US010760088B2

(12) United States Patent
Matarasso et al.

(10) Patent No.: US 10,760,088 B2
(45) Date of Patent: Sep. 1, 2020

(54) ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY

(75) Inventors: Noa Matarasso, Tel-Aviv (IL); Eyal Emmanuel, Rechovot (IL); David Panik, Rehovot (IL); Inbal Nurith Dangoor, Gedera (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 779 days.

(21) Appl. No.: 14/115,397

(22) PCT Filed: May 2, 2012

(86) PCT No.: PCT/IL2012/050154
§ 371 (c)(1),
(2), (4) Date: Nov. 4, 2013

(87) PCT Pub. No.: WO2012/150598
PCT Pub. Date: Nov. 8, 2012

(65) Prior Publication Data
US 2014/0059714 A1 Feb. 27, 2014

Related U.S. Application Data

(60) Provisional application No. 61/537,621, filed on Sep. 22, 2011, provisional application No. 61/481,752, filed on May 3, 2011.

(51) Int. Cl.
*C12N 15/82* (2006.01)
*C07K 14/415* (2006.01)
(52) U.S. Cl.
CPC ........ *C12N 15/8247* (2013.01); *C07K 14/415* (2013.01); *C12N 15/8246* (2013.01); *C12N 15/8261* (2013.01); *C12N 15/8271* (2013.01)
(58) Field of Classification Search
None
See application file for complete search history.

(56) References Cited

U.S. PATENT DOCUMENTS

| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,666,828 A | 5/1987 | Gusella |
| 4,683,202 A | 7/1987 | Mullis |
| 4,801,531 A | 1/1989 | Frossard |
| 4,879,219 A | 11/1989 | Wands et al. |
| 4,943,674 A | 7/1990 | Houck et al. |
| 4,945,050 A | 7/1990 | Sanford et al. |
| 5,011,771 A | 4/1991 | Bellet et al. |
| 5,187,267 A | 2/1993 | Comai et al. |
| 5,192,659 A | 3/1993 | Simons |
| 5,268,463 A | 12/1993 | Jefferson |
| 5,272,057 A | 12/1993 | Smulson et al. |
| 5,281,521 A | 1/1994 | Trojanowski et al. |
| 5,296,462 A | 3/1994 | Thomashow |
| 5,316,931 A | 5/1994 | Donson et al. |
| 5,356,816 A | 11/1994 | Thomashow |
| 5,399,680 A | 3/1995 | Zhu et al. |
| 5,464,765 A | 11/1995 | Coffee et al. |
| 5,466,785 A | 11/1995 | De Framond |
| 5,495,070 A | 2/1996 | John |
| 5,504,200 A | 4/1996 | Hall et al. |
| 5,521,708 A | 5/1996 | Beretta |

(Continued)

FOREIGN PATENT DOCUMENTS

| AU | 2005229157 | 10/2005 |
| AU | 2005234725 | 12/2005 |

(Continued)

OTHER PUBLICATIONS

Marienfeld et al. (DNA Res. 3 (5), 287-290 (1996)).*
Examination Report dated May 11, 2016 From the Instituto Mexicano de la Propiedad Industrial, IMPI Re. Application No. MX/a/2013/012879 and Its Translation Into English.
Applicant-Initiated Interview Summary dated Dec. 20, 2013 From the US Patent and Trademark Office Re. U.S. Appl. No. 13/125,047.
Communication Pursuant to Rule 58 EPC or Rule 159 EPC, Invitation to Remedy Deficiencies in the Application Documents dated Dec. 6, 2013 From the European Patent Office Re. Application No. 11190921.4.
Patent Examination Report dated Jan. 3, 2014 From the Australian Government, IP Australia Re. Application No. 2008278654.

(Continued)

*Primary Examiner* — Charles Logsdon

(57) ABSTRACT

Provided are isolated polynucleotides encoding a polypeptide at least 80% homologous to the amino acid sequence selected from the group consisting of SEQ ID NOs: 757, 456-756, 758-774, 8385-10836, and 10838-14462; and isolated polynucleotide comprising nucleic acid sequences at least 80% identical to SEQ ID NO: 377, 1-376, 378-455, and 775-8384. Also provided are nucleic acid constructs comprising same, isolated polypeptides encoded thereby, transgenic cells and transgenic plants comprising same and methods of using same for increasing yield, biomass, growth rate, vigor, oil content, fiber yield, fiber quality, abiotic stress tolerance, and/or nitrogen use efficiency of a plant.

25 Claims, 8 Drawing Sheets
Specification includes a Sequence Listing.

(56) References Cited

U.S. PATENT DOCUMENTS

| | | |
|---|---|---|
| 5,569,597 A | 10/1996 | Grimsley et al. |
| 5,597,718 A | 1/1997 | John et al. |
| 5,604,121 A | 2/1997 | Hilder et al. |
| 5,608,142 A | 3/1997 | Barton et al. |
| 5,608,144 A | 3/1997 | Baden et al. |
| 5,608,149 A | 3/1997 | Barry et al. |
| 5,608,152 A | 3/1997 | Kridl et al. |
| 5,620,882 A | 4/1997 | John |
| 5,659,026 A | 8/1997 | Baszczynski et al. |
| 5,693,507 A | 12/1997 | Daniell et al. |
| 5,859,330 A | 1/1999 | Bestwick et al. |
| 5,880,100 A | 3/1999 | Ogiso et al. |
| 5,981,834 A | 11/1999 | John et al. |
| 6,080,914 A | 6/2000 | Conner |
| 6,084,153 A | 7/2000 | Good et al. |
| 6,313,375 B1 | 11/2001 | Jung et al. |
| 6,313,376 B1 | 11/2001 | Jung et al. |
| 6,359,196 B1 | 3/2002 | Lok et al. |
| 6,392,122 B1 | 5/2002 | Clendennen et al. |
| 6,403,862 B1 | 6/2002 | Jiao et al. |
| 6,472,588 B1 | 10/2002 | Haigler et al. |
| 6,670,528 B1 | 12/2003 | Shinozaki et al. |
| 6,720,477 B2 | 4/2004 | Da Costa e Silva et al. |
| 7,214,786 B2 | 5/2007 | Kovalic et al. |
| 7,554,007 B2 | 6/2009 | Ronen et al. |
| 7,569,389 B2 | 8/2009 | Feldmann et al. |
| 7,812,218 B2 | 10/2010 | Ronen et al. |
| 7,910,800 B2 | 3/2011 | Karchi et al. |
| 8,049,069 B2 | 11/2011 | Wu et al. |
| 8,168,857 B2 | 5/2012 | Ayal et al. |
| 8,426,682 B2 | 4/2013 | Ronen et al. |
| 2002/0046419 A1 | 4/2002 | Choo et al. |
| 2002/0049999 A1 | 4/2002 | Allen et al. |
| 2002/0148007 A1 | 10/2002 | Jiao et al. |
| 2002/0160378 A1 | 10/2002 | Harper et al. |
| 2002/0170088 A1 | 11/2002 | Wilkins |
| 2003/0005485 A1 | 1/2003 | Ohlrogge et al. |
| 2003/0074697 A1 | 4/2003 | Allen et al. |
| 2003/0084485 A1 | 5/2003 | Zhu et al. |
| 2003/0162294 A1 | 8/2003 | Verbruggen |
| 2003/0163839 A1 | 8/2003 | Helentjaris et al. |
| 2003/0233670 A1 | 12/2003 | Edgerton et al. |
| 2004/0006794 A1 | 1/2004 | Wilkins |
| 2004/0019927 A1 | 1/2004 | Sherman et al. |
| 2004/0031072 A1* | 2/2004 | La Rosa ............... C07K 14/415 800/278 |
| 2004/0034888 A1 | 2/2004 | Liu et al. |
| 2004/0123343 A1 | 6/2004 | La Rosa et al. |
| 2004/0172684 A1* | 9/2004 | Kovalic ............... C07H 21/04 800/284 |
| 2004/0181830 A1 | 9/2004 | Kovalic et al. |
| 2004/0214272 A1* | 10/2004 | La Rosa ............... C07H 21/04 435/69.1 |
| 2005/0108791 A1 | 5/2005 | Edgerton |
| 2006/0048240 A1 | 3/2006 | Alexandrov et al. |
| 2006/0101543 A1 | 5/2006 | Somerville et al. |
| 2006/0107345 A1* | 5/2006 | Alexandrov ......... C07K 14/415 800/278 |
| 2006/0123505 A1 | 6/2006 | Kikuchi et al. |
| 2006/0123516 A1 | 6/2006 | Ronen et al. |
| 2006/0137043 A1 | 6/2006 | Puzio et al. |
| 2006/0143729 A1 | 6/2006 | Alexandrov et al. |
| 2006/0150283 A1 | 7/2006 | Alexandrov et al. |
| 2006/0168684 A1 | 7/2006 | Renz et al. |
| 2006/0174373 A1 | 8/2006 | Gipmans et al. |
| 2006/0179511 A1 | 8/2006 | Chomet et al. |
| 2006/0183137 A1 | 8/2006 | Harper et al. |
| 2006/0195943 A1 | 8/2006 | Feldmann et al. |
| 2006/0206961 A1 | 9/2006 | Cirpus et al. |
| 2006/0260002 A1 | 11/2006 | Ronen et al. |
| 2006/0288451 A1 | 12/2006 | Val et al. |
| 2007/0006345 A1 | 1/2007 | Alexandrov et al. |
| 2007/0006346 A1 | 1/2007 | Alexandrov et al. |
| 2007/0044171 A1 | 2/2007 | Kovalic et al. |
| 2007/0044172 A1 | 2/2007 | Schneeberger et al. |
| 2007/0061916 A1 | 3/2007 | Kovalic et al. |
| 2007/0067865 A1* | 3/2007 | Kovalic ............... C07K 14/415 800/278 |
| 2007/0124833 A1 | 5/2007 | Abad et al. |
| 2007/0169219 A1 | 7/2007 | Nadzan et al. |
| 2007/0214517 A1 | 9/2007 | Alexandrov et al. |
| 2007/0261130 A1 | 11/2007 | Lightner et al. |
| 2007/0271633 A9* | 11/2007 | Kovalic ............... C07H 21/04 800/284 |
| 2007/0277269 A1* | 11/2007 | Alexandrov ......... C07K 14/415 800/290 |
| 2008/0072340 A1 | 3/2008 | Troukhan et al. |
| 2008/0076179 A1 | 3/2008 | Hartel et al. |
| 2008/0148432 A1 | 6/2008 | Abad |
| 2008/0197120 A1 | 8/2008 | Wu et al. |
| 2008/0301839 A1 | 12/2008 | Ravanello |
| 2009/0087878 A9* | 4/2009 | La Rosa ............... C07H 21/04 435/69.1 |
| 2009/0089898 A1 | 4/2009 | Karchi et al. |
| 2009/0093620 A1* | 4/2009 | Kovalic ............... C07K 14/415 536/23.1 |
| 2009/0094717 A1 | 4/2009 | Troukhan et al. |
| 2009/0126042 A1 | 5/2009 | Ronen et al. |
| 2009/0260109 A1 | 10/2009 | Ronen et al. |
| 2009/0293154 A1 | 11/2009 | Yelin et al. |
| 2010/0037352 A1 | 2/2010 | Alexandrov et al. |
| 2010/0083407 A1 | 4/2010 | Feldmann et al. |
| 2010/0154077 A1 | 6/2010 | Emmanuel et al. |
| 2010/0255584 A1 | 10/2010 | Yongwei et al. |
| 2010/0269230 A1 | 10/2010 | Fincher et al. |
| 2010/0319088 A1 | 12/2010 | Ronen et al. |
| 2011/0080674 A1 | 4/2011 | Durand |
| 2011/0214206 A1 | 9/2011 | La Rosa et al. |
| 2012/0060234 A1 | 3/2012 | Emmanuel et al. |
| 2012/0084885 A1 | 4/2012 | Alexandrov et al. |
| 2012/0096587 A1 | 4/2012 | Vinocur et al. |
| 2012/0180164 A1 | 7/2012 | Ayal et al. |
| 2012/0222169 A1 | 8/2012 | Ronen et al. |
| 2012/0297504 A1 | 11/2012 | Granevitze et al. |
| 2013/0125258 A1 | 5/2013 | Emmanuel et al. |
| 2013/0167265 A1 | 6/2013 | Panik et al. |
| 2013/0219562 A1 | 8/2013 | Ronen et al. |
| 2013/0239255 A1 | 9/2013 | Ronen et al. |
| 2013/0276169 A1 | 10/2013 | Poraty et al. |
| 2013/0291223 A1 | 10/2013 | Emmanuel et al. |
| 2019/0119695 A1 | 4/2019 | Matarasso et al. |

FOREIGN PATENT DOCUMENTS

| | | |
|---|---|---|
| CN | 1823168 | 8/2006 |
| EP | 0834566 | 4/1998 |
| EP | 0905242 | 3/1999 |
| EP | 1033405 | 9/2000 |
| EP | 1225231 | 7/2002 |
| EP | 1945021 | 7/2008 |
| EP | 2154946 | 2/2010 |
| JP | 2005-052114 | 3/2005 |
| JP | 2005-185101 | 7/2005 |
| RU | 2350653 | 3/2009 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/40924 | 12/1996 |
| WO | WO 01/17333 | 3/2001 |
| WO | WO 01/40250 | 6/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/035798 | 4/2004 |
| WO | WO 2004/053055 | 6/2004 |
| WO | WO 2004/058963 | 7/2004 |
| WO | WO 2004/081173 | 9/2004 |

(56) References Cited

FOREIGN PATENT DOCUMENTS

| WO | WO 2004/092367 | 10/2004 |
|---|---|---|
| WO | WO 2004/104162 | 12/2004 |
| WO | WO 2004/111183 | 12/2004 |
| WO | WO 2005/084331 | 9/2005 |
| WO | WO 2005/095614 | 10/2005 |
| WO | WO 2005/108422 | 11/2005 |
| WO | WO 2005/121364 | 12/2005 |
| WO | WO 2006/138012 | 12/2006 |
| WO | WO 2007/020638 | 2/2007 |
| WO | WO 2007/049275 | 5/2007 |
| WO | WO 2007/110314 | 10/2007 |
| WO | WO 2007/113237 | 10/2007 |
| WO | WO 2008/069878 | 6/2008 |
| WO | WO 2008/075364 | 6/2008 |
| WO | WO 2008/122980 | 10/2008 |
| WO | WO 2009/009142 | 1/2009 |
| WO | WO 2009/013750 | 1/2009 |
| WO | WO 2009/083958 | 7/2009 |
| WO | WO 2009/141824 | 11/2009 |
| WO | WO 2009/144311 | 12/2009 |
| WO | WO 2010/020941 | 2/2010 |
| WO | WO 2010/039750 | 4/2010 |
| WO | WO 2010/049897 | 5/2010 |
| WO | WO 2010/076756 | 7/2010 |
| WO | WO 2010/099084 | 9/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/128448 | 9/2013 |
| WO | WO 2013/179211 | 12/2013 |
| WO | WO 2014/188428 | 11/2014 |
| WO | WO 2015/029031 | 3/2015 |
| WO | WO 2015/181823 | 12/2015 |

OTHER PUBLICATIONS

Patent Examination Report dated May 13, 2016 From the Australian Government, IP Australia Re. Application No. 2012251353.
Patent Examination Report dated Jan. 7, 2016 From the Australian Government, IP Australia Re. Application No. 2012251353.
Official Action dated Jan. 9, 2014 From the US Patent and Trademark Office Re. U.S. Appl. No. 12/992,902.
Bork et al. "Go Hunting in Sequence Databases But Watch Out for the Traps", Trends in Genetics, TIG, 12(10): 425-427, Oct. 1996.
Doerks et al. "Protein Annotation: Detective Work for Function Prediction", Trends in Genetics, TIG, 14(6): 248-250, Jun. 1998.
Smith et al. "The Challenges of Genome Sequence Annotation or 'The Devil Is in the Details'", Nature Biotechnology, 15: 1222-1223, Nov. 1997.
Examination Report dated Nov. 30, 2016 From the Instituto Mexicano de la Propiedad Industrial, IMPI Re. Application No. MX/a/2013/012879 and Its Translation Into English.
Examination Report dated Oct. 4, 2017 Fiom the Australian Government, IP Australia Re. Application No. 2017200521. (3 Pages).
Examination Report dated Aug. 4, 2017 From the Instituto Mexicano de la Propiedad Industrial, IMPI, Direccion Divisional de Patentes Re. Application No. MX/a/2013/012879 and Its Translation Into English. (6 Pages).
Examination Report dated Feb. 1, 2018 From the Government of India, Patent Office, Intellectual Property Building Re.: Application No. 2834027. (10 Pages).
Examination Report dated Mar. 14, 2018 From the Australian Government, IP Australia Re. Application No. 2017200521. (8 Pages).
Requisition by the Examiner dated Oct. 23, 2018 From the Canadian Intellectual Property Office Re. Application No. 2834027. (6 Pages).
Clarifications Prior to Substantive Examination dated Jul. 17, 2019 from Argentinean Industrial Property National Institute Re. Application No. P20120101545 and Its English Summary. (7 pages).
Bray et al. "Genes Commonly Regulated by Water-Deficit Stress in *Arabidopsis thaliana*," Journal of Experimental Botany 55(407): 2331-2341, 2004.
Kim et al. "A Genetic Link Between Cold Responses and Flowering Time through FVE in *Arabidopsis thaliana*," Nature Genetics 36: 167-171, 2004.
Requisition by the Examiner dated Nov. 4, 2019 From the Canadian Intellectual Property Office Re. Application No. 2834027. (3 Pages).
Axe "Extreme Functional Sensitivity to Conservative Amino Acid Changes on Enzyme Exteriors," Journal of Molecular Biology 301(3): 585-595, 2000.
Search Report dated Jun. 21, 2019 from the Brazilian Patent Office Re. Application No. BR 11 2013 028383.1 and its English Translation. (8 pages).
Communication Pursuant to Article 94(3) EPC dated Dec. 8, 2008 From the European Patent Office Re. Application No. 04734072.4.
International Preliminary Report on Patentability dated Dec. 8, 2005 From the International Bureau of WIPO Re. Application No. PCT/IL2004/000431.
International Preliminary Report on Patentability dated Jan. 22, 2009 From the International Bureau of WIPO Re. Application No. PCT/IL2006/001223.
Invitation to Pay Additional Fees dated Feb. 7, 2008 From the International Searching Authority Re. Application No. PCT/IL06/001223.
Invitation to Pay Additional Fees dated Dec. 18, 2008 From the International Searching Authority Re. Application No. PCT/IL08/01024.
Advisory Action Before the Filing of an Appeal Brief dated Aug. 5, 2011 From the US Patent and Trademark Office Re. U.S. Appl. No. 12/083,978.
Advisory Action Before the Filing of an Appeal Brief dated Nov. 19, 2013 From the US Patent and Trademark Office Re. U.S. Appl. No. 12/834,106.
Advisory Action Before the Filing of an Appeal Brief dated Aug. 29, 2012 From the US Patent and Trademark Office Re. U.S. Appl. No. 12/457,199.
Applicant-Initiated Interview Summary dated Aug. 6, 2012 From the US Patent and Trademark Office Re. U.S. Appl. No. 12/669,975.
Communication Pursuant to Article 94(3) EPC dated Aug. 2, 2013 From the European Patent Office Re. Application No. 10194223.3.
Communication Pursuant to Article 94(3) EPC dated Apr. 3, 2012 From the European Patent Office Re.: Application No. 06766224.7.
Communication Pursuant to Article 94(3) EPC dated Jan. 3, 2013 From the European Patent Office Re. Application No. 09807983.3.
Communication Pursuant to Article 94(3) EPC dated Jul. 4, 2012 From the European Patent Office Re. Application No. 10194223.3.
Communication Pursuant to Article 94(3) EPC dated Nov. 7, 2013 From the European Patent Office Re. Application No. 10748403.2.
Communication Pursuant to Article 94(3) EPC dated Mar. 8, 2011 From the European Patent Office Re.: Application No. 06809784.9.
Communication Pursuant to Article 94(3) EPC dated May 8, 2013 From the European Patent Office Re. Application No. 08776651.5.
Communication Pursuant to Article 94(3) EPC dated Nov. 8, 2010 From the European Patent Office Re.: Application No. 04734072.4.
Communication Pursuant to Article 94(3) EPC dated Oct. 9, 2013 From the European Patent Office Re. Application No. 08869158.9.
Communication Pursuant to Article 94(3) EPC dated Sep. 9, 2009 From the European Patent Office Re.: Application No. 04734072.4.
Communication Pursuant to Article 94(3) EPC dated May 12, 2010 From the European Patent Office Re.: Application No. 06766224.7.
Communication Pursuant to Article 94(3) EPC dated Feb. 13, 2009 From the European Patent Office Re.: Application No. 05750089.4.
Communication Pursuant to Article 94(3) EPC dated Jul. 13, 2012 From the European Patent Office Re. Application No. 11172514.9.
Communication Pursuant to Article 94(3) EPC dated Feb. 14, 2012 From the European Patent Office Re.: Application No. 04734072.4.
Communication Pursuant to Article 94(3) EPC dated Mar. 14, 2011 From the European Patent Office Re. Application No. 07849616.3.

(56) References Cited

OTHER PUBLICATIONS

Communication Pursuant to Article 94(3) EPC dated Jun. 15, 2012 From the European Patent Office Re. Application No. 11154193.4.
Communication Pursuant to Article 94(3) EPC dated Dec. 19, 2012 From the European Patent Office Re.: Application No. 04734072.4.
Communication Pursuant to Article 94(3) EPC dated Nov. 19, 2010 From the European Patent Office Re.: Application No. 06809784.9.
Communication Pursuant to Article 94(3) EPC dated Aug. 20, 2013 From the European Patent Office Re. Application No. 11172514.9.
Communication Pursuant to Article 94(3) EPC dated Jun. 21, 2012 From the European Patent Office Re. Application No. 11154213.0.
Communication Pursuant to Article 94(3) EPC dated Oct. 23, 2012 From the European Patent Office Re. Application No. 11154193.4.
Communication Pursuant to Article 94(3) Epc dated Oct. 23, 2012 From the European Patent Office Re. Application No. 11154213.0.
Communication Pursuant to Article 94(3) EPC dated Nov. 27, 2009 From the European Patent Office Re.: Application No. 06809784.9.
Communication Pursuant to Article 94(3) EPC dated Jun. 29, 2011 From the European Patent Office Re. Application No. 08738191.9.
Communication Pursuant to Article 94(3) EPC dated May 29, 2013 From the European Patent Office Re. Application No. 09823171.5.
Communication Pursuant to Rule 55 EPC dated Mar. 16, 2012 From the European Patent Office Re. Application No. 11190921.4.
Communication Pursuant to Rule 58 EPC or Rule 159 EPC, Invitation to Remedy Deficiencies in the Application Documents dated Jan. 19, 2012 From the European Patent Office Re. Application No. 11190922.2.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC dated Jul. 18, 2011 From the European Patent Office Re. Application No. 11154193.4.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC dated Jul. 25, 2011 From the European Patent Office Re. Application No. 11154213.0.
Communication Pursuant to Rule 70(2) EPC and Reference to Rule 39(1) EPC dated Sep. 13, 2010 From the European Patent Office Re.: Application No. 09163033.5.
Communication Pursuant to Rules 70(2) and 70a(2) EPC and Reference to Rule 39(1) EPC dated Dec. 5, 2011 From the European Patent Office Re. Application No. 10194223.3.
Communication Pursuant to Rules 70(2) and 70a(2) EPC and Reference to Rule 39(1) EPC dated Nov. 7, 2011 From the European Patent Office Re. Application No. 11172514.9.
Communication Pursuant to Rules 70(2) and 70a(2) EPC dated Nov. 4, 2013 From the European Patent Office Re. Application No. 10840687.7.
Communication Pursuant to Rules 70(2) and 70a(2) EPC dated Mar. 5, 2013 From the European Patent Office Re. Application No. 10785834.2.
Communication Pursuant to Rules 70(2) and 70a(2) EPC dated May 7, 2012 From the European Patent Office Re. Application No. 09823171.5.
Communication Pursuant to Rules 70(2) and 70a(2) EPC dated Jan. 19, 2012 From the European Patent Office Re. Application No. 09807983.3.
Communication Pursuant to Rules 70(2) and 70a(2) EPC dated Jul. 24, 2012 From the European Patent Office Re. Application No. 10748403.2.
Communication Pursuant to Rules 70(2) and 70a(2) EPC dated May 24, 2011 From the European Patent Office Re. Application No. 09750276.9.
Communication Pursuant to Rules 70(2) and 70a(2) EPC dated Aug. 30, 2010 From the European Patent Office Re. Application No. 08738191.9.
Communication Relating to the Results of the Partial International Search dated Jul. 8, 2009 From the International Searching Authority Re.: Application No. PCT/IL2008/001657.
Communication Under Rule 71(3) EPC dated Jun. 5, 2012 From the European Patent Office Re.: Application No. 06809784.9.
Communication Under Rule 71(3) EPC dated Nov. 19, 2012 From the European Patent Office Re. Application No. 08738191.9.
Decision on Granting a Patent for Invention dated Dec. 7, 2010 From the ROSPATENT, Federal State Institution, Federal Institute for Industrial Property of the Federal Service for Intellectual Property, Patents and Trademarks of the Russian Federation Re. Application No. 2008120395 and Its Translation Into English.
English Summary of Examination Results dated Dec. 28, 2012 From the National Office of Intellectual Property (NOIP) of Vietnam Re. Application No. 1-2009-02358.
European Search Report and the European Search Opinion dated Nov. 2, 2011 From the European Patent Office Re. Application No. 10194223.3.
European Search Report and the European Search Opinion dated Oct. 6, 2011 From the European Patent Office Re. Application No. 11172514.9.
European Search Report and the European Search Opinion dated Aug. 9, 2010 From the European Patent Office Re.: Application No. 09163033.5.
European Search Report and the European Search Opinion dated Jun. 14, 2011 From the European Patent Office Re. Application No. 11154193.4.
European Search Report and the European Search Opinion dated Jun. 21, 2011 From the European Patent Office Re. Application No. 11154213.0.
Examination Report dated Aug. 1, 2011 From the Government of India, Patent Office Re. Application No. 158/CHENP/2007.
Examination Report dated Nov. 3, 2010 From the Government of India, Patent Office Re.: Application No. 158/CHENP/2007.
Examination Report dated Jun. 6, 2012 From the Federal Service of Intellectual Property, Federal State Budget Institute, Federal Institute of Industrial Property of the Russian Federation Re. Application No. 2011113420 and Its Translation Into English.
Examination Report dated Dec. 7, 2012 From the Instituto Mexicano de la Propiedad Industrial Re. Application No. MX/a/2011/003575 and Its Translation Into English.
Examination Report dated Jun. 7, 2013 From the Instituto Mexicano de la Propiedad Industrial Re. Application No. MX/a/2011/003575 and Its Translation Into English.
Examination Report dated Jul. 9, 2013 From the Instituto Mexicano de la Propiedad Industrial Re. Application No. MX/a/2010/007169 and Its Translation Into English.
Examination Report dated Jun. 11, 2012 From the Instituto Mexicano de la Propiedad Industrial Re. Application No. MX/a/2011/007294 and Summary in English.
Examination Report dated Mar. 13, 2013 From the Instituto Mexicano de la Propiedad Industrial Re. Application No. PA/a/2005/009380 and Its Summary in English.
Examination Report dated Nov. 13, 2007 From the Government of India, Patent Office Re.: Application No. 3482/CHENP/2005.
Examination Report dated Sep. 14, 2012 From the Australian Government IP Australia Re. Application No. 2007335706.
Examination Report dated Oct. 15, 2012 From the Instituto Mexicano de la Propiedad Industrial Re. Application No. MX/a/2009/006660 and Its Translation Into English.
Examination Report dated Aug. 16, 2012 From the Instituto Mexicano de la Propiedad Industrial Re. Application No. MX/a/2010/014097 and Its Translation Into English.
Examination Report dated Feb. 17, 2010 From the Instituto Mexicano de la Propriedad Industrial Re. Application No. PA/a/2005/012565 and Its Summary in English.
Examination Report dated Apr. 19, 2011 From the Instituto Mexicano de la Propriedad Industrial Re. Application No. MX/a/2008/002262 and Its Summary Into English.
Examination Report dated Dec. 19, 2011 From the Federal Service of Intellectual Property, Federal State Budget Institute, Federal Institute of Industrial Property of the Russian Federation Re. Application No. 2011113420 and Its Translation Into English.
Examination Report dated Jun. 20, 2013 From the Instituto Mexicano de la Propiedad Industrial Re. Application No. MX/a/2011/007294 and Its Translation Into English.

(56) References Cited

OTHER PUBLICATIONS

Examination Report dated Aug. 22, 2013 From the Instituto Mexicano de la Propiedad Industrial Re. Application No. MX/a/2011/009044 and Its Translation Into English.
Examination Report dated Sep. 22, 2010 From the Instituto Mexicano de la Propriedad Industrial Re. Application No. MX/a/2008/005280 and Its Summary Into English.
Examination Report dated Mar. 23, 2013 From the Government of India, Patent Office, Intellectual Property Building Re. Application No. 2570/CHENP/2008.
Examination Report dated May 23, 2013 From the Instituto Mexicano de la Propiedad Industrial Re. Application No. MX/a/2011/001741 and Its Translation Into English.
Examination Report dated Jun. 25, 2012 From the Instituto Mexicano de la Propiedad Industrial Re. Application No. MX/a/2011/003575 and Its Translation Into English.
Examination Report dated May 25, 2011 From the Government of India, Patent Office Re.: Application No. 158/CHENP/2007.
Examination Report dated Jun. 26, 2013 From the Instituto Mexicano de la Propiedad Industrial Re. Application No. MX/a/2010/000975 and Its Translation Into English.
Examination Report dated Jul. 29, 2013 From the Instituto Mexicano de la Propiedad Industrial Re. Application No. MX/a/2010/012697 and Its Translation Into English.
Examiner's Report dated Aug. 1, 2011 From the Australian Government, IP Australia Re. Application No. 2005234725.
Examiner's Report dated Jan. 10, 2012 From the Australian Government, IP Australia Re. Application No. 2005234725.
Examiner's Report dated Jan. 13, 2011 From the Australian Government, IP Australia Re.: Application No. 2005252469.
Examiner's Report dated Jan. 13, 2012 From the Australian Government, IP Australia Re. Application No. 2011239323.
Examiner's Report dated Mar. 15, 2012 From the Australian Government, IP Australia Re. Application No. 2011239323.
Examiner's Report dated Dec. 17, 2009 From the Australian Government, IP Australia Re.: Application No. 2005252469.
Examiner's Report dated Oct. 19, 2011 From the Australian Government, IP Australia Re. Application No. 2006281018.
Examiner's Report dated Dec. 20, 2010 From the Australian Government, IP Australia Re. Application No. 2005234725.
Examiner's Report dated Jul. 21, 2011 From the Australian Government, IP Australia Re. Application No. 2005234725.
Examiner's Report dated Jun. 24, 2011 From the Australian Government, IP Australia Re. Application No. 2006281018.
Examiner's Report dated Oct. 28, 2011 From the Australian Government, IP Australia Re. Application No. 2006307457.
Examinees Report dated Jun. 30, 2011 From the Australian Government, IP Australia Re. Application No. 2006307457.
Examiner's Report dated Jan. 31, 2012 From the Australian Government, IP Australia Re. Application No. 2006281018.
Examiner's Report dated Mar. 31, 2011 From the Australian Government, IP Australia Re.: Application No. 2005252469.
International Preliminary Report on Patentability dated Dec. 1, 2011 From the International Bureau of WIPO Re. Application No. PCT/IL2008/000489.
International Preliminary Report on Patentability dated Dec. 2, 2010 From the International Bureau of WIPO Re. Application No. PCT/IL2009/000508.
International Preliminary Report on Patentability dated Mar. 3, 2011 From the International Bureau of WIPO Re.: Application No. PCT/IB2009/053633.
International Preliminary Report on Patentability dated Feb. 4, 2010 From the International Bureau of WIPO Re.: Application No. PCT/IL2008/001024.
International Preliminary Report on Patentability dated Jul. 4, 2013 From the International Bureau of WIPO Re. Application No. PCT/IB2011/055854.
International Preliminary Report on Patentability dated Jul. 8, 2010 From the International Bureau of WIPO Re.: Application No. PCT/IL2008/001657.
International Preliminary Report on Patentability dated Apr. 12, 2012 From the Interantional Bureau of WIPO Re. Application No. PCT/IB2010/052545.
International Preliminary Report on Patentability dated Jul. 12, 2012 From the International Bureau of WIPO Re. Application No. PCT/IB2010/056023.
International Preliminary Report on Patentability dated May 12, 2011 From the International Bureau of WIPO Re. Application No. PCT/IB2009/054774.
International Preliminary Report on Patentability dated Jan. 14, 2010 From the International Bureau of WIPO Re.: Application No. PCT/IL2008/000489.
International Preliminary Report on Patentability dated Mar. 14, 2013 From the International Bureau of WIPO Re. Application No. PCT/IB2011/053697.
International Preliminary Report on Patentability dated Sep. 15, 2011 From the International Bureau of WIPO Re. Application No. PCT/IB2010/050871.
International Preliminary Report on Patentability dated Feb. 21, 2013 From the International Bureau of WIPO Re. Application No. PCT/IB2011/051843.
International Preliminary Report on Patentability dated Jan. 21, 2010 From the International Bureau of WIPO Re.: Application No. PCT/IL2007/001590.
International Preliminary Report on Patentability dated Jan. 22, 2009 From the International Bureau of WIPO Re.: Application No. PCT/IL2006/000947.
International Preliminary Report on Patentability dated Mar. 29, 2007 From the International Bureau of WIPO Re.: Application No. PCT/IL2005/000627.
International Preliminary Report on Patentability dated Jan. 30, 2007 From the International Bureau of WIPO Re.: Application No. PCT/IL05/00627.
International Search Report and the Written Opinion dated Sep. 1, 2013 From the International Searching Authority Re. Application No. PCT/IB2013/054374.
International Search Report and the Written Opinion dated Jun. 2, 2010 From the International Searching Authority Re. Application No. PCT/IB09/53633.
International Search Report and the Written Opinion dated Jun. 2, 2010 From the International Searching Authority Re.: Application No. PCT/IB09/54774.
International Search Report and the Written Opinion dated Aug. 6, 2012 From the International Searching Authority Re. Application No. PCT/IB2011/053697.
International Search Report and the Written Opinion dated Dec. 6, 2011 From the International Searching Authority Re. Application No. PCT/IB2011/051843.
International Search Report and the Written Opinion dated Sep. 6, 2012 From the International Searching Authority Re. Application No. PCT/IB2011/055854.
International Search Report and the Written Opinion dated Jan. 7, 2013 From the International Searching Authority Re. Application No. PCT/IL2012/050154.
International Search Report and the Written Opinion dated Sep. 7, 2010 From the International Searching Authority Re. Application No. PCT/IB10/50871.
International Search Report and the Written Opinion dated Apr. 10, 2013 From the International Searching Authority Re. Application No. PCT/IL2012/050327.
International Search Report and the Written Opinion dated May 12, 2013 From the International Searching Authority Re. Application No. PCT/IL2013/050172.
International Search Report and the Written Opinion dated Mar. 16, 2012 From the International Searching Authority Re. Application No. PCT/IB2010/052545.
International Search Report and the Written Opinion dated Feb. 17, 2010 From the International Searching Authority Re.: Application No. PCT/IL09/00508.
International Search Report and the Written Opinion dated Nov. 19, 2013 From the International Searching Authority Re. Application No. PCT/IL2013/050725.

(56) References Cited

OTHER PUBLICATIONS

International Search Report and the Written Opinion dated Aug. 22, 2011 From the International Searching Authority Re. Application No. PCT/IB2010/056023.
International Search Report and the Written Opinion dated Nov. 24, 2008 From the International Searching Authority Re.: Application No. PCT/IL08/00489.
International Search Report and the Written Opinion dated Jul. 29, 2008 From the International Searching Authority Re.: Application No. PCT/IL06/001223.
International Search Report and the Written Opinion dated Oct. 30, 2009 From the International Searching Authority Re.: Application No. PCT/IL2008/001657.
International Search Report and the Written Opinion dated Oct. 31, 2011 From the International Searching Authority Re.: Application No. PCT/IL08/00489.
International Search Report dated Jul. 2, 2009 From the International Searching Authority Re.: Application No. PCT/IL07/01590.
International Search Report dated Jan. 3, 2007 From the International Searching Authority Re.: Application No. PCT/IL2005/000627.
International Search Report dated Mar. 4, 2009 From the International Searching Authority Re.: Application No. PCT/IL08/01024.
International Search Report dated Nov. 4, 2005 From the International Searching Authority Re.: Application No. PCT/IL04/00431.
International Search Report dated Aug. 27, 2008 From the International Searching Authority Re.: Application No. PCT/IL06/00947.
Invitation to Pay Additional Fees dated Mar. 2, 2010 From the International Searching Authority Re.: Application No. PCT/IB09/53633.
Invitation to Pay Additional Fees dated Apr. 8, 2013 From the International Searching Authority Re. Application No. PCT/IL2013/050172.
Invitation to Pay Additional Fees dated May 8, 2012 From the International Searching Authority Re. Application No. PCT/IB2011/053697.
Invitation to Pay Additional Fees dated Sep. 8, 2006 From the International Searching Authority Re.: Application No. PCT/IL05/00627.
Invitation to Pay Additional Fees dated Jun. 9, 2011 From the International Searching Authority Re. Application No. PCT/IB2010/056023.
Invitation to Pay Additional Fees dated Jun. 15, 2012 From the International Searching Authority Re. Application No. PCT/IB2011/055854.
Invitation to Pay Additional Fees dated Oct. 16, 2013 From the International Searching Authority Re. Application No. PCT/IL2013/050725.
Invitation to Pay Additional Fees dated Jul. 17, 2013 From the International Searching Authority Re. Application No. PCT/IB2013/054374.
Invitation to Pay Additional Fees dated Oct. 17, 2012 From the International Searching Authority Re. Application No. PCT/IL2012/050154.
Invitation to Pay Additional Fees dated Aug. 18, 2011 From the International Searching Authority Re.: Application No. PCT/IL08/00489.
Invitation to Pay Additional Fees dated Nov. 19, 2009 From the International Searching Authority Re.: Application No. PCT/IL09/00508.
Invitation to Pay Additional Fees dated Aug. 23, 2005 From the International Search Authority Re. Application No. PCT/IL2004/000431.
Invitation to Pay Additional Fees dated Dec. 27, 2011 From the International Searching Authority Re. Application No. PCT/IB2010/052545.
Invitation to Pay Additional Fees dated Dec. 31, 2012 From the International Searching Authority Re. Application No. PCT/IL2012/050327.
Notice of Allowance dated Dec. 5, 2011 From the US Patent and Trademark Office Re. U.S. Appl. No. 12/448,359.
Notice of Allowance dated Jan. 7, 2013 From the US Patent and Trademark Office Re. U.S. Appl. No. 12/457,199.
Notice of Allowance dated Apr. 8, 2013 From the US Patent and Trademark Office Re. U.S. Appl. No. 12/594,853.
Notice of Allowance dated Aug. 11, 2010 From the Instituto Mexicano de la Propriedad Industrial Re. Application No. PA/a/2005/012565.
Notice of Allowance dated Nov. 15, 2013 From the US Patent and Trademark Office Re. U.S. Appl. No. 12/669,975.
Notice of Allowance dated Apr. 16, 2010 From the US Patent and Trademark Office Re.: U.S. Appl. No. 11/629,411.
Notice of Allowance dated Oct. 18, 2010 From the US Patent and Trademark Office Re.: U.S. Appl. No. 11/990,386.
Notice of Allowance dated Nov. 19, 2012 From the US Patent and Trademark Office Re. U.S. Appl. No. 13/450,547.
Notice of Grant dated Jan. 14, 2011 From the Instituto Mexicano de la Propriedad Industrial Re. Application No. MX/a/2008/005280.
Office Action dated Apr. 1, 2013 From the State Intellectual Property Office of the People's Republic of China Re. Application No. 200880127757.X and Its Translation Into English.
Office Action dated Jan. 2, 2012 From the Israel Patent Office Re. Application No. 206118 and Its Translation Into English.
Office Action dated Feb. 3, 2011 From the Israel Patent Office Re.: Application No. 172135 and Its Translation Into English.
Office Action dated Aug. 4, 2010 From the Israel Patent Office Re.: Application No. 172135 and Its Translation Into English.
Office Action dated Jan. 9, 2009 From the State Intellectual Property Office of the People's Republic of China Re.: Application No. 200480020597.0.
Office Action dated Sep. 9, 2013 From the State Intellectual Property Office of the People's Republic of China Re. Application No. 200910217137.1 and Its Translation Into English.
Office Action dated Nov. 11, 2010 From the Israel Patent Office Re. Application No. 206118 and Its Translation Into English.
Office Action dated May 13, 2010 From the Israel Patent Office Re. Application No. 180022 and Its Translation Into English.
Office Action dated Jun. 17, 2010 From the Israel Patent Office Re. Application No. 190918 and Its Translation Into English.
Office Action dated Oct. 18, 2010 From the Israel Patent Office Re. Application No. 180022 and Its Translation Into English.
Office Action dated Jun. 19, 2011 From the Israel Patent Office Re. Application No. 199391 and Its Translation Into English.
Office Action dated Jun. 20, 2011 From the Israel Patent Office Re. Application No. 190918 and Its Translation Into English.
Office Action dated Jan. 22, 2010 From the State Intellectual Property Office of the People's Republic of China Re.: Application No. 200580027481.4 and Its Translation Into English.
Office Action dated Sep. 22, 2011 From the Israeli Patent Office Re. Application No. 201242 and Its Translation Into English.
Office Action dated Jun. 25, 2012 From the State Intellectual Property Office of the People's Republic of China Re.: Application No. 200880109464.9 and Its Translation Into English.
Office Action dated Apr. 27, 2009 From the Israeli Patent Office Re.: Application No. 172135 and Its Translation Into English.
Office Action dated Oct. 28, 2013 From the State Intellectual Property Office of the People's Republic of China Re. Application No. 201110104274.1 and Its Translation Into English.
Office Action dated Jan. 31, 2010 From the Israel Patent Office Re.: Application No. 172135 and Its Translation Into English.
Office Letter dated Jul. 7, 2008 From the Government of India, Patent Office Re.: Application No. 3482/CHENP/2005.
Official Action dated May 1, 2009 From the US Patent and Trademark Office Re.: U.S. Appl. No. 11/629,411.
Official Action dated Sep. 2, 2009 From the US Patent and Trademark Office Re.: U.S. Appl. No. 11/629,411.
Official Action dated Feb. 8, 2013 From the US Patent and Trademark Office Re. U.S. Appl. No. 12/594,853.
Official Action dated Jul. 8, 2011 From the US Patent and Trademark Office Re. U.S. Appl. No. 12/083,978.
Official Action dated Jun. 8, 2010 From the US Patent and Trademark Office Re.: U.S. Appl. No. 11/629,411.

(56) References Cited

OTHER PUBLICATIONS

Official Action dated May 8, 2013 From the US Patent and Trademark Office Re. U.S. Appl. No. 13/125,047.
Official Action dated Apr. 10, 2012 From the US Patent and Trademark Office Re. U.S. Appl. No. 12/669,975.
Official Action dated May 10, 2011 From the US Patent and Trademark Office Re. U.S. Appl. No. 12/457,199.
Official Action dated Aug. 12, 2013 From the US Patent and Trademark Office Re. U.S. Appl. No. 12/834,106.
Official Action dated Jun. 13, 2012 From the US Patent and Trademark Office Re. U.S. Appl. No. 12/594,853.
Official Action dated May 14, 2012 From the US Patent and Trademark Office Re. U.S. Appl. No. 12/457,199.
Official Action dated Feb. 15, 2011 From the US Patent and Trademark Office Re. U.S. Appl. No. 12/448,359.
Official Action dated May 15, 2009 From the US Patent and Trademark Office Re.: U.S. Appl. No. 11/990,386.
Official Action dated Sep. 16, 2013 From the US Patent and Trademark Office Re. U.S. Appl. No. 13/125,047.
Official Action dated Jul. 17, 2012 From the US Patent and Trademark Office Re. U.S. Appl. No. 12/834,106.
Official Action dated Aug. 18, 2010 From the US Patent and Trademark Office Re. U.S. Appl. No. 12/083,978.
Official Action dated Dec. 18, 2012 From the US Patent and Trademark Office Re. U.S. Appl. No. 12/834,106.
Official Action dated Jan. 18, 2013 From the US Patent and Trademark Office Re. U.S. Appl. No. 12/669,975.
Official Action dated Oct. 18, 2007 From the US Patent and Trademark Office Re. U.S. Appl. No. 11/284,236.
Official Action dated Jun. 19, 2012 From the US Patent and Trademark Office Re. U.S. Appl. No. 13/450,547.
Official Action dated Sep. 19, 2011 From the US Patent and Trademark Office Re. U.S. Appl. No. 12/810,855.
Official Action dated May 20, 2013 From the US Patent and Trademark Office Re. U.S. Appl. No. 13/059,231.
Official Action dated Sep. 20, 2013 From the US Patent and Trademark Office Re. U.S. Appl. No. 12/669,975.
Official Action dated Dec. 21, 2011 From the US Patent and Trademark Office Re. U.S. Appl. No. 12/810,855.
Official Action dated Aug. 22, 2011 From the Its Patent and Trademark Office Re. U.S. Appl. No. 12/457,199.
Official Action dated Oct. 22, 2009 From the US Patent and Trademark Office Re.: U.S. Appl. No. 11/990,386.
Official Action dated Nov. 23, 2010 From the US Patent and Trademark Office Re. U.S. Appl. No. 12/083,978.
Official Action dated Jun. 24, 2013 From the US Patent and Trademark Office Re. U.S. Appl. No. 12/992,902.
Official Action dated Jul. 26, 2013 From the US Patent and Trademark Office Re. U.S. Appl. No. 13/254,183.
Official Action dated Jul. 28, 2008 From the US Patent and Trademark Office Re. U.S. Appl. No. 11/284,236.
Official Action dated Apr. 29, 2011 From the US Patent and Trademark Office Re. U.S. Appl. No. 12/448,359.
Official Action dated Oct. 29, 2013 From the US Patent and Trademark Office Re. U.S. Appl. No. 13/059,231.
Partial European Search Report dated Jul. 12, 2011 From the European Patent Office Re. Application No. 10194223.3.
Partial European Search Report dated Apr. 19, 2010 From the European Patent Office Re.: Application No. 09163033.5.
Patent Examination Report dated Jan. 4, 2013 From the Australian Government, IP Australia Re. Application No. 2008344935.
Patent Examination Report dated Dec. 12, 2012 From the Australian Government, IP Australia Re. Application No. 2008236316.
Patent Examination Report dated Jun. 21, 2013 From the Australian Government, IP Australia Re. Application No. 2012241091.
Patent Examination Report dated Jun. 27, 2013 From the Australian Government, IP Australia Re. Application No. 2012216482.
Patent Examination Report dated May 31, 2013 From the Australian Government, IP Australia Re. Application No. 2008278654.
Requisition—Sequence Listing dated May 8, 2013 From the Canadian Intellectual Property Office Re. Application No. 2,753,616.
Requisition by the Examiner dated Feb. 2, 2012 From the Canadian Intellectual Property Office Re. Application No. 2,570,195.
Requisition by the Examiner dated Oct. 3, 2012 From the Canadian Intellectual Property Office Re. Application No. 2,526,440.
Requisition by the Examiner dated Apr. 11, 2013 From the Canadian Intellectual Property Office Re. Application No. 2,626,592.
Requisition by the Examiner dated Feb. 12, 2013 From the Canadian Intellectual Property Office Re. Application No. 2,570,195.
Requisition by the Examiner dated Jun. 15, 2011 From the Canadian Intellectual Property Office Re. Application No. 2,526,440.
Requisition by the Examiner dated Mar. 25, 2013 From the Canadian Intellectual Property Office Re. Application No. 2,619,114.
Requisition by the Examiner dated Aug. 27, 2013 From the Canadian Intellectual Property Office Re. Application No. 2,526,440.
Restriction Official Action dated Feb. 1, 2012 From the US Patent and Trademark Office Re. U.S. Appl. No. 12/669,975.
Restriction Official Action dated Mar. 1, 2013 From the US Patent and Trademark Office Re. U.S. Appl. No. 13/254,183.
Restriction Official Action dated Apr. 4, 2013 From the US Patent and Trademark Office Re. U.S. Appl. No. 13/125,047.
Restriction Official Action dated Apr. 11, 2012 From the US Patent and Trademark Office Re. U.S. Appl. No. 12/834,106.
Restriction Official Action dated Feb. 13, 2012 From the US Patent and Trademark Office Re. U.S. Appl. No. 12/594,853.
Restriction Official Action dated Nov. 13, 2012 From the US Patent and Trademark Office Re. U.S. Appl. No. 12/992,902.
Substantive Examination Report dated Jul. 31, 2013 From the Intellectual Property Office of the Philippines, Bureau of Patents Re. Application No. 1/2009/501930.
Summary of Office Action dated Sep. 2, 2010 From the ROSPATENT, Federal State Institution, Federal Institute for Industrial Property of the Federal Service for Intellectual Property, Patents and Trademarks of the Russian Federation Re. Application No. 2008120395.
Supplementary European Search Report and the European Search Opinion dated Feb. 1, 2010 From the European Patent Office Re.: Application No. 06766224.7.
Supplementary European Search Report and the European Search Opinion dated Jul. 1, 2010 From the European Patent Office Re. Application No. 07849616.3.
Supplementary European Search Report and the European Search Opinion dated Jan. 2, 2012 From the European Patent Office Re. Application No. 09807983.3.
Supplementary European Search Report and the European Search Opinion dated Jul. 6, 2012 From the European Patent Office Re. Application No. 10748403.2.
Supplementary European Search Report and the European Search Opinion dated May 6, 2011 From the European Patent Office Re. Application No. 09750276.9.
Supplementary European Search Report and the European Search Opinion dated Aug. 11, 2010 From the European Patent Office Re. Application No. 08738191.9.
Supplementary European Search Report and the European Search Opinion dated Feb. 14, 2013 From the European Patent Office Re. Application No. 10785834.2.
Supplementary European Search Report and the European Search Opinion dated Sep. 14, 2009 From the European Patent Office Re.: Application No. 06809784.9.
Supplementary European Search Report and the European Search Opinion dated Oct. 15, 2013 From the European Patent Office Re. Application No. 10840687.7.
Supplementary European Search Report and the European Search Opinion dated Apr. 18, 2012 From the European Patent Office Re. Application No. 09823171.5.
Supplementary European Search Report and the European Search Opinion dated Jul. 29, 2010 From the European Patent Office Re. Application No. 08776651.5.
Supplementary European Search Report dated Apr. 23, 2008 From the European Patent Office Re.: Application No. 05750089.4.
Supplementary European Search Report dated Oct. 31, 2007 From the European Patent Office Re.: Application No. 04734072.4.

(56) References Cited

OTHER PUBLICATIONS

Supplementary Partial European Search Report dated Aug. 30, 2007 From the European Patent Office Re.: Application No. 04734072.4.
Translation of Decision of Rejection dated Dec. 9, 2011 From the State Intellectual Property Office of the People's Republic of China Re.: Application No. 200580027481.4.
Translation of Examination Report dated Sep. 6, 2010 From the Government of the People's Republic of Bangladesh, Department of Patents, Designs and Trademarks, Ministry of Industries Re. Application No. 275/2009.
Translation of Notice of Paying Restoration Fee for Unity of Invention dated Oct. 29, 2012 From the State Intellectual Property Office of the People's Republic of China Re. Application No. 200880127757.X.
Translation of Notice of Payment of the Restoration Fee for Unity of Invention dated Mar. 20, 2009 From the State Intellectual Property Office of the People's Republic of China Re.: Application No. 200580027481.4.
Translation of Notice to Amendment dated Aug. 31, 2012 From the Thai Patent Office, Department of Intellectual Property Office Re. Application No. 0901000235.
Translation of Notification of the Office Action dated Dec. 1, 2011 From the State Intellectual Property Office of the People's Republic of China Re. Application No. 200680047610.0.
Translation of Notification of the Office Action dated Jun. 30, 2011 From the State Intellectual Property Office of the People's Republic of China Re. Application No. 200680047610.0.
Translation of Office Action dated Jul. 1, 2011 From the State Intellectual Property Office of the People's Republic of China Re. Application No. 200880017707.6.
Translation of Office Action dated Jan. 4, 2012 From the State Intellectual Property Office of the People's Republic of China Re. Application No. 200880109464.9.
Translation of Office Action dated Apr. 9, 2012 From the State Intellectual Property Office of the People's Republic of China Re. Application No. 200880017707.6.
Translation of Office Action dated Sep. 13, 2012 From the State Intellectual Property Office of the People's Republic of China Re. Application No. 200910217137.1.
Translation of Office Action dated Jan. 17, 2012 From the State Intellectual Property Office of the People's Republic of China Re. Application No. 201110104274.1.
Translation of Office Action dated Jan. 17, 2013 From the State Intellectual Property Office of the People's Republic of China Re. Application No. 201110104274.1.
Translation of Office Action dated Oct. 19, 2010 From the State Intellectual Property Office of the People's Republic of China Re. Application No. 200680038391.X.
Translation of Office Action dated Jun. 22, 2011 From the State Intellectual Property Office of the People's Republic of China Re. Application No. 200880127685.9.
Translation of Office Action dated Mar. 22, 2013 From the State Intellectual Property Office of the People's Republic of China Re. Application No. 200880109464.9.
Translation of Office Action dated Feb. 25, 2013 From the State Intellectual Property Office of the People's Republic of China Re. Application No. 200910217137.1.
Translation of Office Action dated Aug. 28, 2013 From the State Intellectual Property Office of the People's Republic of China Re. Application No. 200880109464.9.
Translation of Office Action dated Dec. 31, 2011 From the State Intellectual Property Office of the People's Republic of China Re. Application No. 200910217137.1.
Translation of Search Report dated Jan. 17, 2013 From the State Intellectual Property Office of the People's Republic of China Re. Application No. 201110104274.1.
Translation of the Office Action dated Jan. 9, 2009 From the State Intellectual Property Office Re. Application No. 2004800200597.0.
Written Opinion dated Jul. 2, 2009 From the International Searching Authority Re.: Application No. PCT/IL07/01590.
Written Opinion dated Jan. 3, 2007 From the International Searching Authority Re.: Application No. PCT/IL2005/000627.
Written Opinion dated Mar. 4, 2009 From the International Searching Authority Re.: Application No. PCT/IL08/01024.
Written Opinion dated Nov. 4, 2005 From the International Searching Authority Re.: Application No. PCT/IL04/00431.
Written Opinion dated Aug. 27, 2008 From the International Searching Authority Re.: Application No. PCT/IL06/00947.
Adachi et al. "*Oryza sativa* Japonica Group cDNA Clone:J023021L06, Full Insert Sequence", Database EMBASE [Online], XP002665608, Retrieved From EBI, Database Accession No. AK099270, Jul. 19, 2003.
Aharon et al. "Overexpression of a Plasma Membrane Aquaporin in Transgenic Tobacco Improves Plant Vigor Under Favorable Growth Conditions But Not Under Drought or Salt Stress", The Plant Cell, 15: 439-447, Feb. 2003.
Alcala et al. "EST543159 Tomato *Callus solanum* Lycopersicum cDNA Clone cLEC80A19 5-end, mRNA Sequence", GenBank: BI923254.1, GenBank Accession No. BI923254, Oct. 17, 2001.
Alcala et al. "Generation of ESTs From Tomato Fruit Tissue", Database GenBank on STIC, National Center for Biotechnology Information, Accession No. AW932839, 2001.
Apse et al. "Engineering Salt Tolerance in Plants", Current Opinion in Biotechnology, XP003018468, 13(2): 146-150, Apr. 1, 2002.
*Arabidopsis* Genome Initiative "Analysis of the Genome Sequence of the Flowering Plant *Arabidopsis thaliana*" Nature, 408: 796-815, Dec. 14, 2000.
Backhaus et al. "Nucleotide Sequence of a cDNA for a P2 60S Acidic Ribosomal Protein From Parthenitun Argentatum", Plant Physiology, 106: 395, 1994.
Bautista et al. "*Arabidopsis thaliana* At5g06690 mRNA, Complete Cds", Unpublished, The Salk Institute for Biological Studies, La Jolla, CA, USA GenBank: BT029447, Nov. 15, 2006.
Benfey et al. "The CaMV 35S Enhancer Contains at Least Two Domains Which Can Confer Different Development and Tissue-Specific Expression Patterns", The EMBO Journal, 8(8): 2195-2202, 1989.
Benfey et al. "The Cauliflower Mosaic Virus 35S Promoter: Combinatorial Regulation of Transcription in Plants", Science, 250(4983): 959-966, Nov. 16, 1990.
Bennetzen et al. "Setaria Italica Strain Yugul SETITScaffold_2_Cont751, Whole Genome Shotgun Sequence", Database NCBI [Online], GenBank Accession No. AGNK01000751, May 11, 2012.
Bernhardt et al. "The bHLH Genes GLABRA3 (GL3) and Enhancer of GLABRA3 (EGL3) Specify Epidermal Cell Fate in the *Arabidopsis* Root", Development, 130(26): 6431-6439, 2003.
Blast "BLAST Results". 1 P.
Blewitt et al. "BNLGHi10083 Six-Day Cotton Fiber Gossypium Hirsutum cDNA 5' Similar to (AC004521) Unknown Protein [*Arabidopsis thaliana*], mRNA Sequence", XP002576188, Retrieved Fron EBI Accession No. EMBL:AI728187, Database Accession No. AI728187, Jun. 12, 1999. Sequence.
Blewitt et al. "BNLGHi8081 Six-Day Cotton Fiber Gossypium Hirsutum cDNA 5' Similar to (AC004521) Unknown Protein [*Arabidopsis thalian*], mRNA Sequence", XP002576189, Retrieved From EBI Acccsion No. EMBL:AI730835, Database Accession No. AI730835, Jun. 12, 1999. Sequence.
Blewitt et al. "BNLGHi8396 Six-Day Cotton Fiber Gossypium Hirsutum cDNA 5' Similar to (AC004521) Unknown Protein [*Arabidopsis thaliana*], mRNA Sequence", XP002576190, Retrieved From EBI Accession No. EMBL:AI27553, Database Accession No. AI27553, Jun. 12, 1999. Sequence.
Blewitt et al. "Gossypium Hirsutum Strain Acala Maxxa BURP Domain-Containing Protein (BNL1924) mRNA, Complete CDS", GenBank Nucleotide, GenBank Accession No. AY343972, Aug. 16, 2003.
Bowie et al. "Deciphering the Message in Protein Sequences: Tolerance to Amino Acid Substitutions", Science, 247(4948): 1306-1310, Mar. 16, 1990.
Brandle et al. "Perspectives on the Production of Recombinant Proteins in Plants", AgBiotechNet, 3(ABN 070): 1-4, 2001. Abstract.
Briggs et al. "Poly(ADP-Ribosyl)ation in Plants", Trends in Plant Science, 16(7): 372-380, Jul. 31, 2011. p. 378.

(56) References Cited

OTHER PUBLICATIONS

Castelli et al. "*Arabidopsis thaliana* Full-Length cDNA Complete Sequence From Clone GSLTFB52ZA10 of Flowers and Buds of Strain Col-0 of *Arabidopsis thaliana* (Thale Cress)", GeneBank Direct Submission BX829993, Accession No. BX829993, Feb. 6, 2004.
Cheuk et al. "*Arabidopsis thaliana* At2g40550 Gene, Complete CDS", Database EMBL [Online], XP002673499, Retrieved From EBI Accession No. EM_PL: BT022032.1, Database Accession No. BT022032, May 4, 2005.
Cheuk et al. "*Arabidopsis thaliana* At2g46960/F14M4.21 mRNA, Complete CDS", Database EMBL [Online], XP002593835, Retrieved From EBI Accession No. EMBL:AY091688, Database Accession No. AY091688, Apr. 14, 2002.
Ciddi et al. "Elicitation of *Taxus* sp. Cell Cultures for Production of Taxol", Biotechnology Letters, 17(12): 1343-1346, Dec. 1995.
Clontech "Genome Walker™ Universal Kit User Manual", Clontech Laboratories Inc., Cat. No. 638904, PT3042-1 (PR742239), p. 1-30, Apr. 25, 2007.
Daniell et al. "Solanum Bulbocastanum Chloroplast, Complete Genome", GenBank NCBI, Accession No. NC_007943, Mar. 26, 2010. p. 1, Source, p. 10-11, Nucleotides 46590-47195, Gene 'RPS4'.
Davletova et al. "The Zinc-Finger Protein Zat12 Plays a Central Role in Reactive Oxygen and Abiotic Stress Signaling in *Arabidopsis*", Plant Physiology, 139: 847-856, Oct. 2005.
Del Pozo et al. "F-Box Proteins and Protein Degradation: An Emerging Theme in Cellular Regulation", Plant Molecular Biology, 44(2): 123-128, Sep. 2000.
Desveaux et al. "Whirly Transcription Factors: Defense Gene Regulation and Beyond", Trends in Plant Science, TiPS, 10(2): 95-102, Feb. 2005.
Feng et al. "Probable Cinnamyl Alcohol Dehydrogenase 6", Darabase UniProt [Online], XP002665609, Retrieved From EBI, Database Accession No. Q7XWU3, Mar. 1, 2004.
Francois et al. "Overexpression of the VvLTP1 Gene Interferes With Somatic Embryo Development in Grapevine", Functional Plant Biology, 35(5): 394-402, 2008.
Fray et al. "Nucleotide Sequence and Expression of a Ripening and Water Stress-Related cDNA From Tomato With Homology to the MIP Class of Membrane Channel Proteins", Plant Molecular Biology, XP009117320, 24(3): 539-543, 1994. Figs. 1, 2. & Database UniProt, REcName: Full=Probable Aquaporin PIP-Type pTOM75; AltName: Full=Ripening-Associated Membrane Protein; Short= RAMP, Oct. 1, 1994.
Friedberg "Automated Protein Function Prediction—The Genomic Challenge", Briefings in Bioinformatics, 7(3): 225-242, 2006.
Gardiner et al. "*Zea mays* PCO131392 mRNA Sequence", Database EMBL/GenBank/DDBJ, EBI Database Accession No. AY107021, XP002542347, May 28, 2002. 96,5% Identity in 1118 nt Overlap of AY107021 (1118 nt) With SEQ ID No. 68 (1348 nt) of the Present Application, Abstract.
Gaxiola et al. "Drought- and Salt-Tolerant Plants Result From Overexpression of the AVP1 H→-Pump", Proc. Natl. Acad. Sci. USA, PNAS, 98(20): 11444-11449, Sep. 25, 2001.
Good et al. "Can Less Yield More? Is Reducing Nutrient Input Into the Environment Compatible With Maintaining Crop Production?", Trends in Plant Science, 9(12): 597-605, Dec. 2004.
Good et al. "Engineering Nitrogen Use Efficiency With Alanine Aminotransferase", Canadian Journal of Botany, 85: 252-262, 2007.
Gowik et al. "Cis-Regulatory Elements for Mesophyll-Specific Gene Expression in the C4 Plant *Flaveria trinervia*, the Promoter of the C4 Phosphoenolpyruvate Carboxylase Gene", The Plant Cell, 16: 1077-1090, 2004.
Grover et al. "Understanding Molecular Alphabets of the Plant Abiotic Stress Responses", Current Science, 80(2): 206-216, Jan. 25, 2001.
Guo et al. "Protein Tolerance to Random Amino Acid Change", Proc. Natl. Acad. Sci. USA, PNAS, 101(25): 9205-9210, 2004.

Hachez et al. "Modulating the Expression of Aquaporin Genes in Planta: A Key to Understand Their Physiological Functions?", Biochimica et Biophysica Acta, XP005655605, 1758(8): 1142-1156, Aug. 1, 2006. p. 1151, col. 1, § 2—p. 1153, col. 1, § 1, Table 1.
Harwood "Plant Fatty Acid Synthesis", The AOCS Lipid Library, 11 P., Apr. 12, 2010.
Hattori et al. "An Acetohydroxy Acid Synthase Mutant Reveals a Single Site Involved in Multiple Herbicide Resistance", Molecular and General Genetics, 246: 419-425, 1995. Abstract!
Hill et al. "Functional Analysis of Conserved Histidines in ADP-Glucose Pyrophosphorylase From *Escherichia coli*", Biochemical and Biophysical Research Communications, 244(2): 573-577, 1998.
Hirner et al. "*Arabidopsis* LHT1 Is a High-Affinity Transporter for Cellular Amino Acid Uptake in Both Root Epidermis and Leaf Mesophyll", The Plant Cell, 18: 1931-1946, Aug. 2006.
Holmstroem et al. "Drought Tolerance in Tobacco", Nature, 379: 683-684, 1996. Abstract.
In et al. "Panax Gingseng mRNA for Cytoplasmic Ribosomal Protein S13, Complete Cds", Database EMBL [Online], Retrieved From EBI Accession No. EMBL, Database Accession No. AB043974, 2000.
Invitrogen "SuperScript® Plasmid System With Gateway® Technology for cDNA Synthesis and Cloning", Invitrogen by Life Technologies, User Manual, Catalog No. 18248-013, Manual Part No. 11108, 44 P., Dec. 22, 2010.
Ishikawa et al. "JP 2005-185101: Full Length cDNA of Plant and the Use Thereof", Database EMBL [Online], XP002678022, Retrieved From EBI Accession No. EM_PAT:HV067703, Database Accession No. HV067703, Jul. 15, 2011. Sequence.
Ji et al. "Gossypium Hirsutum Expansin mRNA, Complete CDs", Database EMBL [Online], XP002474936, Retrieved From EBI Accession No. EMBL:AY189969, Database Accession No. AY189969, May 20, 2003.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.
Johansson et al. "The Role of Aquaporins in Cellular and Whole Plant Water Balance," Biochimica et Biophysica Acta 1465: 324-342, 2000.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. p. 35887, col. 1, Para 2.
Kano-Murakami et al. "A Rice Homeotic Gene, OSH1, Causes Unusual Phenotypes in Transgenic Tobacco", FEBS Letters, 334(3): 365-368, Nov. 1993.
Katavic et al. "Utility of the *Arabidopsis* FAE1 and Yeast SLC1-1 Genes for Improvements in Erucic Acid and Oil Content in Rapeseed", Biochemical Society Transactions, 28: 935-7, 2000. Abstract!
Keskin et al. "A New, Structurally Nonredundant, Diverse Data Set of Protein-Protein Interfaces and Its Implications", Protein Science, 13: 1043-1055, 2004.
Kikuchi et al. "*Oryza sativa* Japonica Group cDNA Clone:J023131O04, Full Insert Sequence", GenBank Database Accession No. AK072531, Jul. 2, 2013.
Kikuchi et al. "Rice cDNA-Encoded Protein SEQ ID No. 31047", Database Geneseq [Online], XP002678021, Retrieved From EBI Accession No. GSP:AQD37188, Database Accession No. AGD37188, Jun. 12, 2008. Shows 100% Identity to Present SEG ID No. 246 (Protein) and Corresponding Polynucleotide Shows 100 % Identity to SEQ ID No. 7 Over 458 Nucleotides. Abstract.
Kim et al. "*Arabidopsis thaliana* At2g46960/F14M4.21 mRNA, Complete CDS", Database EMBL [Online], XP002593834, Retrieved From EBI Accession No. EMBL:AF367329, Database Accession No. AF367329, Apr. 12, 2001.
Kim et al. "Molecular Cloning of Low-Temperature-Inducible Ribosomal Proteins From Soybean", Journal of Experimental Botany, 55(399): 1153-1155, 2004.

(56) References Cited

OTHER PUBLICATIONS

Kirkness et al. "Lycopersicon Esculentum Clone 133453R, mRNA Sequence", Database EMBL [Online], XP002529190, Retrieved From EBI Accession No. EMBL:BT014251, Database Accession No. BT014251, May 12, 2004.
Kirubakaran et al. "Characterization of a New Antifungal Lipid Transfer Protein From Wheat", Plant Physiology and Biochemistry, 46: 918-927, 2008.
La Rosa et al. "*Oryza sativa* Amino Acid Sequence SEQ ID No. 133688", Database Geneseq [Online], XP002678023, Retrieved From EBI Accession No. GSP:ANM19687, Database Accession No. ANM19687, Dec. 28, 2007. 100% Identity to Present SEQ IFD No. 246, Corresponding Polynucleotide Has 99,6% Identity to Present SEQ ID No. 7 Over 488 Nucleotides. Abstract, Sequence.
La Rosa et al. "*Oryza sativa* Nucleotide Sequence SEQ ID No. 31205", Database Geneseq [Online], XO002678024, Retrieved From EBI Accession No. GSN:ANL17203, Database Accession No. ANL17203, Dec. 28, 2007. Sequence.
Li et al. "Gossypium Hirsutum Dehydration-Induced Protein RD22-Like Protein (RDL) mRNA, Complete CDS", EBI Accession No. EMBL:AY072821, XP002639385, Database Accession No. AY072821, Dec. 4, 2002. Compound.
Li et al. "Isolation of Genes Preferntially Expressed in Cotton Fibers by cDNA Filter Arrays and RT-PCR", Plant Science, XP002639386, 163(6): 1113-1120, 2002.
Lin et al. "*Arabidopsis thaliana* Chromosome III BAC F7O18 Genomic Sequence, Complete Sequence", GenBank Accession No. AC011437, Oct. 30, 2002.
Liu et al. "Plant Full Length Insert Polypeptide Seqid 64542", Database Geneseq [Online], XP002713973, Retrieved From EBI Accession No. GSP:ADY08727, Database Accession No. ADY08727, Apr. 21, 2005. Polypeptide Has 96.4% Identity to SEQ ID No. 653 and Is Used for the Same Purpose, Abstract, Sequence.
Liu et al. "Root-Specific Expression of a Western White Pine PR10 Gene Is Mediated by Different Promoter Regions in Transgenic Tobacco", Plant Molecular Biology, 52: 103-120, 2003.
Lurin et al. "Genome-Wide Analysis of *Arabidopsis* Pentatricopeptide Repeat Proteins Reveals Their Essential Role in Organelle Biogenesis", The plant Cell, 16: 2089-2103, Aug. 2004.
Matsumoto et al. "*Hordeum vulgare* Subsp. *Vulgare*, Full-Length cDNA", UniProtKB/TrEMBL, ID: F2DLE8-HORVD, UniProt Accession No. F2DLE8, May 31, 2011.
Matsumoto et al. "Os11g0162200 [*Oryza sativa* Japonica Group]", Direct GenBank Sequence Submission, GenBank: BAF27672.1, GenBank Accession No. BAF27672, Aug. 11, 2012.
Matz et al. "Gossypium Hirsutum GHDEL65 (ghdel65) mRNA, Complete CDS", GenBank Nucleotide, GenBank Accession No. AF336280, Mar. 15, 2001.
Maurel "Plant Aquaporins: Novel Functions and Regulation Properties", FEBS Letters, XP022078418, 581(12): 2227-2236, May 25, 2007. p. 2230, col. 2, Last §—p. 2231, col. 1, § 2, Fig.1.
McConnell et al. "Role of PHABULOSA and PHAVOLUTA in Determining Radial Patterning in Shoots", Nature, 411(6338): 709-713, Jun. 7, 2001.
Merriam-Webster "Exogenous Definition", Merrian-Webster On-Line Dictionary, 2010.
NCBI "PREDICTED: Nudix Hydrolase 16, Mitochondrial-Like [Setaria Italica]", Database NCBI [Online], NCBI Reference Sequence: XP_004955808, Jun. 26, 2013.
NCBI "Protein Sequence (588 Letters)", NCBI BLAST Basic Local Alignment Search Tool, 3 P., Retrieved From the Internet on Nov. 24, 2009.
Ngo et al. "Computational Complexity, Protein Structure Prediction, and the Levinthal Paradox", The Protein Folding Problem and Tertiary Structure Prediction, p. 433, 492-495, 1994.
Nuccio et al. "Metabolic Engineering of Plants for Osmotic Stress Resistance", Current Opinion in Plant Biology, XP002216348, 2(2): 128-134, Apr. 1, 1999.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig. 1.
Orzaez et al. "Agroinjection of Tomato Fruits. A Tool for Rapid Functional Analysis of Transgenes Directly in Fruit", Plant Physiology, 140: 3-11, 2006.
Park et al. "Glycine Max Ribosomal Protein S13 (RPS13) mRNA, Complete Cds", Database EMBL [Online], Retreieved From EBI Accession No. EMBL, Database Accession No. AY453393, 2004.
Paterson et al. "Sorghum Bicolor Chromosome 2, Whole Genome Shotgun Sequence", NCBI Database [Online], Retrieved From EBI Accession No. EMBL:CM000761, Database Accession No. CM000761, Jun. 24, 2009. Sequence.
Paterson et al. "SubName: Full=Putative Uncharacterized Protein Sb02g004350", Database UniProt [Online], XP002713972, Retrieved From EBI Accession No. UNIPROT:C5XB01, Database Accession No. C5XB01, Sep. 1, 2009. Polynucleotide and Polypeptide Molecules Fully Comprising the Present Molecules According to SEQ ID No. 166, 653, Abstract, Sequence.
Payne et al. "GL3 Encodes a bHLH Protein That Regulates Trichome Development in *Arabidopsis* Through Interaction With GL1 and TTG1", Genetics, 156: 1349-1362, Nov. 2000.
Payne et al. "Heterologous MYB Genes Distinct From GL1 Enhance Trichome Production When Overexpressed in Nicotiana Tabacum", Development, 126: 671-682, 1999.
Pilon-Smits et al. "Improved Performance of Transgenic Fructan-Accumulating Tobacco under Drought Stress", Plant Physiology, 107: 125-130, 1995.
Plant Energy Biology "Protein_Coding: Cationic Amino Acid Transporter 2 (TAIR10)", Plant Energy Biology: SUBA3 Flatfile for AT1G58030.1, Database, 1 P., 2007.
Purnelle et al. "*Arabidopsis thaliana* DNA Chromosome 3, BAC Clone F3C22", Database EMBL [Online], XP002640829, Retrieved From EBI Accession No. EMBL:AL353912, Database Accession No. AL 353912, Apr. 27, 2000. Compound.
Quesada et al. "Genetic Architecture of NaCl Tolerance in *Arabidopsis*", Plant Physiology, 130: 951-963, 2002. Abstract!
Rolletschek et al. "Ectopic Expression of an Amino Acid Transporter (VfAAP1) in Seeds of Vica Narbonensis and Pea Increases Storage Proteins", Plant Physiology, 137: 1236-1249, Apr. 2005.
Rounsley et al. "*Arabidopsis thaliana* Chromosome 2 Clone T2P4 Map CIC10A06, Complete Sequence", Database EMBL [Online], XP002673500, Retrieved From EBI Accession No. EMBL:AC002336, Database Accession No. AC002336, Jul. 18, 1997. Sequence.
Saez-Vasquez et al. "Accumulation and Nuclear Targeting of BnC24, A *Brassica napus* Ribosomal Protein Corresponding to a mRNA Accumulating in Response to Cold Treatment", Plant Science, 156(1): 35-46, 2000.
Saijo et al. "Over-Expression of a Single Ca 2+-Dependent Protein Kinase Confers Both Cold and Salt/Drought Tolerance on Rice Plants", The Plant Journal 23(3): 319-327, 2000.
Seki et al. "Monitoring the Expression Profiles of 7000 *Arabidopsis* Genes Under Drought, Cold and High-Salinity Stresses Using a Full-Length cDNA Microarray", The Plant Journal, 31(3): 279-292, 2002.
Skriver et al. "Cis-Acting DNA Elements Responsive to Gibberellin and Its Antagonist Abscisic Acid", Proceedings of the National Academy of Sciences USA 88: 7266-7270, 1991.
Smart et al. "MIP Genes Are Down-Regulated Under Drought Stress in Nicotiana Glauca", Plant and Cell Physiology, XP002455682, 42(7): 686-693, 2001. p. 686, Reference to Database Entry AF290618, p. 692, 1-h col., § 2.
Smart et al. "Nicotiana Glauca Putative Delta TIP (MIP2) mRNA, Complete Cds", Database EMBL [Online], Retrieved From EBI Accession No. EMBL: AF290618, XP002455682, Database Accession No. AF290618, Jan. 2, 2001.
Soderlund et al. "Sequencing, Mapping, and Analysis of 27,455 Maize Full-Length cDNAs", PLoS Genetics, 5(11): e1000740-1-e1000740-13, Nov. 2009.
Su et al. "Molecular and Functional Characterization of a Family of Amino Acid Transporter From *Arabidopsis*", Plant Physiology, 136: 3104-3113, Oct. 2004.

(56) References Cited

OTHER PUBLICATIONS

Sunkar et al. "Small RNAs as Big Players in Plant Abiotic Stress Responses and Nutrient Deprivation", Trends in Plant Science, XP022148764, 12(7): 301-309, Jul. 1, 2007.
TAIR "Encodes a Member of the Cationic Amino Acid Transporter (CAT) Subfamily of Amino Acid Polyamine Choline Transporters. Localized to the Tonoplast", TAIR, Locus: AT1G58030, TAIR Accession No. Locus:2196245, 4 P., 2013.
TAIR "Protein Kinase Superfamily Protein. Functions in: Protein Serine/Threonine Kinase Activity, Protein Kinase activity, Kinase Activity, ATP Binding ff.", TAIR, Locus: AT5G15080, TAIR Accession No. Locus:2147805, 4 P., 2013.
Takahashi et al. "The DNA Replication Checkpoint Aids Survival of Plants Deficient in the Novel Replisome Factor ETG1", The EMBO Journal, XP002537888, 27(13): 1840-1851, Jul. 9, 2008 & Supplementary Materials and Methods. Suppl. Fig.S6, p. 1844-1845.
Taliercio et al. "GG TMIRS 129 G10 F Cooton Normalized Library dT Primed Gossypium Hirsutum cDNA, mRNA Sequence", EMBL-Bank, XP002659970, Retrieved From EBI Accession No. EM EST:DW508992, Database Accession No. DW508992, Jul. 1, 2006.
Tamura et al. "Osmotic Stress Tolerance of Transgenic Tobacco Expressing a Gene Encoding a Membrane-Located Receptor-Like Protein From Tobacco Plants", Plant Physiology, 131(2): 454-462, 2003.
Tanaka et al. "Enhanced Tolerance Against Salt-Stress and Freezing-Stress of *Escherichia coli* Cells Expressing Algal BBC1 Gene", Current Microbiology, 42(3): 173-177, 2001.
Tarczynski et al. "Stress Protection of Transgenic Tobacco by Production of the Osmolyte Mannitol", Science, 259: 508-510, 1993. Abstract!
Terminology "Frequently Asked Questions", Bioinformatics Website, Frequently Asked Questions, 2001.
Theologis et al. "Sequence and Analysis off Chromosome 1 of the Plant *Arabidopsis thaliana*", Nature, 408: 816-820, Dec. 14, 2000.
Thornton et al. "From Structure to Function: Approaches and Limitations", Nature Structural Biology. Structural Genomic Supplement, Nov. 2000, p. 991-994.
Tobias et al. "Structure of the Cinnamyl-Alcohol Dehydrogenase Gene Family in Rice and Promoter Activity of a Member Associated With Lignification", Planta, 220: 678-688, 2005.
Udall et al. "A Global Assembly of Cotton ESTs", Genome Research, 16(3): 441-450, 2006.
Van der Hoeven et al. "EST301294 Tomato Root During/After Fruit Set, Cornell University Lycopersicon Esculentum cDNA Clone cLEX1K11 Similar to Vernicia Fordii Aquaporin, mRNA Sequence", Database EMBL [Online], Retrieved From EBI Accession No. EMBL: AW218814, XP002455680, Database Accession No. AW218814, Dec. 14, 1999. Abstract.
Van der Hoeven et al. "EST301295 Tomato Root During/After Fruit Set, Cornell University Lycopersicon Esculentum cDNA Clone cLEX1K11 Similar to Vernicia Fordii Aquaporin, mRNA Sequence", Database EMBL. [Online], Retrieved From EBI Accession No. EMBL: AW218815, XP002455681, Database Accession No. AW218815, Dec. 14, 1999. Abstract.
Van der Hoeven et al. "EST312975 Tomato Root During/After Fruit Set, Cornell University Lycopersicum Solanum cDNA Clone cLEX14O20 5-, mRNA Sequence", GenBank, GenBank Accession No. AW622177.1.
Van der Hoeven et al. "EST428934 Tomato Nutrient Deficient Roots Lycopersicon Esculentum cDNA Clone cLEW26B2 5' Sequence, mRNA Sequence", Database EMBL, Retrieved From EBI Accession No. EMBL, Database Accession No. BF098413, 2000.
Van Haaren et al. "A Functional Map of the Fruit-Specific Promoter of the Tomato 2A11 Gene", Plant Molecular Biology, 21: 625-640, 1993. Abstract!
Vigeolas et al. "Increasing Seed Oil Content in Oil-Seed Rape (*Brassica napus* L.) by Over-Expression of a Yeast Glycerol-3-Phosphate Dehydrogenase Under the Control of a Seed-Specific Promoter", Plant Biotechnology Journal, 5 Issue: 431-441, 2007. Abstract!

Wallace et al. "Oligonucleotide Probes for the Screening of Recombinant DNA Libraries", Methods in Enzymology, XP002957829, 152: 432-442, Jan. 1, 1987.
Wang et al. "Control of Plant Trichome Development by a Cotton Fiber MYB Gene", The Plant Cell, 16: 2323-2334, Sep. 2004. GenEmbl Database, Accession No. AY641990.
Wang et al. "The Soybean Dof-Type Transcription Factor Genes, GmDof4 and GmDof11, Enhance Lipid Content in the Seeds of Transgenic *Arabidopsis* Plants", The Plant Journal, 52: 716-729, 2007. Abstract!
Wells "Additivity of Mutational Effects in Proteins", Biochemistry, 29 (37): 8509-8517, 1990.
Whisstock et al. "Prediction of Protein Function from Protein Sequence and Structure," Quarterly Reviews of Biophysics 36 (3): 307-340, Aug. 2003.
Wing et al. "An Integrated Analysis of the Genetics, Devlopment, and Evolution of Cotton Fiber", NBCI GenBank Accession No. BE052336, 2000.
Wing et al. "GA_Eb0023F09f Gossypium Arboreum 7-10 Dpa Fiber Library Gossypium Arboreum cDNA Clone GA_Eb0023F09f, mRNA Sequence", XP002576191, Retrieved From EBI Accession No. EMBL:BF275177, Database Accession No. BF275177, Nov. 20, 2000. Sequence.
Wing et al. "GA Eb0026P18f Gossypium Arboreum 7-10 Dpa Fiber Library Gossypium Arboreum cDNA Clone GA_Eb0026P18f, mRNA Sequence", Database EMBL [Online], XP002640830, Retrieved From EBI Accession No. EMBL:BF277249, Database Accession No. BF277249, Nov. 20, 2000.
Wu et al. "SubName: Full=Major Intrinsic Protein", Database UniProt [Online], XP002529191, Retrieved From EBI Accession No. UNIPROT:AOFI89, Database Accession No. AOFI89, Nov. 28, 2006.
Xu et al. "Expression of a Late Embryogenesis Abundant Protein Gene, UUVAl, From Barley Confers Tolerance to Water Deficit and Salt Stress in Transgenic Rice", Plant Physiology, 110: 249-257, 1996.
Yamada et al. "*Arabidopsis thaliana* Clone RAFL14-87-A16 (R20399) Unknown Protein (At1g60770) mRNA, Complete Cds", GenBank Accession No. BT002876, Retrieved From the Internet, Jan. 21, 2010.
Yamada et al. "*Arabidopsis thaliana* Unknown Proein (At3g51610) mRNA, Complete CDS", Database EMBL [Online], XP002640828, Retrieved Fom EBI Accession No. EMBL:AY034915, Database Accession No. AY034915, Jun. 13, 2001. Compound.
Yanagisawa et al. "Diversity and Similarity Among Recognition Sequences of Dof Transcription Factors", The Plant Journal, 17(2): 209-214, 1999.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Young et al. "Hypothetical Protein MTR_7g116270 [Medicago Truncatula]", Database NCBI [Online], GenBank: AES82688.1, Database Accession No. AES82688, Nov. 21, 2011.
Yu et al. "Cell Cycle Checkpoint Protein MAD2 Homolog [*Zea mays*]", Database NCBI [Online], GenBank: AAD30555.1, GenBank Accession No. AAD30555, May 17, 1999.
Zabrouskov et al. "Oxidative Metabolism and the Physiological Age of Seed Potatoes Are Affected by Increased Alpha-Linolenate Content", Physiologia Plantarum, 116: 172-185, 2002.
Zhang et al. "Phosphatidic Acid Regulates Microtubule Organization by Interaction With MAP65-1 in Response to Salt Stress in *Arabidopsis*", The Plant Cell, 24: 4555-4576, Nov. 2012.
Zhou et al. "Global Genome Expression Analysis of Rice in Response to Drought and High-Salinity Stresses in Shoot, Flag Leaf, and Panicle", Plant Molecular Biology, 63(5): 591-608, Mar. 2007.
Applicant-Initiated Interview Summary dated Nov. 20, 2013 From the US Patent and Trademark Office Re. U.S. Appl. No. 13/125,047.
Requisition by the Examiner dated Oct. 28, 2013 From the Canadian Intellectual Property Office Re. Application No. 2,570,195.

(56) References Cited

OTHER PUBLICATIONS

Lazar et al. "Transforming Growth Factor Alpha: Mutation of Aspartic Acid 47 and Leucine 48 Results in Different Biological Activities", Molecular and Cell Biology, 8(3): 1247-1252, Mar. 1988.

Examination Report dated Dec. 16, 2013 From the Government of India, Patent Office, Intellectual Property Building Re. Application No. 2570/CHENP/2008.

Li et al. "Dehydration-Induced Protein RD22-Like Protein [Gossypium Hirsutum]", NCBI Database [Online], GenBank: AAL67991.1, GenBank Accession No. AAL67991, Dec. 4, 2002.

Advisory Action Before the Filing of an Appeal Brief dated Dec. 20, 2013 From the US Patent and Trademark Office Re. U.S. Appl. No. 12/834,106.

Applicant-Initiated Interview Summary dated Dec. 18, 2013 From the US Patent and Trademark Office Re. U.S. Appl. No. 12/834,106.

* cited by examiner pQFN, pQFNc

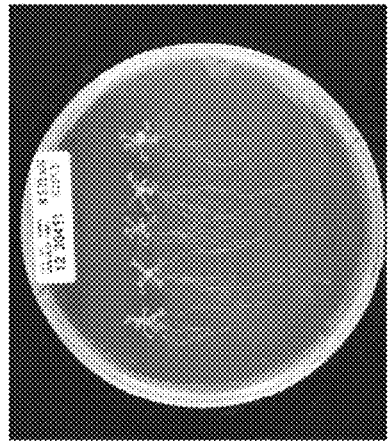
FIG. 3A
Normal conditions
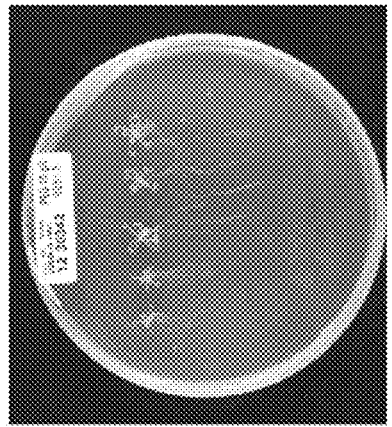
FIG. 3C
Osmotic stress (15 % PEG)
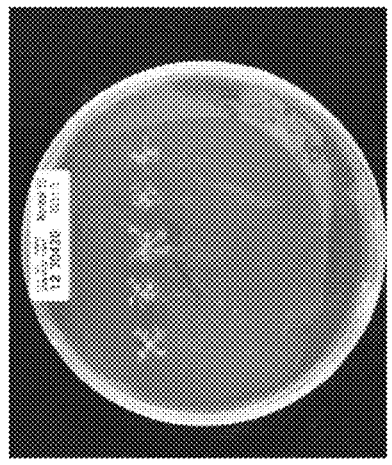
FIG. 3E
Nitrogen limiting conditions
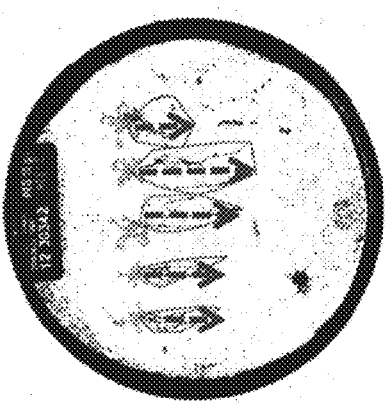
FIG. 3B
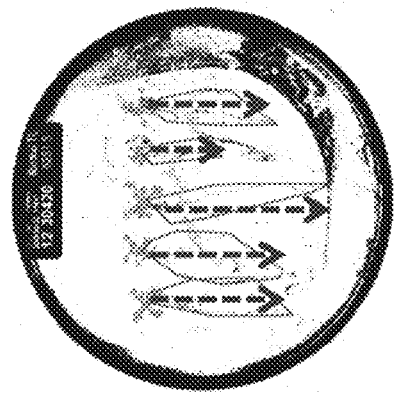
FIG. 3D
FIG. 3F pQNa_RP pQXNc

ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY

RELATED APPLICATIONS

This application is a National Phase of PCT Patent Application No. PCT/IL2012/050154 having International filing date of May 2, 2012, which claims the benefit of priority under 35 USC § 119(e) of U.S. Provisional Patent Application No. 61/481,752 filed on May 3, 2011 and 61/537,621 filed on Sep. 22, 2011. The contents of the above applications are all incorporated by reference as if fully set forth herein in their entirety.

SEQUENCE LISTING STATEMENT

The ASCII file, entitled 57662SequenceListing.txt, created on Nov. 4, 2013, comprising 33,138,135 bytes, submitted concurrently with the filing of this application is incorporated herein by reference.

FIELD AND BACKGROUND OF THE INVENTION

The present invention, in some embodiments thereof, relates to isolated polypeptides and polynucleotides, nucleic acid constructs comprising same, transgenic cells comprising same, transgenic plants exogenously expressing same and more particularly, but not exclusively, to methods of using same for increasing yield (e.g., seed yield, oil yield), biomass, growth rate, vigor, oil content, fiber yield, fiber quality abiotic stress tolerance, and/or fertilizer use efficiency (e.g., nitrogen use efficiency) of a plant.

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen usually needs to be replenished every year, particularly for cereals, which comprise more than half of the cultivated areas worldwide. For example, inorganic nitrogenous fertilizers such as ammonium nitrate, potassium nitrate, or urea, typically accounts for 40% of the costs associated with crops such as corn and wheat.

Nitrogen is an essential macronutrient for the plant, responsible for biosynthesis of amino and nucleic acids, prosthetic groups, plant hormones, plant chemical defenses, etc. In addition, nitrogen is often the rate-limiting element in plant growth and all field crops have a fundamental dependence on inorganic nitrogen. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources.

For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. No. 20020046419 to Choo, et al.; U.S. Pat. Appl. No. 20050108791 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

The ever-increasing world population and the decreasing availability in arable land for agriculture affect the yield of plants and plant-related products. The global shortage of water supply, desertification, abiotic stress (ABS) conditions (e.g., salinity, drought, flood, suboptimal temperature and toxic chemical pollution), and/or limited nitrogen and fertilizer sources cause substantial damage to agricultural plants such as major alterations in the plant metabolism, cell death, and decreases in plant growth and crop productivity.

Drought is a gradual phenomenon, which involves periods of abnormally dry weather that persists long enough to produce serious hydrologic imbalances such as crop damage, water supply shortage and increased susceptibility to various diseases.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Thus, salination of soils that are used for agricultural production is a significant and increasing problem in regions that rely heavily on agriculture, and is worsen by over-utilization, over-fertilization and water shortage, typically caused by climatic change and the demands of increasing population.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

WO publication No. 2009/013750 discloses genes, constructs and methods of increasing abiotic stress tolerance, biomass and/or yield in plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2004/104162 discloses methods of increasing abiotic stress tolerance and/or biomass in plants and plants generated thereby.

WO publication No. 2005/121364 discloses polynucleotides and polypeptides involved in plant fiber development and methods of using same for improving fiber quality, yield and/or biomass of a fiber producing plant.

WO publication No. 2007/020638 discloses methods of increasing abiotic stress tolerance and/or biomass in plants and plants generated thereby.

WO publication No. 2009/083958 discloses methods of increasing water use efficiency, fertilizer use efficiency, biotic/abiotic stress tolerance, yield and biomass in plant and plants generated thereby.

WO publication No. 2010/020941 discloses methods of increasing nitrogen use efficiency, abiotic stress tolerance, yield and biomass in plants and plants generated thereby.

WO publication No. 2009/141824 discloses isolated polynucleotides and methods using same for increasing plant utility.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO publication No. 2004/081173 discloses novel plant derived regulatory sequences and constructs and methods of using such sequences for directing expression of exogenous polynucleotide sequences in plants.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO publication No. 2004/111183 discloses nucleotide sequences for regulating gene expression in plant trichomes and constructs and methods utilizing same.

WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2010/100595 publication discloses isolated polynucleotides and polypeptides, and methods of using same for increasing plant yield and/or agricultural characteristics.

WO2011/015985 publication discloses polynucleotides and polypeptides for increasing desirable plant qualities.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency.

SUMMARY OF THE INVENTION

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide at least 80% identical to SEQ ID NO: 456-774, 8385-8643, 8645-10650, 10652-10836, 10838-12575, 12577, 12579-12583, 12585, 12586, 12590, 12591, 12593-12615, 12617-12624, 12628-12637, 12639-12659, 12662-12666, 12668-12677, 12679-12681, 12683-12695, 12697-12705, 12707-12709, 12711-12717, 12719-12727, 12729-12755, 12757-12811, 12813, 12815-12817, 12819-12825, 12827-12840, 12847-12848, 12850, 12853, 12855-12859, 12861-12884, 12886, 12887, 12893, 12895, 12896, 12898-12902, 12904-12912, 12916-12926, 12930-12937, 12940-12942, 12945-12954, 12956-12962, 12965-12967, 12969-12977, 12979-12984, 12986-12992, 12994, 12999-13001, 13003, 13006-13010, 13012-13016, 13018-13019, 13021-13029, 13031-13049, 13051-13054, 13056-13063, 13065-13066, 13068-13070, 13073-13076, 13079-13084, 13086-14461 or 14462, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs:456-774, 8385-10836, 10838-14461 and 14462, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence at least 80% identical to SEQ ID NO: 1-455, 775-6485, 6487-6657, 6660-6664, 6666-6701, 6703-6745, 6748-6818, 6820-6821, 6824-6827, 6829-6881, 6883, 6885-8383 or 8384, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising the nucleic acid sequence selected from the group consisting of SEQ ID NOs: 1-455, 775-8383 and 8384, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing nitrogen use efficiency and/or oil content of a plant, comprising expressing within the plant an exogenous polynucleotide comprising a nucleic acid sequence encoding a polypeptide at least 80% identical to SEQ ID NO: 10837, thereby increasing the nitrogen use efficiency and/or oil content of the plant.

According to an aspect of some embodiments of the present invention there is provided a method of increasing nitrogen use efficiency and/or oil content of a plant, comprising expressing within the plant an exogenous polynucleotide comprising a nucleic acid sequence encoding the polypeptide set forth in SEQ ID NO:10837, thereby increasing the nitrogen use efficiency and/or oil content of the plant.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO: 456-774, 8385-8643, 8645-10650, 10652-10836, 10838-12575, 12577, 12579-12583, 12585, 12586, 12590, 12591, 12593-12615, 12617-12624, 12628-12637, 12639-12659, 12662-12666, 12668-12677, 12679-12681, 12683-12695, 12697-12705, 12707-12709, 12711-12717, 12719-12727, 12729-12755, 12757-12811, 12813, 12815-12817, 12819-12825, 12827-12840, 12847-12848, 12850, 12853, 12855-12859, 12861-12884, 12886, 12887, 12893, 12895, 12896, 12898-12902, 12904-12912, 12916-12926, 12930-12937, 12940-12942, 12945-12954, 12956-12962, 12965-12967, 12969-12977, 12979-12984, 12986-12992, 12994, 12999-13001, 13003, 13006-13010, 13012-13016, 13018-13019, 13021-13029, 13031-13049, 13051-13054, 13056-13063, 13065-13066, 13068-13070, 13073-13076, 13079-13084, 13086-14461 or 14462, wherein the amino acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polynucleotide comprising a nucleic acid sequence encoding a polypeptide which comprises the amino acid sequence selected from the group consisting of SEQ ID NOs:456-774, 8385-10836, 10838-14461 and 14462.

According to an aspect of some embodiments of the present invention there is provided an isolated polynucleotide comprising a nucleic acid sequence at least 80% identical to SEQ ID NO:1-455, 775-6485, 6487-6657, 6660-6664, 6666-6701, 6703-6745, 6748-6818, 6820-6821, 6824-

6827, 6829-6881, 6883, 6885-8383, or 8384, wherein the nucleic acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polynucleotide comprising the nucleic acid sequence selected from the group consisting of SEQ ID NOs: 1-455, 775-8383 and 8384.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 456-774, 8385-8643, 8645-10650, 10652-10836, 10838-12575, 12577, 12579-12583, 12585, 12586, 12590, 12591, 12593-12615, 12617-12624, 12628-12637, 12639-12659, 12662-12666, 12668-12677, 12679-12681, 12683-12695, 12697-12705, 12707-12709, 12711-12717, 12719-12727, 12729-12755, 12757-12811, 12813, 12815-12817, 12819-12825, 12827-12840, 12847-12848, 12850, 12853, 12855-12859, 12861-12884, 12886, 12887, 12893, 12895, 12896, 12898-12902, 12904-12912, 12916-12926, 12930-12937, 12940-12942, 12945-12954, 12956-12962, 12965-12967, 12969-12977, 12979-12984, 12986-12992, 12994, 12999-13001, 13003, 13006-13010, 13012-13016, 13018-13019, 13021-13029, 13031-13049, 13051-13054, 13056-13063, 13065-13066, 13068-13070, 13073-13076, 13079-13084, 13086-14461 or 14462, wherein the amino acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polypeptide comprising the amino acid sequence selected from the group consisting of SEQ ID NOs: 456-774, 8385-10836, and 10838-14462.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to an aspect of some embodiments of the present invention there is provided a transgenic plant comprising the nucleic acid construct of some embodiments of the invention.

According to an aspect of some embodiments of the present invention there is provided a method of generating a transgenic plant, comprising expressing the nucleic acid construct of some embodiments of the invention within the plant, thereby generating the transgenic plant.

According to some embodiments of the invention, the nucleic acid sequence encodes an amino acid sequence selected from the group consisting of SEQ ID NOs: 456-774, 8385-10836, and 10838-14462.

According to some embodiments of the invention, the nucleic acid sequence is selected from the group consisting of SEQ ID NOs: 1-455, and 775-8384.

According to some embodiments of the invention, the polynucleotide consists of the nucleic acid sequence selected from the group consisting of SEQ ID NOs: 1-455, and 775-8384.

According to some embodiments of the invention, the nucleic acid sequence encodes the amino acid sequence selected from the group consisting of SEQ ID NOs:456-774, 8385-10836, and 10838-14462.

According to some embodiments of the invention, the plant cell forms part of a plant.

According to some embodiments of the invention, the method further comprising growing the plant expressing the exogenous polynucleotide under the abiotic stress condition(s).

According to some embodiments of the invention, the method further comprising growing the plant expressing the exogenous polynucleotide under the nitrogen-limiting condition(s).

According to some embodiments of the invention, the abiotic stress is selected from the group consisting of salinity, drought, water deprivation, flood, etiolation, low temperature, high temperature, heavy metal toxicity, anaerobiosis, nutrient deficiency, nutrient excess, atmospheric pollution and UV irradiation.

According to some embodiments of the invention, the yield comprises seed yield or oil yield.

According to some embodiments of the invention, the promoter is heterologous to the isolated polynucleotide and/or to the host cell.

According to some embodiments of the invention, the method further comprising growing the plant expressing the exogenous polynucleotide under nitrogen-limiting conditions.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG; FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
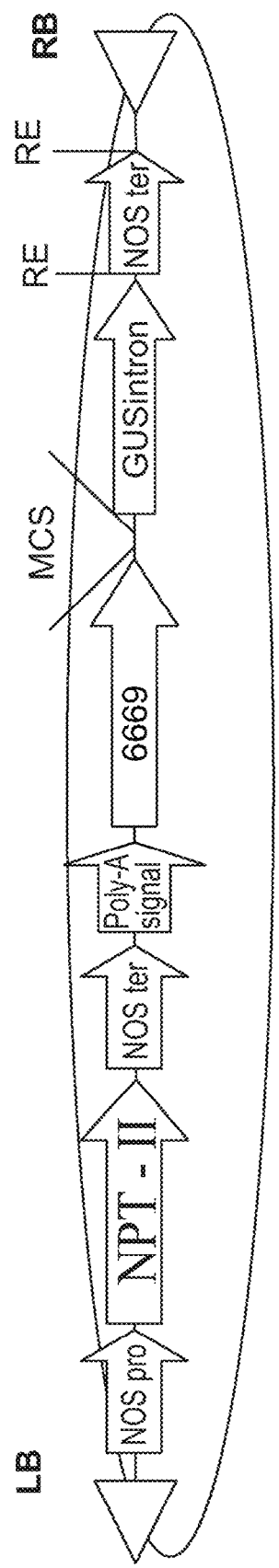
FIG. 1 is a schematic illustration of the modified pGI binary plasmid containing the new At6669 promoter (SEQ ID NO: 14467) and the GUSintron (pQYN 6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUS-intron reporter gene.

The present invention, in some embodiments thereof, relates to isolated polynucleotides and polypeptides, nucleic acid constructs encoding same, cells expressing same, transgenic plants expressing same and methods of using same for increasing yield, biomass, growth rate, vigor, oil content, fiber yield, fiber quality, abiotic stress tolerance, and/or nitrogen use efficiency of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to increase yield, biomass, growth rate, vigor, oil content, fiber yield, fiber quality abiotic stress tolerance, and/or fertilizer use efficiency (e.g., nitrogen use efficiency) of a plant.

Thus, as shown in the Examples section which follows, the present inventors have utilized bioinformatics tools to identify polynucleotides which enhance yield (e.g., seed yield, oil yield, oil content), growth rate, biomass, vigor, fiber yield, fiber quality, abiotic stress tolerance and/or nitrogen use efficiency) of a plant. Genes which affect the trait-of-interest were identified [Table 53, Example 12, SEQ ID NOs: 1-455 (polynucleotides) and SEQ ID NOs: 456-774 (polypeptides)] based on correlation analyses performed using *Arabidopsis* ecotypes (Examples 2 and 3), tomato varieties (Example 4), b. *Juncea* ecotypes (Examples 5 and 6), *Sorghum* varieties (Example 7), Maize hybrids (Example 8), Soybean varieties (Example 9), Barley accessions (Example 10) and Cotton species (Examples 11) and the expression profiles of the genes according to selected expression sets (e.g., tissues, developmental stages and stress conditions) (Tables 1-53, Examples 1-12). Homologous polypeptides and polynucleotides having the same function were also identified [Table 54, Example 13; SEQ ID NOs: 775-8384 (polynucleotides) and SEQ ID NOs: 8385-14462 (polypeptides)]. The identified polynucleotides were cloned into binary vectors (Example 14) and transgenic plants over-expressing the identified polynucleotides and polypeptides were generated (Example 15) and further evaluated for the effect of the exogenous gene on the trait of interest (e.g., increased fresh and dry weight, leaf area, root coverage and length, relative growth rate (RGR) of leaf area, RGR of root coverage, RGR of root length, seed yield, oil yield, dry matter, harvest index, growth rate, rosette area, rosette diameter, RGR leaf number, RGR plot coverage, RGR rosette diameter, leaf blade area, oil percentage in seed and weight of 1000 seeds, plot coverage, tolerance to abiotic stress conditions and to fertilizer limiting conditions; Examples 16-18). Altogether, these results suggest the use of the novel polynucleotides and polypeptides of the invention for increasing yield (including oil yield, seed yield and oil content), growth rate, biomass, vigor, fiber yield, fiber quality, abiotic stress tolerance and/or nitrogen use efficiency of a plant.

Thus, according to an aspect of some embodiments of the invention, there is provided method of increasing yield, growth rate, biomass, vigor, oil content, fiber yield, fiber quality, fertilizer use efficiency (e.g., nitrogen use efficiency) and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 456-774, 8385-8643, 8645-10650, 10652-10836, 10838-12575, 12577, 12579-12583, 12585, 12586, 12590, 12591, 12593-12615, 12617-12624, 12628-12637, 12639-12659, 12662-12666, 12668-12677, 12679-12681, 12683-12695, 12697-12705, 12707-12709, 12711-12717, 12719-12727, 12729-12755, 12757-12811, 12813, 12815-12817, 12819-12825, 12827-12840, 12847-12848, 12850, 12853, 12855-12859, 12861-12884, 12886, 12887, 12893, 12895, 12896, 12898-12902, 12904-12912, 12916-12926, 12930-12937, 12940-12942, 12945-12954, 12956-12962, 12965-12967, 12969-12977, 12979-12984, 12986-12992, 12994, 12999-13001, 13003, 13006-13010, 13012-13016, 13018-13019, 13021-13029, 13031-13049, 13051-13054, 13056-13063, 13065-13066, 13068-13070, 13073-13076, 13079-13084, 13086-14461 and 14462, thereby increasing the yield, growth rate, biomass, vigor, oil content, fiber yield, fiber quality, fertilizer use efficiency (e.g., nitrogen use efficiency) and/or abiotic stress tolerance of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigor. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (*Zea mays* L.) hybrids based on Corn Belt germplasm in the European Atlantic.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, Ceiba pentandra), desert willow, creosote bush, winterfat, balsa, kenaf, roselle, jute, sisal abaca, flax, corn, sugar cane, hemp, ramie, kapok, coir, bamboo, spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow.

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in yield, seed yield, biomass, growth rate, vigor, oil content, fiber yield, fiber quality, abiotic stress tolerance, and/or nitrogen use efficiency of a plant as compared to a native plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 456-774, 8385-8643, 8645-10650, 10652-10836, 10838-12575, 12577, 12579-12583, 12585, 12586, 12590, 12591, 12593-12615, 12617-12624, 12628-12637, 12639-12659, 12662-12666, 12668-12677, 12679-12681, 12683-12695, 12697-12705, 12707-12709, 12711-12717, 12719-12727, 12729-12755, 12757-12811, 12813, 12815-12817, 12819-12825, 12827-12840, 12847-12848, 12850, 12853, 12855-12859, 12861-12884, 12886, 12887, 12893, 12895, 12896, 12898-12902, 12904-12912, 12916-12926, 12930-12937, 12940-12942, 12945-12954, 12956-12962, 12965-12967, 12969-12977, 12979-12984, 12986-12992, 12994, 12999-13001, 13003, 13006-13010, 13012-13016, 13018-13019, 13021-13029, 13031-13049, 13051-13054, 13056-13063, 13065-13066, 13068-13070, 13073-13076, 13079-13084, 13086-14461 and 14462.

Homology (e.g., percent homology, identity+similarity) can be determined using any homology comparison software, including for example, the BlastP or TBLASTN software of the National Center of Biotechnology Information (NCBI) such as by using default parameters, when starting from a polypeptide sequence; or the tBLASTX algorithm (available via the NCBI) such as by using default parameters, which compares the six-frame conceptual translation products of a nucleotide query sequence (both strands) against a protein sequence database.

According to some embodiments of the invention, the term "homology" or "homologous" refers to identity of two or more nucleic acid sequences; or identity of two or more amino acid sequences.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal BLAST® search. This may be done by a first BLAST® involving BLASTing the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be BLASTed against, for example, the 28,469 full-length cDNA clones from *Oryza sativa* Nipponbare available at NCBI. The BLAST results may be filtered. The full-length sequences of either the filtered results or the non-filtered results are then BLASTed back (second BLAST®) against the sequences of the organism from which the sequence-of-interest is derived. The results of the first and second BLASTs are then compared. An orthologue is identified when the sequence resulting in the highest score (best hit) in the first BLAST® identifies in the second BLAST® the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web(dot)ebi(dot)ac(dot)uk/Tools/clustalw2/index(dot)html], followed by a neighbor-joining tree (Hypertext Transfer Protocol://en(dot)wikipedia(dot)org/wiki/Neighbor-joining) which helps visualizing the clustering.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:456-774, 8385-8643, 8645-10650, 10652-10836, 10838-12575, 12577, 12579-12583, 12585, 12586, 12590, 12591, 12593-12615, 12617-12624, 12628-12637, 12639-12659, 12662-12666, 12668-12677, 12679-12681, 12683-12695, 12697-12705, 12707-12709, 12711-12717, 12719-12727, 12729-12755, 12757-12811, 12813, 12815-12817, 12819-12825, 12827-12840, 12847-12848, 12850, 12853, 12855-12859, 12861-12884, 12886, 12887, 12893, 12895, 12896, 12898-12902, 12904-12912, 12916-12926, 12930-

12937, 12940-12942, 12945-12954, 12956-12962, 12965-12967, 12969-12977, 12979-12984, 12986-12992, 12994, 12999-13001, 13003, 13006-13010, 13012-13016, 13018-13019, 13021-13029, 13031-13049, 13051-13054, 13056-13063, 13065-13066, 13068-13070, 13073-13076, 13079-13084, 13086-14461 and 14462.

According to some embodiments of the invention, the method of increasing yield, biomass, growth rate, vigor, oil content, fiber yield, fiber quality, abiotic stress tolerance, and/or nitrogen use efficiency of a plant is effected by expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:456-774, 8385-8643, 8645-10650, 10652-10836, 10838-12575, 12577, 12579-12583, 12585, 12586, 12590, 12591, 12593-12615, 12617-12624, 12628-12637, 12639-12659, 12662-12666, 12668-12677, 12679-12681, 12683-12695, 12697-12705, 12707-12709, 12711-12717, 12719-12727, 12729-12755, 12757-12811, 12813, 12815-12817, 12819-12825, 12827-12840, 12847-12848, 12850, 12853, 12855-12859, 12861-12884, 12886, 12887, 12893, 12895, 12896, 12898-12902, 12904-12912, 12916-12926, 12930-12937, 12940-12942, 12945-12954, 12956-12962, 12965-12967, 12969-12977, 12979-12984, 12986-12992, 12994, 12999-13001, 13003, 13006-13010, 13012-13016, 13018-13019, 13021-13029, 13031-13049, 13051-13054, 13056-13063, 13065-13066, 13068-13070, 13073-13076, 13079-13084, 13086-14461 and 14462, thereby increasing the yield, biomass, growth rate, vigor, oil content, fiber yield, fiber quality, abiotic stress tolerance, and/or nitrogen use efficiency of the plant.

According to some embodiments of the invention, the exogenous polynucleotide encodes a polypeptide consisting of the amino acid sequence set forth by SEQ ID NO:456-774, 8385-10836, 10838-14461 or 14462.

According to an aspect of some embodiments of the invention, the method of increasing yield, biomass, growth rate, vigor, oil content, fiber yield, fiber quality, abiotic stress tolerance, and/or nitrogen use efficiency of a plant, is effected by expressing within the plant an exogenous polynucleotide comprising a nucleic acid sequence encoding a polypeptide comprising an amino acid sequence selected from the group consisting of SEQ ID NOs:456-774, 8385-10836, 10838-14461 and 14462, thereby increasing the yield, biomass, growth rate, vigor, oil content, fiber yield, fiber quality, abiotic stress tolerance, and/or nitrogen use efficiency of the plant.

According to an aspect of some embodiments of the invention, there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs: 456-774, 8385-10836, 10838-14461 and 14462, thereby increasing the yield, biomass, growth rate, vigor, oil content, fiber yield, fiber quality, abiotic stress tolerance, and/or nitrogen use efficiency of the plant.

According to some embodiments of the invention, the exogenous polynucleotide encodes a polypeptide consisting of the amino acid sequence set forth by SEQ ID NO: 456-774, 8385-10836, 10838-14461 or 14462.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-455, 775-6485, 6487-6657, 6660-6664, 6666-6701, 6703-6745, 6748-6818, 6820-6821, 6824-6827, 6829-6881, 6883, and 6885-8384.

According to an aspect of some embodiments of the invention, there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-455, 775-6485, 6487-6657, 6660-6664, 6666-6701, 6703-6745, 6748-6818, 6820-6821, 6824-6827, 6829-6881, 6883, and 6885-8384, thereby increasing the yield, biomass, growth rate, vigor, oil content, fiber yield, fiber quality, abiotic stress tolerance, and/or nitrogen use efficiency of the plant.

According to some embodiments of the invention, the homology is a global homology, i.e., an homology over the entire amino acid or nucleic acid sequences of the invention and not over portions thereof.

According to some embodiments of the invention, the identity is a global identity, i.e., an identity over the entire amino acid or nucleic acid sequences of the invention and not over portions thereof.

Identity (e.g., percent homology) can be determined using any homology comparison software, including for example, the BlastN software of the National Center of Biotechnology Information (NCBI) such as by using default parameters.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-455, 775-6485, 6487-6657, 6660-6664, 6666-6701, 6703-6745, 6748-6818, 6820-6821, 6824-6827, 6829-6881, 6883, and 6885-8384.

According to some embodiments of the invention the exogenous polynucleotide is set forth by SEQ ID NO:1-455, 775-8383 or 8384.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

According to an aspect of some embodiments of the invention, there is provided a method of increasing fertilizer use efficiency (e.g., nitrogen use efficiency) and/or oil content of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence set forth in SEQ ID NO: 10837, thereby increasing the fertilizer use efficiency (e.g., nitrogen use efficiency) and/or oil content of the plant.

According to an aspect of some embodiments of the invention, the method of increasing fertilizer use efficiency (e.g., nitrogen use efficiency) and/or oil content of a plant is effected by expressing within the plant an exogenous polynucleotide comprising a nucleic acid sequence encoding the polypeptide set forth in SEQ ID NO: 10837, thereby increasing the fertilizer use efficiency (e.g., nitrogen use efficiency) and/or oil content of a plant.

According to some embodiments of the invention, the exogenous polynucleotide encodes a polypeptide consisting of the amino acid sequence set forth by SEQ ID NO: 10837.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 201, 258, 455, 1269, 1312, 2017, 2174, 2278, 2289, 2564, 2565, 2641, 2642, 2643, 2799, 2827, 2828, 2829, 2830, 2835, 2836, 2837, 2852, 2853, 2873, 2877, 3026, 3181, 3250, 3311, 3466, 3480, 4017, 4243, 4339, 4346, 4347, 4508, 4509, 4540, 4541, 4546, 4547, 4548, 4563, 4564, 4565, 4569, 4570, 4581, 4906, 5530, 5955, 5979, 6033, and 6868.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-455, 775-6485, 6487-6657, 6660-6664, 6666-6701, 6703-6745, 6748-6818, 6820-6821, 6824-6827, 6829-6881, 6883, and 6885-8384.

According to some embodiments of the invention the nucleic acid sequence is capable of increasing yield, growth rate, vigor, biomass, oil content, fiber yield, fiber quality, nitrogen use efficiency, fertilizer use efficiency, abiotic stress tolerance and/or water use efficiency of a plant.

According to some embodiments of the invention the isolated polynucleotide comprising the nucleic acid sequence selected from the group consisting of SEQ ID NOs: 1-455, 775-8383 and 8384.

According to some embodiments of the invention the isolated polynucleotide is set forth by SEQ ID NO:1-455, 775-8383 or 8384.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 456-774, 8385-8643, 8645-10650, 10652-10836, 10838-12575, 12577, 12579-12583, 12585, 12586, 12590, 12591, 12593-12615, 12617-12624, 12628-12637, 12639-12659, 12662-12666, 12668-12677, 12679-12681, 12683-12695, 12697-12705, 12707-12709, 12711-12717, 12719-12727, 12729-12755, 12757-12811, 12813, 12815-12817, 12819-12825, 12827-12840, 12847-12848, 12850, 12853, 12855-12859, 12861-12884, 12886, 12887, 12893, 12895, 12896, 12898-12902, 12904-12912, 12916-12926, 12930-12937, 12940-12942, 12945-12954, 12956-12962, 12965-12967, 12969-12977, 12979-12984, 12986-12992, 12994, 12999-13001, 13003, 13006-13010, 13012-13016, 13018-13019, 13021-13029, 13031-13049, 13051-13054, 13056-13063, 13065-13066, 13068-13070, 13073-13076, 13079-13084, 13086-14461 and 14462.

According to some embodiments of the invention the amino acid sequence is capable of increasing yield, growth rate, vigor, biomass, oil content, fiber yield, fiber quality, nitrogen use efficiency, fertilizer use efficiency, abiotic stress tolerance and/or water use efficiency of a plant.

The invention provides an isolated polynucleotide comprising a nucleic acid sequence encoding a polypeptide which comprises the amino acid sequence selected from the group consisting of SEQ ID NOs: 456-774, 8385-10836, 10838-14461 and 14462.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 456-774, 8385-8643, 8645-10650, 10652-10836, 10838-12575, 12577, 12579-12583, 12585, 12586, 12590, 12591, 12593-12615, 12617-12624, 12628-12637, 12639-12659, 12662-12666, 12668-12677, 12679-12681, 12683-12695, 12697-12705, 12707-12709, 12711-12717, 12719-12727, 12729-12755, 12757-12811, 12813, 12815-12817, 12819-12825, 12827-12840, 12847-12848, 12850, 12853, 12855-12859, 12861-12884, 12886, 12887, 12893, 12895, 12896, 12898-12902, 12904-12912, 12916-12926, 12930-12937, 12940-12942, 12945-12954, 12956-12962, 12965-12967, 12969-12977, 12979-12984, 12986-12992, 12994, 12999-13001, 13003, 13006-13010, 13012-13016, 13018-13019, 13021-13029, 13031-13049, 13051-13054, 13056-13063, 13065-13066, 13068-13070, 13073-13076, 13079-13084, 13086-14461 and 14462.

According to some embodiments of the invention, the polypeptide comprising an amino acid sequence selected from the group consisting of SEQ ID NOs: 456-774, 8385-10836, 10838-14461 and 14462.

According to some embodiments of the invention, the polypeptide is set forth by SEQ ID NO: 456-774, 8385-10836, 10838-14461 or 14462.

The invention also encompasses fragments of the above described polypeptides and polypeptides having mutations, such as deletions, insertions or substitutions of one or more amino acids, either naturally occurring or man induced, either randomly or in a targeted fashion.

The term "'plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Dibeteropogon amplectens, Dioclea* spp, *Dolichos* spp., *Dorycnium rectum, Echinochloa pyramidalis, Ehraffia* spp., *Eleusine coracana, Eragrestis* spp., *Erythrina* spp., *Eucalypfus* spp., *Euclea schimperi, Eulalia vi/losa, Pagopyrum* spp., *Feijoa sellowlana, Fragaria* spp., *Flemingia* spp, *Freycinetia banksli, Geranium thunbergii, GinAgo biloba, Glycine javanica, Gliricidia* spp, *Gossypium hirsutum, Grevillea* spp., *Guibourtia coleosperma, Hedysarum* spp., *Hemaffhia altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria, Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys veffcillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays,* amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable constitutive promoters include, for example, CaMV 35S promoter [SEQ ID NO:14463 (pQFNC); SEQ ID NO:14464 (PJJ 35S from Brachypodium); SEQ ID NO:14465 (Odell et al., Nature 313:810-812, 1985)], *Arabidopsis* At6669 promoter (SEQ ID NO:14466; see PCT Publication No. WO04081173A2 or the new At6669 promoter (SEQ ID NO:14467); maize Ubi 1 (maize polyubiquitin-1, SEQ ID NO:14468; Christensen et al., Plant Sol. Biol. 18:675-689, 1992; Taylor et al., Plant Cell Rep 12:491-495, 1993); rice actin 1 (SEQ ID NO:14469, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (SEQ ID NO:14470, de Pater et al, Plant J November; 2(6):837-44, 1992); Ubi 1 promoter (SEQ ID NO:14471); RBCS promoter (SEQ ID NO:14472); Rice cyclophilin (Bucholz et al, Plant Mol. Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604,121; 5,569,597: 5,466,785; 5,399,680; 5,268,463; and 5,608,142.

Suitable tissue-specific promoters include, but not limited to, leaf-specific promoters [e.g., AT5G06690 (Thioredoxin) (high expression, SEQ ID NO:14473), AT5G61520 (At-STP3) (low expression, SEQ ID NO:14474) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO:14475 from seed specific genes (Simon, et al., Plant Mol. Biol. 5. 191, 1985; Scofield, et al., J. Biol. Chem. 262:12202, 1987; Baszczynski, et al., Plant Mol. Biol. 14:633, 1990), rice PG5a (U.S. Pat. No. 7,700, 835), early seed development *Arabidopsis* BAN (SEQ ID NO:14476, US 2009/0031450 A1), late seed development *Arabidopsis* ABI3 (SEQ ID NO:14477) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143).323-32 1990), napA (Stalberg, et al, Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Thomas and Flavell, The Plant Cell 2:1171-1180, 1990; Mol Gen Genet. 216:81-90, 1989; NAR 17:461-2), wheat a, b and g gliadins (EMBO3:1409-15, 1984), Barley ltr1 promoter, barley B1, C, D hordein (Theor Appl Gen 98:1253-62, 1999; Plant J 4:343-55, 1993; Mol Gen Genet. 250:750-60, 1996), Barley DOF (Mena et al, The Plant Journal, 116(1): 53-62, 1998), Biz2 (EP99106056.7), Barley SS2 (Guerin and Carbonero Plant Physiology 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma of al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990], LAT52 (Twell et al Mol. Gen. Genet. 217:240-245; 1989), *Arabidopsis* apetala-3 (Tilly et al., Development. 125:1647-57, 1998), *Arabidopsis* APETALA 1 (AT1G69120, AP1) (SEQ ID NO:14478) (Hempel et al., Development 124:3845-3853, 1997)], and root promoters [e.g., the ROOTP promoter [SEQ ID NO: 14479]; rice ExpB5 and barley ExpB1 promoters (Won et al. Mol. Cells. 30: 369-376, 2010); *arabidopsis* monoterpene synthase (AT3G25820) promoter (Chen et al., Plant Phys 135:1956-66, 2004); *arabidopsis* Pho1 promoter (SEQ ID NO:14480, Hamburger et al., Plant Cell. 14: 889-902, 2002), which is also slightly induced Pi stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase yield, seed yield, fiber yield, fiber quality, fiber length, growth rate, biomass, vigor, oil content, fertilizer use efficiency, nitrogen use efficiency and/or abiotic stress tolerance of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on yield, seed yield, fiber yield, fiber quality, fiber length, growth rate, biomass, vigor, oil content, fertilizer use efficiency, nitrogen use efficiency and/or abiotic stress tolerance of a plant.

Expressing a plurality of exogenous polynucleotides in a single host plant can be effected by co-introducing multiple nucleic acid constructs, each including a different exogenous polynucleotide, into a single plant cell. The transformed cell can than be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, drought, water deprivation, excess of water (e.g., flood, waterlogging), etiolation, low temperature, high temperature, heavy metal toxicity, anaerobiosis, nutrient deficiency, nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water use efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \quad \text{Formula I}$$

Fertilizer use efficiency—To analyze whether the transgenic plants are more responsive to fertilizers, plants are grown in agar plates or pots with a limited amount of fertilizer, as described, for example, Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" Proc. Natl. Acad. Sci. USA 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative growth area can be calculated using Formula II.

Relative growth rate area=Regression coefficient of area along time course    Formula II:

Thus, the relative growth area rate is in units of 1/day and length growth rate is in units of 1/day.

Seed yield—Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula III:

1000 Seed Weight=number of seed in sample/sample weight×1000    Formula III:

The Harvest Index can be calculated using Formula IV

Harvest Index=Average seed yield per plant/Average dry weight    Formula IV:

Grain protein concentration—Grain protein content (g grain protein $m^{-2}$) is estimated as the product of the mass of grain N (g grain N $m^2$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol:// World Wide Web (dot) cottoninc (dot) com/Classification-ofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor.

Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil (oil of the vegetative portion of the plant).

According to some embodiments of the invention, the plant cell forms a part of a plant.

As used herein the term "about" refers to ±10%.

The terms "comprises", "comprising", "includes", "including", "having" and their conjugates mean "including but not limited to".

The term "consisting of means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [Hypertext Transfer Protocol://World Wide Web (dot) invitrogen (dot) com/content (dot)cfm?pageid=469]. Approximately 30-50 mg of tissue was taken from samples. The weighed tissues were ground using pestle and mortar in liquid nitrogen and resuspended in 500 µl of TRIzol Reagent. To the homogenized lysate, 100 µl of chloroform was added followed by precipitation using isopropanol and two washes with 75% ethanol. The RNA was eluted in 30 µl of RNase-free water. RNA samples were cleaned up using Qiagen's RNeasy minikit clean-up protocol as per the manufacturer's protocol (QIAGEN Inc, CA USA). For convenience, each microarray expression information tissue type has received an expression Set ID.

Correlation analysis—was performed for selected genes according to some embodiments of the invention, in which the characterized parameters (measured parameters according to the correlation IDs) were used as "x axis" for correlation with the tissue transcriptom which was used as the "Y axis". For each gene and measured parameter a correlation coefficient "R" was calculated [using Pearson correlation test Hypertext Transfer Protocol://World Wide Web (dot) davidmlane (dot) com/hyperstat/A34739 (dot) html] along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved nitrogen use efficiency, abiotic stress tolerance, yield, growth rate and the like). A positive correlation indicates that the expression of the gene in a certain tissue or developmental stage and the correlation vector (phenotype performance) are positively associated (both, expression and phenotypic performance increase or decrease simultaneously) while a negative correlation indicates a negative association (while the one is increasing the other is decreasing and vice versa).

Example 1

Identification of Genes and Predicted Role Using Bioinformatics Tools

The present inventors have identified polynucleotides which can increase plant yield, seed yield, oil yield, oil content, biomass, growth rate, fiber yield and/or quality, abiotic stress tolerance, nitrogen use efficiency and/or vigor of a plant, as follows.

The nucleotide sequence datasets used here were from publicly available databases or from sequences obtained using the Solexa technology (e.g. Barley and *Sorghum*). Sequence data from 100 different plant species was introduced into a single, comprehensive database. Other information on gene expression, protein annotation, enzymes and pathways were also incorporated. Major databases used include:

Genomes

*Arabidopsis* genome [TAIR genome version 8 (Hypertext Transfer Protocol://World Wide Web (dot) *arabidopsis* (dot) org/)];

Rice genome [build 6.0 (Hypertext Transfer Protocol:// rice (dot) plantbiology(dot)msu(dot)edu/index shtml];

Poplar [*Populus* trichocarpa release 1.1 from JGI (assembly release v1.0) (Hypertext Transfer Protocol://World Wide Web (dot) genome (dot) jgi-psf (dot) org/)];

Brachypodium [JGI 4× assembly, Hypertext Transfer Protocol://World Wide Web (dot) brachpodium (dot) org)];

Soybean [DOE-JGI SCP, version Glyma1 (Hypertext Transfer Protocol://World Wide Web (dot) phytozome (dot) net/)];

Grape [French-Italian Public Consortium for Grapevine Genome Characterization grapevine genome (Hypertext Transfer Protocol://World Wide Web (dot) genoscope (dot) cns (dot) fr/)];

Castobean [TIGR/J Craig Venter Institute 4× assembly [(Hypertext Transfer Protocol://msc (dot) jcvi (dot) org/r communis];

*Sorghum* [DOE-JGI SCP, version Sbi 1 [Hypertext Transfer Protocol://World Wide Web (dot) phytozome (dot) net/)];

Partially assembled genome of Maize [Hypertext Transfer Protocol://maizesequence (dot) org/];

Expressed EST and mRNA Sequences were Extracted from the Following Databases:

EST and RNA sequences from NCBI (Hypertext Transfer Protocol://World Wide Web (dot) ncbi (dot) nlm (dot) nih (dot) gov/dbEST/);

RefSeq (Hypertext Transfer Protocol://World Wide Web (dot) ncbi (dot) nlm (dot) nih (dot) gov/RefSeq/);

TAIR (Hypertext Transfer Protocol://World Wide Web (dot) arabidopsis (dot) org/);

Protein and Pathway Databases

Uniprot [Hypertext Transfer Protocol://World Wide Web (dot) uniprot (dot) org/].

AraCyc [Hypertext Transfer Protocol://World Wide Web (dot) arabidopsis (dot) org/biocyc/index (dot) jsp].

ENZYME [Hypertext Transfer Protocol://expasy (dot) org/enzyme/].

Microarray Datasets were Downloaded from:

GEO (Hypertext Transfer Protocol://World Wide Web.ncbi.nlm.nih.gov/geo/)

TAIR (Hypertext Transfer Protocol://World Wide Web.arabidopsis.org/).

Proprietary microarray data (See WO2008/122980) and Examples 2-9 below.

QTL and SNPs Information

Gramene [Hypertext Transfer Protocol://World Wide Web (dot) gramene (dot) org/qtl/].

Panzea [Hypertext Transfer Protocol://World Wide Web (dot) panzea (dot) org/index (dot) html].

Database Assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (arabidopsis, rice, castorbean, grape, brachypodium, poplar, soybean, sorghum) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

BLAST® search [Hypertext Transfer Protocol://blast(dot)ncbi(dot)nlm(dot) nih(dot)gov/Blast(dot)cgi] against all plant UniProt [Hypertext Transfer Protocol://World Wide Web(dot)uniprot(dot)org/] sequences was performed. Open reading frames of each putative transcript were analyzed and longest ORF with higher number of homologues was selected as predicted protein of the transcript. The predicted proteins were analyzed by InterPro [Hypertext Transfer Protocol://World Wide Web(dot)ebi(dot)ac(dot)uk/interpro/].

BLAST® against proteins from AraCyc and ENZYME databases was used to map the predicted transcripts to AraCyc pathways.

Predicted proteins from different species were compared using BLAST® algorithm [Hypertext Transfer Protocol://World Wide Web(dot)ncbi(dot)nlm(dot)nih (dot)gov/Blast (dot)cgi] to validate the accuracy of the predicted protein sequence, and for efficient detection of orthologs.

Gene expression profiling—Several data sources were exploited for gene expression profiling which combined microarray data and digital expression profile (see below). According to gene expression profile, a correlation analysis was performed to identify genes which are co-regulated under different developmental stages and environmental conditions and which are associated with different phenotypes.

Publicly available microarray datasets were downloaded from TAIR and NCBI GEO sites, renormalized, and integrated into the database. Expression profiling is one of the most important resource data for identifying genes important for yield, biomass, growth rate, vigor, oil content, abiotic stress tolerance of plants and nitrogen use efficiency.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (e.g., the developmental stages at which a gene can be found/expressed) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags that assembled into 67,477 unigenes (32,357 singletons and 35,120 contigs). Analysis of the data obtained against the Cucurbit Genomics Database [Hypertext Transfer Protocol://World Wide Web (dot) icugi (dot) org/] confirmed the accuracy of the sequencing and assembly. Expression patterns of selected genes fitted well their qRT-PCR data.

Example 2

Production of *Arabidopsis* Transcriptom and High Throughput Correlation Analysis of Yield, Biomass and/or Vigor Related Parameters Using 44K *Arabidopsis* Full Genome Oligonucleotide Micro-Array To produce a high throughput correlation analysis, the present inventors utilized an *Arabidopsis thaliana* oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Arabidopsis* tissues—Five tissues at different developmental stages including root, leaf, flower at anthesis, seed at 5 days after flowering (DAF) and seed at 12 DAF, representing different plant characteristics, were sampled and RNA was extracted as described as described hereinabove under "GENERAL EXPERIMENTAL AND BIOINFORMATICS METHODS". For convenience, each microarray expression information tissue type has received a Set ID as summarized in Table 1 below.

TABLE 1

Tissues used for Arabidopsis transcriptom expression sets

| Expression Set | Set ID |
|---|---|
| Root at reproductive stage | 1 |
| Seed 5 DAF at reproductive stage | 2 |
| Seed 12 DAF at reproductive stage | 3 |
| Flower at reproductive stage | 4 |
| Leaf at reproductive stage | 5 |

Table 1:
Provided are the identification (ID) digits of each of the *Arabidopsis* expression sets (1-5). DAF = days after flowering.

Yield components and vigor related parameters assessment—Eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in a tissue culture in vertical grown transparent agar plates. Most of chosen parameters were analyzed by digital imaging.

Digital imaging in Tissue culture—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P4 3.0 GHz processor) and a public domain program—ImageJ 1.37, Java based image processing program, which was developed at the U.S National Institutes of Health and is freely available on the internet at Hypertext Transfer Protocol://rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root analysis—During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula V.

Relative growth rate of root coverage=Regression coefficient of root coverage along time course.    Formula V:

Vegetative growth rate analysis—was calculated according to Formula VI. The analysis was ended with the appearance of overlapping plants.

Relative vegetative growth rate area=Regression coefficient of vegetative area along time course.    Formula VI For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra—Oxford Instrument) and its MultiQuant sowftware package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil yield—The oil yield was calculated using Formula VII.

Seed Oil yield=Seed yield per plant(gr.)*Oil % in seed.     Formula VII:

Harvest Index (seed)—The harvest index was calculated using Formula IV (described above): Harvest Index=Average seed yield per plant/Average dry weight.

Experimental Results

Nine different *Arabidopsis* ecotypes were grown and characterized for 18 parameters (named as vectors).

TABLE 2

| *Arabidopsis* correlated parameters (vectors) | |
|---|---|
| Correlated parameter with | Correlation ID |
| Seeds per silique (number) | 1 |
| Harvest Index (value) | 2 |
| seed yield per plant (gr) | 3 |
| Dry matter per plant (gr) | 4 |
| Total Leaf Area per plant (cm) | 5 |
| Oil % per seed (percent) | 6 |
| Oil yield per plant (mg) | 7 |
| relative root growth (cm/day) | 8 |
| root length day 7 (cm) | 9 |
| root length day 13 (cm) | 10 |
| fresh weight (gr) | 11 |
| seed weight (gr) | 12 |
| Vegetative growth rate (cm$^2$/day) | 13 |
| Lamina length (cm) | 14 |
| Lamina width(cm) | 15 |
| Leaf width/length (ratio) | 16 |
| Blade circularity (cm) | 17 |
| Silique length (cm) | 18 |

Table 2: Provided are the *Arabidopsis* correlated parameters (correlation ID Nos. 1-18).
Abbreviations:
Cm = centimeter(s);
gr = gram(s);
mg = milligram(s).

The characterized values are summarized in Table 3 and 4 below and the correlation analysis is provided in Table 5 below.

TABLE 3

| | Measured parameters in *Arabidopsis* ecotypes | | | | |
|---|---|---|---|---|---|
| Ecotype/Correlation ID No. | Line-1 | Line-2 | Line-3 | Line-4 | Line-5 |
| 1 | 45.44 | 53.47 | 58.47 | 35.27 | 48.56 |
| 2 | 0.53 | 0.35 | 0.56 | 0.33 | 0.37 |
| 3 | 0.34 | 0.44 | 0.59 | 0.42 | 0.61 |
| 4 | 0.64 | 1.27 | 1.05 | 1.28 | 1.69 |
| 5 | 46.86 | 109.89 | 58.36 | 56.8 | 114.66 |
| 6 | 34.42 | 31.19 | 38.05 | 27.76 | 35.49 |
| 7 | 118.63 | 138.73 | 224.06 | 116.26 | 218.27 |
| 8 | 0.631 | 0.664 | 1.176 | 1.089 | 0.907 |
| 9 | 0.937 | 1.759 | 0.701 | 0.728 | 0.991 |
| 10 | 4.419 | 8.53 | 5.621 | 4.834 | 5.957 |
| 11 | 1.51 | 3.607 | 1.935 | 2.082 | 3.556 |
| 12 | 0.02031238 | 0.02302244 | 0.02522553 | 0.03444936 | 0.02021001 |
| 13 | 0.31258158 | 0.37755231 | 0.4841254 | 0.47415969 | 0.42508143 |
| 14 | 2.76683 | 3.54357 | 3.27353 | 3.78465 | 3.68982 |
| 15 | 1.38477 | 1.69708 | 1.45982 | 1.37418 | 1.82816 |
| 16 | 0.352785 | 0.287757 | 0.315993 | 0.258499 | 0.356279 |
| 17 | 0.508828 | 0.48083 | 0.45029 | 0.369857 | 0.500566 |
| 18 | 1.06 | 1.26 | 1.31 | 1.47 | 1.24 |

Table 3: Provided are the values of each of the parameters measured in *Arabidopsis* ecotypes (lines 1-5) using the correlation ID numbers described in Table 2 hereinabove.

TABLE 4

Measured parameters in *Arabidopsis* ecotypes-continue

| Ecotype/Correlation ID No. | Line-6 | Line-7 | Line-8 | Line-9 |
|---|---|---|---|---|
| 1 | 37 | 39.38 | 40.53 | 25.53 |
| 2 | 0.32 | 0.45 | 0.51 | 0.41 |
| 3 | 0.43 | 0.36 | 0.62 | 0.55 |
| 4 | 1.34 | 0.81 | 1.21 | 1.35 |
| 5 | 110.82 | 88.49 | 121.79 | 93.04 |
| 6 | 32.91 | 31.56 | 30.79 | 34.02 |
| 7 | 142.11 | 114.15 | 190.06 | 187.62 |
| 8 | 0.774 | 0.606 | 0.701 | 0.782 |
| 9 | 1.163 | 1.284 | 1.414 | 1.251 |
| 10 | 6.372 | 5.649 | 7.06 | 7.041 |
| 11 | 4.338 | 3.467 | 3.479 | 3.71 |
| 12 | 0.02634353 | 0.02048623 | 0.02260485 | 0.02352516 |
| 13 | 0.64454891 | 0.42961167 | 0.38423782 | 0.47130278 |
| 14 | 4.59654 | 3.87735 | 3.71722 | 4.14899 |
| 15 | 1.64999 | 1.51005 | 1.81691 | 1.66772 |
| 16 | 0.272645 | 0.304707 | 0.335145 | 0.306598 |
| 17 | 0.375805 | 0.393745 | 0.491283 | 0.408787 |
| 18 | 1.09 | 1.18 | 1.18 | 1 |

Table 4: Provided are the values of each of the parameters measured in *Arabidopsis* ecotypes (lines 6-9) using the correlation ID numbers described in Table 2 hereinabove.

TABLE 5

Correlation between the expression level of selected genes of some embodiments of the invention in various tissues and the phenotypic performance under normal conditions across *Arabidopsis* accessions

| Gene Name | R | P value | Exp. set | Corr. ID | Gene Name | R | P value | Exp. set | Corr. ID |
|---|---|---|---|---|---|---|---|---|---|
| LYD289 | 0.92 | 3.17E−03 | 2 | 18 | LYD289 | 0.90 | 2.54E−03 | 4 | 18 |
| LYD289 | 0.75 | 3.34E−02 | 5 | 3 | LYD289 | 0.75 | 3.25E−02 | 5 | 7 |
| LYD290 | 0.77 | 2.42E−02 | 1 | 18 | LYD290 | 0.79 | 3.33E−02 | 2 | 9 |
| LYD290 | 0.71 | 4.87E−02 | 3 | 2 | LYD291 | 0.89 | 7.19E−03 | 2 | 2 |
| LYD291 | 0.76 | 4.58E−02 | 2 | 6 | LYD291 | 0.71 | 4.76E−02 | 3 | 18 |
| LYD292 | 0.70 | 5.11E−02 | 1 | 1 | LYD292 | 0.73 | 4.16E−02 | 4 | 8 |
| LYD292 | 0.74 | 3.48E−02 | 5 | 12 | LYD292 | 0.81 | 1.44E−02 | 5 | 18 |
| LYD293 | 0.71 | 4.72E−02 | 3 | 18 | LYD293 | 0.72 | 4.28E−02 | 5 | 3 |
| LYD293 | 0.74 | 3.65E−02 | 5 | 7 | LYD293 | 0.76 | 3.03E−02 | 5 | 8 |
| LYD294 | 0.74 | 3.55E−02 | 1 | 18 | LYD294 | 0.81 | 1.57E−02 | 5 | 12 |
| LYD294 | 0.79 | 2.01E−02 | 5 | 18 | LYD295 | 0.73 | 3.83E−02 | 1 | 18 |
| LYD295 | 0.80 | 3.03E−02 | 2 | 2 | LYD295 | 0.79 | 2.08E−02 | 3 | 3 |
| LYD295 | 0.71 | 4.92E−02 | 3 | 7 | LYD295 | 0.72 | 4.32E−02 | 5 | 1 |
| LYD296 | 0.76 | 4.69E−02 | 2 | 18 | LYD296 | 0.76 | 4.57E−02 | 2 | 3 |
| LYD296 | 0.77 | 4.34E−02 | 2 | 7 | LYD296 | 0.86 | 5.77E−03 | 3 | 18 |
| LYD297 | 0.86 | 1.23E−02 | 2 | 1 | LYD297 | 0.76 | 4.69E−02 | 2 | 18 |
| LYD297 | 0.84 | 8.28E−03 | 3 | 4 | LYD297 | 0.76 | 3.03E−02 | 5 | 12 |
| LYD297 | 0.75 | 3.32E−02 | 5 | 18 | LYD298 | 0.70 | 7.71E−02 | 2 | 1 |
| LYD298 | 0.72 | 6.93E−02 | 2 | 18 | LYD298 | 0.88 | 3.55E−03 | 3 | 12 |
| LYD298 | 0.75 | 3.28E−02 | 3 | 18 | LYD299 | 0.85 | 7.67E−03 | 1 | 12 |
| LYD299 | 0.76 | 2.79E−02 | 1 | 18 | LYD299 | 0.71 | 7.32E−02 | 2 | 14 |
| LYD299 | 0.87 | 1.19E−02 | 2 | 13 | LYD299 | 0.84 | 9.28E−03 | 3 | 12 |
| LYD299 | 0.98 | 1.37E−05 | 4 | 12 | LYD299 | 0.85 | 7.82E−03 | 5 | 12 |
| LYD300 | 0.80 | 1.68E−02 | 1 | 12 | LYD300 | 0.75 | 3.08E−02 | 1 | 18 |
| LYD300 | 0.73 | 6.21E−02 | 2 | 9 | LYD300 | 0.86 | 6.54E−03 | 3 | 12 |
| LYD300 | 0.78 | 2.26E−02 | 3 | 18 | LYD301 | 0.73 | 3.94E−02 | 1 | 3 |
| LYD301 | 0.77 | 2.55E−02 | 1 | 7 | LYD301 | 0.84 | 1.68E−02 | 2 | 4 |
| LYD301 | 0.80 | 3.03E−02 | 2 | 3 | LYD301 | 0.77 | 4.39E−02 | 2 | 7 |
| LYD301 | 0.71 | 4.99E−02 | 3 | 15 | LYD301 | 0.89 | 3.27E−03 | 3 | 10 |
| LYD301 | 0.71 | 5.06E−02 | 4 | 4 | LYD301 | 0.72 | 4.21E−02 | 4 | 15 |
| LYD301 | 0.80 | 1.82E−02 | 4 | 3 | LYD301 | 0.78 | 2.24E−02 | 4 | 7 |
| LYD301 | 0.76 | 2.94E−02 | 4 | 13 | LYD301 | 0.81 | 1.59E−02 | 5 | 4 |
| LYD301 | 0.85 | 6.99E−03 | 5 | 15 | LYD301 | 0.73 | 4.04E−02 | 5 | 5 |
| LYD302 | 0.83 | 2.04E−02 | 2 | 16 | LYD302 | 0.74 | 5.73E−02 | 2 | 17 |
| LYD302 | 0.91 | 1.50E−03 | 3 | 18 | LYD302 | 0.76 | 2.85E−02 | 4 | 18 |
| LYD303 | 0.83 | 1.00E−02 | 1 | 15 | LYD303 | 0.76 | 2.83E−02 | 1 | 5 |
| LYD303 | 0.72 | 4.40E−02 | 3 | 15 | LYD303 | 0.87 | 5.08E−03 | 3 | 10 |
| LYD303 | 0.80 | 1.67E−02 | 4 | 18 | LYD304 | 0.80 | 2.92E−02 | 2 | 2 |
| LYD304 | 0.70 | 5.27E−02 | 3 | 3 | LYD305 | 0.93 | 2.70E−03 | 2 | 4 |
| LYD305 | 0.83 | 2.01E−02 | 2 | 15 | LYD305 | 0.73 | 6.26E−02 | 2 | 3 |
| LYD305 | 0.76 | 2.94E−02 | 3 | 18 | LYD306 | 0.87 | 4.65E−03 | 1 | 1 |
| LYD306 | 0.86 | 6.39E−03 | 1 | 18 | LYD306 | 0.74 | 5.59E−02 | 2 | 9 |
| LYD306 | 0.82 | 1.34E−02 | 3 | 9 | LYD306 | 0.70 | 5.24E−02 | 3 | 10 |

TABLE 5-continued

Correlation between the expression level of selected genes of some embodiments of the invention in various tissues and the phenotypic performance under normal conditions across *Arabidopsis* accessions

| Gene Name | R | P value | Exp. set | Corr. ID | Gene Name | R | P value | Exp. set | Corr. ID |
|---|---|---|---|---|---|---|---|---|---|
| LYD306 | 0.72 | 4.51E−02 | 4 | 1 | LYD306 | 0.92 | 1.36E−03 | 5 | 18 |
| LYD307 | 0.89 | 2.95E−03 | 3 | 3 | LYD307 | 0.79 | 1.94E−02 | 3 | 7 |
| LYD308 | 0.74 | 3.52E−02 | 1 | 9 | LYD308 | 0.71 | 7.45E−02 | 2 | 2 |
| LYD308 | 0.70 | 5.29E−02 | 5 | 12 | LYD308 | 0.97 | 5.57E−05 | 5 | 14 |
| LYD308 | 0.76 | 2.86E−02 | 5 | 11 | LYD308 | 0.86 | 6.25E−03 | 5 | 13 |
| LYD309 | 0.84 | 8.79E−03 | 3 | 16 | LYD309 | 0.83 | 1.08E−02 | 4 | 1 |
| LYD310 | 0.85 | 1.60E−02 | 2 | 12 | LYD310 | 0.74 | 5.68E−02 | 2 | 13 |
| LYD310 | 0.95 | 3.36E−04 | 3 | 16 | LYD310 | 0.73 | 4.17E−02 | 3 | 17 |
| LYD310 | 0.75 | 3.39E−02 | 5 | 3 | LYD310 | 0.91 | 1.78E−03 | 5 | 6 |
| LYD310 | 0.87 | 4.96E−03 | 5 | 7 | LYD311 | 0.73 | 4.06E−02 | 3 | 12 |
| LYD311 | 0.80 | 1.76E−02 | 3 | 18 | LYD312 | 0.72 | 6.60E−02 | 2 | 18 |
| LYD312 | 0.74 | 3.70E−02 | 3 | 12 | LYD312 | 0.73 | 3.97E−02 | 5 | 18 |
| LYD313 | 0.75 | 3.13E−02 | 4 | 1 | LYD313 | 0.87 | 4.72E−03 | 5 | 12 |
| LYD315 | 0.83 | 2.12E−02 | 2 | 2 | LYD315 | 0.73 | 6.03E−02 | 2 | 6 |
| LYD315 | 0.72 | 4.45E−02 | 3 | 3 | LYD315 | 0.81 | 1.41E−02 | 4 | 18 |
| LYD316 | 0.76 | 4.96E−02 | 2 | 1 | LYD316 | 0.79 | 3.36E−02 | 2 | 18 |
| LYD316 | 0.84 | 9.29E−03 | 3 | 3 | LYD316 | 0.87 | 4.46E−03 | 3 | 7 |
| LYD318 | 0.75 | 3.33E−02 | 5 | 2 | LYD319 | 0.77 | 4.30E−02 | 2 | 4 |
| LYD319 | 0.84 | 1.83E−02 | 2 | 15 | LYD319 | 0.77 | 4.11E−02 | 2 | 5 |
| LYD319 | 0.78 | 2.17E−02 | 3 | 1 | LYD319 | 0.75 | 3.34E−02 | 3 | 17 |
| LYD319 | 0.85 | 7.55E−03 | 4 | 6 | LYD319 | 0.76 | 2.92E−02 | 4 | 7 |
| LYD320 | 0.74 | 3.49E−02 | 3 | 14 | LYD320 | 0.80 | 1.69E−02 | 3 | 13 |
| LYD321 | 0.76 | 2.92E−02 | 4 | 1 | LYD321 | 0.71 | 4.76E−02 | 5 | 17 |
| LYD322 | 0.87 | 4.62E−03 | 5 | 4 | LYD322 | 0.79 | 2.07E−02 | 5 | 15 |
| LYD323 | 0.70 | 5.23E−02 | 1 | 16 | LYD323 | 0.77 | 4.25E−02 | 2 | 2 |
| LYD323 | 0.73 | 4.15E−02 | 4 | 1 | LYD323 | 0.87 | 4.54E−03 | 4 | 17 |
| LYD323 | 0.92 | 1.17E−03 | 5 | 1 | LYD323 | 0.85 | 8.20E−03 | 5 | 17 |
| LYD324 | 0.89 | 2.94E−03 | 3 | 12 | LYD324 | 0.71 | 4.65E−02 | 3 | 18 |
| LYD324 | 0.73 | 4.16E−02 | 5 | 4 | LYD324 | 0.82 | 1.18E−02 | 5 | 3 |
| LYD324 | 0.74 | 3.52E−02 | 5 | 7 | LYD325 | 0.81 | 1.55E−02 | 1 | 12 |
| LYD325 | 0.75 | 3.21E−02 | 3 | 12 | LYD325 | 0.77 | 2.52E−02 | 3 | 18 |
| LYD326 | 0.77 | 2.60E−02 | 4 | 9 | LYD326 | 0.73 | 3.87E−02 | 4 | 10 |
| LYD327 | 0.78 | 2.35E−02 | 3 | 16 | LYD327 | 0.78 | 2.27E−02 | 5 | 18 |
| LYD328 | 0.72 | 4.20E−02 | 3 | 3 | LYD328 | 0.78 | 2.32E−02 | 5 | 12 |
| LYD328 | 0.89 | 2.68E−03 | 5 | 8 | LYD329 | 0.71 | 4.80E−02 | 1 | 8 |
| LYD329 | 0.79 | 3.41E−02 | 2 | 1 | LYD329 | 0.92 | 3.64E−03 | 2 | 17 |
| LYD329 | 0.78 | 2.25E−02 | 3 | 3 | LYD329 | 0.74 | 3.57E−02 | 3 | 13 |
| LYD329 | 0.81 | 1.41E−02 | 3 | 8 | LYD329 | 0.90 | 2.51E−03 | 5 | 8 |
| LYD330 | 0.74 | 3.63E−02 | 3 | 2 | LYD331 | 0.74 | 3.50E−02 | 1 | 6 |
| LYD331 | 0.74 | 3.72E−02 | 1 | 7 | LYD331 | 0.72 | 4.38E−02 | 3 | 3 |
| LYD331 | 0.76 | 2.77E−02 | 3 | 7 | LYD331 | 0.73 | 3.85E−02 | 3 | 17 |
| LYD331 | 0.75 | 3.29E−02 | 4 | 3 | LYD331 | 0.75 | 3.36E−02 | 4 | 6 |
| LYD331 | 0.81 | 1.54E−02 | 4 | 7 | LYD331 | 0.75 | 3.15E−02 | 5 | 3 |
| LYD331 | 0.76 | 3.00E−02 | 5 | 6 | LYD331 | 0.82 | 1.18E−02 | 5 | 7 |
| LYD332 | 0.78 | 2.17E−02 | 1 | 6 | LYD332 | 0.74 | 3.70E−02 | 3 | 16 |
| LYD332 | 0.81 | 1.45E−02 | 3 | 17 | LYD334 | 0.72 | 6.61E−02 | 2 | 3 |
| LYD334 | 0.82 | 2.30E−02 | 2 | 6 | LYD334 | 0.80 | 3.09E−02 | 2 | 7 |
| LYD334 | 0.76 | 4.96E−02 | 2 | 8 | LYD334 | 0.78 | 2.19E−02 | 3 | 12 |
| LYD334 | 0.73 | 4.01E−02 | 4 | 3 | LYD334 | 0.70 | 5.27E−02 | 4 | 7 |
| LYD335 | 0.74 | 5.55E−02 | 2 | 2 | LYD337 | 0.77 | 4.25E−02 | 2 | 10 |
| LYD337 | 0.76 | 3.03E−02 | 3 | 3 | LYD338 | 0.75 | 3.38E−02 | 3 | 2 |
| LYD338 | 0.74 | 3.55E−02 | 4 | 13 | LYD338 | 0.82 | 1.31E−02 | 5 | 6 |
| LYD338 | 0.79 | 1.88E−02 | 5 | 7 | LYD339 | 0.79 | 3.58E−02 | 2 | 2 |
| LYD339 | 0.71 | 4.83E−02 | 4 | 3 | LYD339 | 0.78 | 2.13E−02 | 4 | 6 |
| LYD339 | 0.80 | 1.71E−02 | 4 | 7 | LYD340 | 0.71 | 4.67E−02 | 1 | 8 |
| LYD340 | 0.73 | 4.13E−02 | 4 | 3 | LYD340 | 0.71 | 4.64E−02 | 4 | 7 |
| LYD340 | 0.84 | 9.57E−03 | 5 | 3 | LYD340 | 0.74 | 3.42E−02 | 5 | 6 |
| LYD340 | 0.89 | 3.32E−03 | 5 | 7 | LYD341 | 0.86 | 1.40E−02 | 2 | 2 |
| LYD341 | 0.76 | 2.91E−02 | 5 | 16 | LYD341 | 0.71 | 5.05E−02 | 5 | 17 |
| LYD342 | 0.71 | 7.17E−02 | 2 | 18 | LYD342 | 0.88 | 4.16E−03 | 3 | 12 |
| LYD342 | 0.80 | 1.82E−02 | 4 | 13 | LYD342 | 0.74 | 3.71E−02 | 5 | 4 |
| LYD343 | 0.86 | 1.21E−02 | 2 | 2 | LYD343 | 0.77 | 2.57E−02 | 3 | 4 |
| LYD343 | 0.72 | 4.25E−02 | 3 | 3 | LYD343 | 0.83 | 1.12E−02 | 5 | 14 |
| LYD343 | 0.70 | 5.19E−02 | 5 | 13 | LYD344 | 0.77 | 2.43E−02 | 1 | 13 |
| LYD344 | 0.81 | 2.69E−02 | 2 | 2 | LYD344 | 0.74 | 3.70E−02 | 3 | 3 |
| LYD344 | 0.86 | 6.81E−03 | 5 | 2 | | | | | |

Table 5. Provided are the correlations (R) between the expression levels of yield improving genes and their homologues in tissues [roots, seeds, flower, and leaf; Expression sets (Exp)] and the phenotypic performance in various yield, biomass, and direct yield components [Correlation ID vector (corr.)] under normal condition across *Arabidopsis* accessions.
P = p value.

Example 3

Production of *Arabidopsis* Transcriptom and High Throughput Correlation Analysis of Normal and Nitrogen Limiting Conditions Using 44K *Arabidopsis* Oligonucleotide Micro-Array In order to produce a high throughput correlation analysis, the present inventors utilized a *Arabidopsis* oligonucleotide micro-array, produced by Agilent Technologies [Hypertext Transfer Protocol://World Wide Web (dot) chem (dot) agilent (dot) com/Scripts/PDS (dot) asp?1 Page=50879]. The array oligonucleotide represents about 44,000 *Arabidopsis* genes and transcripts. To define correlations between the levels of RNA expression with NUE, yield components or vigor related parameters various plant characteristics of 14 different *Arabidopsis* ecotypes were analyzed. Among them, ten ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Two tissues of plants [leaves and stems] growing at two different nitrogen fertilization levels (1.5 mM Nitrogen or 6 mM Nitrogen) were sampled and RNA was extracted as described hereinabove under "GENERAL EXPERIMENTAL AND BIOINFORMATICS METHODS". For convenience, each micro-array expression information tissue type has received a Set ID as summarized in Table 6 below.

TABLE 6

Tissues used for *Arabidopsis* transcriptom expression sets

| Expression Set | Set ID |
| --- | --- |
| Leaves at 1.5 mM Nitrogen fertilization | 1 |
| Stems at 6 mM Nitrogen fertilization | 2 |
| Leaves at 6 mM Nitrogen fertilization | 3 |
| Stems at 1.5 mM Nitrogen fertilization | 4 |

Table 6: Provided are the identification (ID) digits of each of the *Arabidopsis* expression sets.

Assessment of *Arabidopsis* yield components and vigor related parameters under different nitrogen fertilization levels—10 *Arabidopsis* accessions in 2 repetitive plots each containing 8 plants per plot were grown at greenhouse. The growing protocol used was as follows: surface sterilized seeds were sown in Eppendorf tubes containing 0.5× Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions (Normal Nitrogen conditions) was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [Hypertext Transfer Protocol:// rsb (dot) info (dot) nih (dot) gov/ij/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol:// rsbweb (dot) nih (dot) gov/]. Next, analyzed data was saved to text files and processed using the JMP statistical analysis software (SAS institute).

Data parameters collected are summarized in Table 7, herein below.

TABLE 7

*Arabidopsis* correlated parameters (vectors)

| Correlated parameter with | Correlation ID |
| --- | --- |
| N 6 mM; Seed Yield [gr./plant] | 1 |
| N 6 mM; Harvest Index (ratio) | 2 |
| N 6 mM; 1000 Seeds weight [gr.] | 3 |
| N 6 mM; seed yield/rosette area day at day 10 [gr./cm$^2$] | 4 |
| N 6 mM; seed yield/leaf blade [gr./cm$^2$] | 5 |
| N 1.5 mM; Rosette Area at day 8 [cm$^2$] | 6 |
| N 1.5 mM; Rosette Area at day 10 [cm$^2$] | 7 |
| N 1.5 mM; Leaf Number at day 10 (number) | 8 |
| N 1.5 mM; Leaf Blade Area at day 10 [cm$^2$] | 9 |
| N 1.5 mM; RGR of Rosette Area at day 3 [cm$^2$/day] | 10 |
| N 1.5 mM; t50 Flowering [day] | 11 |
| N 1.5 mM; Dry Weight [gr./plant] | 12 |
| N 1.5 mM; Seed Yield [gr./plant] | 13 |
| N 1.5 mM; Harvest Index (ratio) | 14 |
| N 1.5 mM; 1000 Seeds weight [gr.] | 15 |
| N 1.5 mM; seed yield/rosette area at day 10 [gr./cm$^2$] | 16 |
| N 1.5 mM; seed yield/leaf blade [gr./cm$^2$] | 17 |
| N 1.5 mM; % Seed yield reduction compared to N 6 mM (ratio) | 18 |
| N 1.5 mM; % Biomass reduction compared to N 6 mM (ratio) | 19 |
| N 6 mM; Rosette Area at day 8 [cm$^2$] | 20 |
| N 6 mM; Rosette Area at day 10 [cm$^2$] | 21 |
| N 6 mM; Leaf Number at day 10 (number) | 22 |
| N 6 mM; Leaf Blade Area at day 10 (cm$^2$) | 23 |
| N 6 mM; RGR of Rosette Area at day 3 [cm$^2$/gr.] | 24 |
| N 6 mM; t50 Flowering [day] | 25 |
| N 6 mM; Dry Weight [gr./plant] | 26 |
| N 6 mM; N level/DW (SPAD unit/gr. plant) | 27 |
| N 6 mM; DW/N level [gr./SPAD unit] | 28 |
| N 6 mM; N level/FW (ratio) | 29 |
| N 6 mM; Seed yield/N unit [gr./SPAD unit] | 30 |
| N 1.5 mM; N level/FW [SPAD unit/gr.] | 31 |
| N 1.5 mM; N level/DW [SPAD unit/gr.] | 32 |
| N 1.5 mM; DW/N level [gr/SPAD unit] | 33 |
| N 1.5 mM; seed yield/N level [gr/SPAD unit] | 34 |

Table 7. Provided are the *Arabidopsis* correlated parameters (vectors).
"N" = Nitrogen at the noted concentrations;
"gr." = grams;
"SPAD" = chlorophyll levels;
"t50" = time where 50% of plants flowered;
"gr./SPAD unit" = plant biomass expressed in grams per unit of nitrogen in plant measured by SPAD.
"DW" = Plant Dry Weight;
"FW" = Plant Fresh weight;
"N level/DW" = plant Nitrogen level measured in SPAD unit per plant biomass [gr.];
"DW/N level" = plant biomass per plant [gr.]/SPAD unit;
Rosette Area (measured using digital analysis);
Plot Coverage at the indicated day [%](calculated by the dividing the total plant area with the total plot area);
Leaf Blade Area at the indicated day [cm$^2$] (measured using digital analysis);
RGR (relative growth rate) of Rosette Area at the indicated day [cm$^2$/day];
t50 Flowering [day[(the day in which 50% of plant flower);
seed yield/rosette area at day 10 [gr/cm$^2$] (calculated);
seed yield/leaf blade [gr/cm$^2$] (calculated);
seed yield/N level [gr/SPAD unit] (calculated).

Assessment of NUE, yield components and vigor-related parameters—Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process is repeated every 2-3 days starting at day 9-12 till day 16-19 (respectively) from transplanting.

The image processing system which was used is described in Example 2 above. Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf analysis—Using the digital analysis leaves data was calculated, including leaf number, leaf blade area, plot coverage, Rosette diameter and Rosette area.

Relative growth rate area: The relative growth rate area of the rosette and the leaves was calculated according to Formulas VIII and IX, respectively.

Relative growth rate of rosette area=Regression coefficient of rosette area along time course.   Formula VIII:

Relative growth rate of plant leaf number=Regression coefficient of plant leaf number along time course.   Formula IX Seed yield and 1000 seeds weight—At the end of the experiment all seeds from all plots were collected and weighed in order to measure seed yield per plant in terms of total seed weight per plant (gr.). For the calculation of 1000 seed weight, an average weight of 0.02 grams was measured from each sample, the seeds were scattered on a glass tray and a picture was taken. Using the digital analysis, the number of seeds in each sample was calculated.

Dry weight and seed yield—At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index (seed)—The harvest index was calculated using Formula IV as described above [Harvest Index=Average seed yield per plant/Average dry weight].

$T_{50}$ days to flowering—Each of the repeats was monitored for flowering date. Days of flowering was calculated from sowing date till 50% of the plots flowered.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr.]/SPAD unit], plant DW per nitrogen unit [DW/N level=plant biomass per plant [gr.]/SPAD unit], and nitrogen level per gram of biomass [N level/DW=SPAD unit/plant biomass per plant (gr.)] were calculated.

Percent of seed yield reduction—measures the amount of seeds obtained in plants when grown under nitrogen-limiting conditions compared to seed yield produced at normal nitrogen levels expressed in percentages (%).

Experimental Results 10 different *Arabidopsis* accessions (ecotypes) were grown and characterized for 37 parameters as described above. The average for each of the measured parameters was calculated using the JMP software (Table 8 and 9 below). Subsequent correlation analysis between the various transcriptom sets (Table 6) and the average parameters was conducted (Table 10).

TABLE 8

Measured parameters in *Arabidopsis* accessions

| Ecotype/Corr. ID | Line-1 | Line-2 | Line-3 | Line-4 | Line-5 |
|---|---|---|---|---|---|
| 1 | 0.11575 | 0.1651625 | 0.10846875 | 0.08195 | 0.11918125 |
| 2 | 0.27999946 | 0.30852795 | 0.28360337 | 0.15835749 | 0.2058752 |
| 3 | 0.01474256 | 0.01686869 | 0.01776982 | 0.01207785 | 0.01553451 |
| 4 | 0.08243942 | 0.10579199 | 0.04051086 | 0.03389743 | 0.05563382 |
| 5 | 0.33919761 | 0.52646 | 0.20718176 | 0.18267073 | 0.27723756 |
| 6 | 0.76004675 | 0.70878892 | 1.06135087 | 1.1569617 | 1.0001808 |
| 7 | 1.42963825 | 1.32500951 | 1.7662424 | 1.97095367 | 1.83234886 |
| 8 | 6.875 | 7.3125 | 7.3125 | 7.875 | 7.75 |
| 9 | 0.33486516 | 0.26631535 | 0.37431832 | 0.3868142 | 0.3699387 |
| 10 | 0.63055011 | 0.7927894 | 0.50199713 | 0.49086784 | 0.71950821 |
| 11 | 15.9674256 | 20.967741 | 14.8356433 | 24.7083342 | 23.6981965 |
| 12 | 0.164375 | 0.12375 | 0.081875 | 0.113125 | 0.12375 |
| 13 | 0.0317625 | 0.02526875 | 0.0230125 | 0.0098375 | 0.00879375 |
| 14 | 0.19221006 | 0.20271686 | 0.29498642 | 0.08498642 | 0.07117143 |
| 15 | 0.0164661 | 0.01575586 | 0.01752601 | 0.01428241 | 0.02237168 |
| 16 | 0.0221105 | 0.0190193 | 0.01356505 | 0.00522479 | 0.00495957 |
| 17 | 0.09480609 | 0.09462778 | 0.06338215 | 0.02639571 | 0.02415312 |
| 18 | 72.55939525 | 84.70067358 | 78.78421204 | 87.9957291 | 92.62153233 |
| 19 | 60.74626866 | 76.70588235 | 78.55973813 | 78.14009662 | 78.6407767 |
| 20 | 0.75895075 | 0.85681934 | 1.4770776 | 1.27750001 | 1.09516034 |
| 21 | 1.40594707 | 1.57034299 | 2.67253089 | 2.41758766 | 2.14203082 |
| 22 | 6.25 | 7.3125 | 8.0625 | 8.75 | 8.75 |
| 23 | 0.34248457 | 0.31479663 | 0.52295373 | 0.44862141 | 0.42970295 |

TABLE 8-continued

Measured parameters in *Arabidopsis* accessions

| Ecotype/ Corr. ID | Line-1 | Line-2 | Line-3 | Line-4 | Line-5 |
|---|---|---|---|---|---|
| 24 | 0.6891365 | 1.02385276 | 0.61434467 | 0.60098475 | 0.65076159 |
| 25 | 16.3714019 | 20.5000004 | 14.6346459 | 24 | 23.5950703 |
| 26 | 0.41875 | 0.53125 | 0.381875 | 0.5175 | 0.579375 |
| 27 | 22.49 | | | 28.27 | |
| 28 | 0.018620067 | | | 0.018306704 | |
| 29 | 53.70549848 | | | 54.62479871 | |
| 30 | 0.004209091 | | | 0.002952562 | |
| 31 | 45.59 | | | 42.11 | |
| 32 | 167.3003802 | | | 241.0607735 | |
| 33 | 0.005977273 | | | 0.004148331 | |
| 34 | 0.001155 | | | 0.000360744 | |

Table 8: Provided are the values of each of the parameters measured in *Arabidopsis* ecotypes (lines 1-5) using the correlation ID numbers described in Table 7 hereinabove.

TABLE 9

Measured parameters in *Arabidopsis* accessions-continue

| Ecotype/ Corr. ID | Line-6 | Line-7 | Line-8 | Line-9 | Line-10 |
|---|---|---|---|---|---|
| 1 | 0.13876875 | 0.10695625 | 0.1380875 | 0.0948125 | 0.06754375 |
| 2 | 0.2762645 | 0.17062181 | 0.21248036 | 0.1655574 | 0.13618211 |
| 3 | 0.01543419 | 0.01403759 | 0.01660137 | 0.01608078 | 0.01601005 |
| 4 | 0.05702681 | 0.05537429 | 0.05071512 | 0.05818119 | 0.03071849 |
| 5 | 0.28118206 | 0.25233196 | 0.27125843 | 0.23547195 | 0.15792361 |
| 6 | 0.91049714 | 0.94164552 | 1.11820707 | 0.63830722 | 0.99598092 |
| 7 | 1.81767559 | 1.63622587 | 1.99606088 | 1.14962099 | 1.75392334 |
| 8 | 7.625 | 7.1875 | 8.625 | 5.92857143 | 7.9375 |
| 9 | 0.38633196 | 0.34966412 | 0.37896098 | 0.30665846 | 0.37272108 |
| 10 | 0.82522726 | 0.64561797 | 0.66798775 | 0.63647393 | 0.60534304 |
| 11 | 18.0593189 | 19.488184 | 23.5678247 | 21.8884261 | 23.5662586 |
| 12 | 0.134375 | 0.10625 | 0.148125 | 0.17125 | 0.18375 |
| 13 | 0.03231875 | 0.01931875 | 0.0120125 | 0.01350446 | 0.005525 |
| 14 | 0.24052391 | 0.1786763 | 0.08141143 | 0.07930284 | 0.03089076 |
| 15 | 0.0147897 | 0.01364492 | 0.0216896 | 0.01860767 | 0.01834821 |
| 16 | 0.01780867 | 0.01273805 | 0.00676616 | 0.01177002 | 0.00315298 |
| 17 | 0.08363306 | 0.05886 | 0.03430777 | 0.04403838 | 0.01485086 |
| 18 | 76.71035446 | 81.93770818 | 91.30080565 | 85.75666711 | 91.82011659 |
| 19 | 73.19201995 | 83.06772908 | 77.18960539 | 70.11995638 | 62.97229219 |
| 20 | 1.23563711 | 1.09369169 | 1.40984007 | 0.89057621 | 1.22408964 |
| 21 | 2.4744351 | 1.96527638 | 2.72071991 | 1.64211359 | 2.20715087 |
| 22 | 8.375 | 7.125 | 9.4375 | 6.3125 | 8.0625 |
| 23 | 0.49679143 | 0.42802388 | 0.50868963 | 0.40531471 | 0.43015889 |
| 24 | 0.67559702 | 0.58421861 | 0.61299718 | 0.51546854 | 0.47694692 |
| 25 | 15.032695 | 19.7496866 | 22.8871401 | 18.8041534 | 23.3779994 |
| 26 | 0.50125 | 0.6275 | 0.649375 | 0.573125 | 0.49625 |
| 27 | 33.32 | | | 39 | 17.64 |
| 28 | 0.015042326 | | | 0.014694282 | 0.028130951 |
| 29 | 66.4790786 | | | 68.05368458 | 35.54803406 |
| 30 | 0.005298764 | | | 0.003255054 | 0.00233267 |
| 31 | 53.11 | | | 67 | 28.15 |
| 32 | 194.9767442 | | | 169.3430657 | 157.8231293 |
| 33 | 0.005128817 | | | 0.005905172 | 0.006336207 |
| 34 | 0.00123354 | | | 0.000465671 | 0.000190517 |

Table 9: Provided are the values of each of the parameters measured in *Arabidopsis* ecotypes (lines 6-10) using the correlation ID numbers described in Table 7 hereinabove.

TABLE 10

Correlation between the expression level of selected genes of some embodiments of the invention in various tissues and the phenotypic performance under normal or abiotic stress conditions across *Arabidopsis* accessions

| Gene Name | R | P value | Exp. set | Corr. ID | Gene Name | R | P value | Exp. set | Corr. ID |
|---|---|---|---|---|---|---|---|---|---|
| LYD289 | 0.74 | 1.36E−02 | 1 | 19 | LYD289 | 0.72 | 2.76E−02 | 2 | 19 |
| LYD289 | 0.76 | 1.02E−02 | 3 | 19 | LYD289 | 0.71 | 2.17E−02 | 4 | 19 |

TABLE 10-continued

Correlation between the expression level of selected genes of some embodiments of the invention in various tissues and the phenotypic performance under normal or abiotic stress conditions across *Arabidopsis* accessions

| Gene Name | R | P value | Exp. set | Corr. ID | Gene Name | R | P value | Exp. set | Corr. ID |
|---|---|---|---|---|---|---|---|---|---|
| LYD290 | 0.78 | 8.04E−03 | 1 | 2 | LYD290 | 0.70 | 2.34E−02 | 1 | 1 |
| LYD290 | 0.74 | 1.53E−02 | 3 | 20 | LYD290 | 0.81 | 4.63E−03 | 3 | 9 |
| LYD290 | 0.77 | 9.60E−03 | 3 | 21 | LYD290 | 0.86 | 1.41E−03 | 3 | 23 |
| LYD291 | 0.74 | 2.25E−02 | 2 | 2 | LYD291 | 0.79 | 1.13E−02 | 2 | 16 |
| LYD291 | 0.73 | 2.44E−02 | 2 | 4 | LYD291 | 0.81 | 8.40E−03 | 2 | 17 |
| LYD291 | 0.71 | 3.28E−02 | 2 | 14 | LYD291 | 0.76 | 1.10E−02 | 3 | 16 |
| LYD291 | 0.76 | 1.08E−02 | 3 | 13 | LYD292 | 0.74 | 1.38E−02 | 3 | 16 |
| LYD292 | 0.73 | 1.65E−02 | 3 | 17 | LYD292 | 0.75 | 1.17E−02 | 3 | 13 |
| LYD292 | 0.92 | 2.05E−04 | 3 | 14 | LYD293 | 0.82 | 3.60E−03 | 1 | 11 |
| LYD293 | 0.77 | 8.67E−03 | 1 | 25 | LYD293 | 0.81 | 4.43E−03 | 1 | 18 |
| LYD293 | 0.86 | 2.95E−03 | 2 | 8 | LYD294 | 0.71 | 2.05E−02 | 1 | 2 |
| LYD294 | 0.84 | 2.53E−03 | 1 | 16 | LYD294 | 0.85 | 1.76E−03 | 1 | 17 |
| LYD294 | 0.84 | 2.49E−03 | 1 | 13 | LYD294 | 0.75 | 1.18E−02 | 1 | 14 |
| LYD294 | 0.70 | 2.41E−02 | 3 | 2 | LYD294 | 0.72 | 1.94E−02 | 3 | 17 |
| LYD294 | 0.81 | 4.93E−03 | 3 | 13 | LYD295 | 0.93 | 8.65E−05 | 1 | 11 |
| LYD295 | 0.89 | 5.39E−04 | 1 | 25 | LYD295 | 0.87 | 1.15E−03 | 1 | 18 |
| LYD295 | 0.73 | 1.76E−02 | 3 | 25 | LYD296 | 0.71 | 2.28E−02 | 1 | 23 |
| LYD297 | 0.73 | 1.58E−02 | 1 | 16 | LYD297 | 0.78 | 7.28E−03 | 1 | 13 |
| LYD300 | 0.73 | 2.51E−02 | 2 | 22 | LYD303 | 0.70 | 2.39E−02 | 1 | 17 |
| LYD303 | 0.72 | 1.91E−02 | 1 | 13 | LYD303 | 0.77 | 9.48E−03 | 3 | 2 |
| LYD303 | 0.76 | 1.11E−02 | 3 | 17 | LYD303 | 0.83 | 2.91E−03 | 3 | 13 |
| LYD303 | 0.73 | 1.73E−02 | 3 | 14 | LYD304 | 0.70 | 2.34E−02 | 1 | 14 |
| LYD304 | 0.72 | 1.84E−02 | 3 | 24 | LYD308 | 0.78 | 8.33E−03 | 4 | 6 |
| LYD309 | 0.72 | 1.82E−02 | 1 | 20 | LYD310 | 0.76 | 1.10E−02 | 1 | 20 |
| LYD310 | 0.73 | 1.65E−02 | 1 | 21 | LYD310 | 0.72 | 1.82E−02 | 1 | 23 |
| LYD315 | 0.88 | 8.81E−04 | 1 | 2 | LYD315 | 0.82 | 3.42E−03 | 1 | 16 |
| LYD315 | 0.84 | 2.10E−03 | 1 | 17 | LYD315 | 0.84 | 2.42E−03 | 1 | 13 |
| LYD315 | 0.79 | 6.32E−03 | 1 | 14 | LYD315 | 0.70 | 3.57E−02 | 2 | 2 |
| LYD315 | 0.70 | 3.52E−02 | 2 | 13 | LYD315 | 0.79 | 1.05E−02 | 2 | 14 |
| LYD315 | 0.78 | 7.74E−03 | 3 | 16 | LYD315 | 0.86 | 1.43E−03 | 3 | 4 |
| LYD315 | 0.75 | 1.22E−02 | 3 | 17 | LYD315 | 0.75 | 1.33E−02 | 3 | 5 |
| LYD315 | 0.91 | 2.42E−04 | 4 | 2 | LYD315 | 0.75 | 1.27E−02 | 4 | 16 |
| LYD315 | 0.78 | 7.43E−03 | 4 | 17 | LYD315 | 0.77 | 9.03E−03 | 4 | 13 |
| LYD315 | 0.81 | 4.26E−03 | 4 | 14 | LYD318 | 0.78 | 7.45E−03 | 1 | 2 |
| LYD318 | 0.86 | 1.26E−03 | 1 | 1 | LYD318 | 0.75 | 1.22E−02 | 1 | 5 |
| LYD318 | 0.86 | 1.36E−03 | 1 | 24 | LYD318 | 0.71 | 2.14E−02 | 3 | 16 |
| LYD318 | 0.74 | 1.35E−02 | 3 | 17 | LYD318 | 0.77 | 9.45E−03 | 3 | 1 |
| LYD318 | 0.76 | 1.01E−02 | 3 | 13 | LYD318 | 0.72 | 1.95E−02 | 3 | 14 |
| LYD319 | 0.74 | 1.41E−02 | 4 | 15 | LYD320 | 0.81 | 4.38E−03 | 1 | 2 |
| LYD320 | 0.76 | 1.10E−02 | 1 | 13 | LYD320 | 0.79 | 6.15E−03 | 1 | 14 |
| LYD320 | 0.72 | 2.73E−02 | 2 | 2 | LYD320 | 0.81 | 8.30E−03 | 2 | 4 |
| LYD320 | 0.79 | 1.20E−02 | 2 | 5 | LYD320 | 0.78 | 1.33E−02 | 2 | 24 |
| LYD320 | 0.78 | 8.46E−03 | 3 | 2 | LYD320 | 0.78 | 8.03E−03 | 4 | 13 |
| LYD320 | 0.90 | 3.95E−04 | 4 | 14 | LYD322 | 0.72 | 1.91E−02 | 1 | 11 |
| LYD322 | 0.74 | 1.43E−02 | 1 | 18 | LYD323 | 0.72 | 1.95E−02 | 3 | 2 |
| LYD325 | 0.86 | 1.24E−03 | 3 | 11 | LYD325 | 0.87 | 1.22E−03 | 3 | 25 |
| LYD325 | 0.94 | 6.39E−05 | 3 | 18 | LYD327 | 0.79 | 6.01E−03 | 1 | 2 |
| LYD327 | 0.83 | 2.81E−03 | 1 | 16 | LYD327 | 0.81 | 4.37E−03 | 1 | 17 |
| LYD327 | 0.92 | 1.95E−04 | 1 | 13 | LYD327 | 0.81 | 4.43E−03 | 1 | 14 |
| LYD327 | 0.83 | 5.30E−03 | 2 | 14 | LYD327 | 0.80 | 5.34E−03 | 4 | 2 |
| LYD327 | 0.84 | 2.31E−03 | 4 | 16 | LYD327 | 0.84 | 2.56E−03 | 4 | 17 |
| LYD327 | 0.92 | 1.27E−04 | 4 | 13 | LYD327 | 0.90 | 3.59E−04 | 4 | 14 |
| LYD330 | 0.75 | 2.05E−02 | 2 | 3 | LYD331 | 0.74 | 1.36E−02 | 1 | 22 |
| LYD331 | 0.81 | 4.46E−03 | 1 | 20 | LYD331 | 0.70 | 2.28E−02 | 1 | 6 |
| LYD331 | 0.81 | 4.34E−03 | 1 | 21 | LYD331 | 0.70 | 2.39E−02 | 1 | 7 |
| LYD331 | 0.77 | 9.77E−03 | 1 | 23 | LYD331 | 0.75 | 1.92E−02 | 2 | 19 |
| LYD331 | 0.78 | 1.34E−02 | 2 | 20 | LYD331 | 0.76 | 1.78E−02 | 2 | 21 |
| LYD331 | 0.71 | 3.20E−02 | 2 | 23 | LYD331 | 0.74 | 1.36E−02 | 3 | 20 |
| LYD331 | 0.74 | 1.35E−02 | 3 | 21 | LYD331 | 0.87 | 1.02E−03 | 4 | 19 |
| LYD332 | 0.86 | 1.42E−03 | 1 | 16 | LYD332 | 0.82 | 3.66E−03 | 1 | 17 |
| LYD332 | 0.90 | 3.17E−04 | 1 | 13 | LYD332 | 0.79 | 6.66E−03 | 1 | 14 |
| LYD332 | 0.81 | 4.49E−03 | 4 | 16 | LYD332 | 0.80 | 4.97E−03 | 4 | 17 |
| LYD332 | 0.79 | 6.44E−03 | 4 | 13 | LYD334 | 0.73 | 2.65E−02 | 2 | 6 |
| LYD335 | 0.71 | 2.19E−02 | 1 | 2 | LYD335 | 0.79 | 6.85E−03 | 1 | 16 |
| LYD335 | 0.78 | 8.37E−03 | 1 | 17 | LYD335 | 0.73 | 1.70E−02 | 1 | 13 |
| LYD335 | 0.72 | 1.85E−02 | 1 | 11 | LYD335 | 0.72 | 1.97E−02 | 3 | 1 |
| LYD337 | 0.76 | 1.07E−02 | 4 | 4 | LYD337 | 0.77 | 9.01E−03 | 4 | 5 |

TABLE 10-continued

Correlation between the expression level of selected genes of some embodiments of the invention in various tissues and the phenotypic performance under normal or abiotic stress conditions across *Arabidopsis* accessions

| Gene Name | R | P value | Exp. set | Corr. ID | Gene Name | R | P value | Exp. set | Corr. ID |
|---|---|---|---|---|---|---|---|---|---|
| LYD339 | 0.71 | 2.23E−02 | 3 | 10 | LYD339 | 0.78 | 8.08E−03 | 3 | 26 |
| LYD340 | 0.77 | 9.66E−03 | 3 | 18 | LYD340 | 0.85 | 1.69E−03 | 3 | 15 |
| LYD341 | 0.76 | 1.10E−02 | 3 | 20 | LYD341 | 0.78 | 7.19E−03 | 3 | 21 |
| LYD341 | 0.85 | 1.62E−03 | 3 | 23 | LYD344 | 0.80 | 5.20E−03 | 1 | 14 |
| LYD344 | 0.74 | 1.49E−02 | 3 | 14 | | | | | |

Table 10. Provided are the correlations (R) between the expression levels of yield improving genes and their homologues in tissues [Leaves or stems; Expression sets (Exp)] and the phenotypic performance in various yield, biomass, growth rate and/or vigor components [Correlation vector (corr.)] under stress conditions or normal conditions across *Arabidopsis* accessions.
P = p value.

Example 4

Production of Tomato Transcriptom and High Throughput Correlation Analysis Using 44K Tomato Oligonucleotide Micro-Array In order to produce a high throughput correlation analysis between NUE related phenotypes and gene expression, the present inventors utilized a Tomato oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 44,000 Tomato genes and transcripts. In order to define correlations between the levels of RNA expression with NUE, RBST, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of Tomato Varieties Across Ecotypes Grown Under Low Nitrogen, Drought and Regular Growth Conditions Experimental Procedures:

Tomato varieties were grown in 3 repetitive blocks, each containing 6 plants per plot were grown at net house. Briefly, the growing protocol was as follows:

1. Regular growth conditions: Tomato varieties were grown under normal conditions (4-6 Liters/m$^2$ of water per day and fertilized with NPK as recommended in protocols for commercial tomato production).

2. Low Nitrogen fertilization conditions: Tomato varieties were grown under normal conditions (4-6 Liters/m$^2$ per day and fertilized with NPK as recommended in protocols for commercial tomato production) until flower stage. At this time, Nitrogen fertilization was stopped.

3. Drought stress: Tomato variety was grown under normal conditions (4-6 Liters/m$^2$ per day) until flower stage. At this time, irrigation was reduced to 50% compared to normal conditions. Plants were phenotyped on a daily basis following the standard descriptor of tomato (Table 12). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute). Data parameters collected are summarized in Tables 13-15, herein below.

Analyzed Tomato tissues—Two tissues at different developmental stages [flower and leaf], representing different plant characteristics, were sampled and RNA was extracted as described above. For convenience, each micro-array expression information tissue type has received a Set ID as summarized in Table 11 below.

TABLE 11

Tomato transcriptom expression sets

| Expression Set | Set ID |
|---|---|
| Leaf at reproductive stage under NUE conditions | 1 + 10 |
| Flower under normal conditions | 5 + 2 |
| Leaf at reproductive stage under normal conditions | 8 + 3 |
| Flower under drought conditions | 9 + 7 |
| Leaf at reproductive stage under drought conditions | 11 + 4 |
| Flower under NUE conditions | 12 + 6 |

Table 11: Provided are the identification (ID) digits of each of the tomato expression sets.

Table 12 provides the tomato correlated parameters (Vectors). The average for each of the measured parameters was calculated using the JMP software and values are summarized in Tables 13-15 below. Subsequent correlation analysis was conducted. Results were integrated to the database (Table 16).

TABLE 12

Tomato correlated parameters (vectors)

| Correlated parameter with | Correlation ID |
|---|---|
| NUE [yield/SPAD] (Normal) | 1 |
| NUpE [biomass/SPAD] (Normal) | 2 |
| HI [yield/yield + biomass] (Normal) | 3 |
| NUE2 [total biomass/SPAD] (Normal) | 4 |
| Total Leaf Area [cm$^2$] (Normal) | 5 |
| Leaflet Length [cm] (Normal) | 6 |
| Leaflet Width (Normal) | 7 |
| 100 weight green fruit (Normal) | 8 |
| 100 weight red fruit (Normal) | 9 |
| SLA [leaf area/plant biomass] (Normal) | 10 |
| Yield/total leaf area (Normal) | 11 |
| Yield/SLA (Normal) | 12 |
| Fruit Yield/Plant (NUE) | 13 |
| FW/Plant (NUE) | 14 |
| average red fruit weight (NUE) | 15 |

TABLE 12-continued

Tomato correlated parameters (vectors)

| Correlated parameter with | Correlation ID |
|---|---|
| Fruit NUE/Normal | 16 |
| FW NUE/Normal | 17 |
| SPAD NUE | 18 |
| RWC NUE | 19 |
| SPAD 100% RWC (NUE) | 20 |
| SPAD NUE/Normal | 21 |
| SAPD 100% RWC NUE/Normal | 22 |
| RWC NUE/Normal | 23 |
| No flowers (NUE) | 24 |
| Weight clusters (flowers) (NUE) | 25 |
| Num. Flowers NUE/Normal | 26 |
| Cluster Weight NUE/Normal | 27 |
| RWC Drought | 28 |
| RWC Drought/Normal | 29 |
| Num of flowers (Drought) | 30 |
| Weight flower clusters (Drought) | 31 |
| Num of Flower Drought/Normal | 32 |
| Num of Flower Drought/NUE | 33 |
| flower cluster weight Drought/Normal | 34 |
| flower cluster weight Drought/NUE | 35 |
| Fruit Yield/Plant Drought | 36 |
| FW/Plant Drought | 37 |
| average red fruit weight Drought | 38 |
| Fruit Yield Drought/Normal | 39 |
| Fruit Drought/NUE | 40 |
| FW drought/Normal | 41 |
| red fruit weight Drought/Normal | 42 |
| Fruit yield/Plant (Normal) | 43 |
| FW/Plant (Normal) | 44 |
| average red fruit weight (Normal) | 45 |
| SPAD (Normal) | 46 |
| RWC (Normal) | 47 |
| SPAD 100% RWC (Normal) | 48 |
| No flowers (Normal) | 49 |
| Weight Flower clusters (Normal) | 50 |
| Total Leaf Area [cm$^2$]) (Drought) | 51 |
| Leaflet Length [cm] (Drought) | 52 |
| Leaflet Width [cm] (Drought) | 53 |
| 100 weight green fruit (Drought) | 54 |
| 100 weight red fruit (Drought) | 55 |
| NUE [yield/SPAD] (Low N) | 56 |
| NUpE [biomass/SPAD] (Low N) | 57 |
| HI [yield/yield + biomass] (Low N) | 58 |
| NUE2 [total biomass/SPAD] (Low N) | 59 |
| Total Leaf Area [cm$^2$] (Low N) | 60 |
| Leaflet Length [cm] (Low N) | 61 |
| Leaflet Width (Low N) | 62 |
| 100 weight green fruit (Low N) | 63 |
| SLA [leaf area/plant biomass] (Low N) | 64 |
| Yield/total leaf area (Low N) | 65 |
| Yield/SLA (Low N) | 66 |
| 100 weight red fruit (Low N) | 67 |

Table 12. Provided are the tomato correlated parameters.
"gr." = grams;
"FW" = fresh weight;
"NUE" = nitrogen use efficiency;
"RWC" = relative water content;
"NUpE" = nitrogen uptake efficiency;
"SPAD" = chlorophyll levels;
"HI" = harvest index (vegetative weight divided on yield);
"SLA" = specific leaf area (leaf area divided by leaf dry weight), Treatment in the parenthesis.

Fruit Weight (grams)—At the end of the experiment [when 50% of the fruits were ripe (red)] all fruits from plots within blocks A-C were collected. The total fruits were counted and weighted. The average fruits weight was calculated by dividing the total fruit weight by the number of fruits.

Plant vegetative Weight (grams)—At the end of the experiment [when 50% of the fruit were ripe (red)] all plants from plots within blocks A-C were collected. Fresh weight was measured (grams).

Inflorescence Weight (grams)—At the end of the experiment [when 50% of the fruits were ripe (red)] two Inflorescence from plots within blocks A-C were collected. The Inflorescence weight (gr.) and number of flowers per inflorescence were counted.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I [(FW−DW/TW−DW)×100] as described above.

Plants that maintain high relative water content (RWC) compared to control lines were considered more tolerant to drought than those exhibiting reduced relative water content.

Experimental Results

TABLE 13

Measured parameters in Tomato accessions (lines 1-6)

| Ecotype/ Correlation ID No. | Line-1 | Line-2 | Line-3 | Line-4 | Line-5 | Line-6 |
|---|---|---|---|---|---|---|
| 1 | 0.02 | 0.01 | 0.01 | 0.00 | 0.01 | 0.01 |
| 2 | 0.03 | 0.09 | 0.05 | 0.02 | 0.05 | 0.05 |
| 3 | 0.35 | 0.10 | 0.14 | 0.12 | 0.18 | 0.19 |
| 4 | 0.05 | 0.09 | 0.06 | 0.02 | 0.06 | 0.06 |
| 5 | | | 426.10 | 582.38 | 291.40 | 593.58 |
| 6 | | | 6.34 | 7.99 | 5.59 | 7.70 |
| 7 | | | 3.69 | 4.77 | 3.43 | 4.56 |
| 8 | | | 0.56 | 3.05 | 0.24 | 2.58 |
| 9 | | | 0.82 | 2.46 | 0.50 | 2.76 |
| 10 | | | 140.99 | 689.67 | 130.22 | 299.12 |
| 11 | | | 0.00 | 0.00 | 0.00 | 0.00 |
| 12 | | | 0.00 | 0.00 | 0.00 | 0.00 |
| 13 | 0.41 | 0.66 | 0.48 | 0.46 | 1.35 | 0.35 |
| 14 | 4.04 | 1.21 | 2.25 | 2.54 | 1.85 | 3.06 |
| 15 | 0.02 | 0.19 | 0.01 | 0.01 | 0.10 | 0.00 |
| 16 | 0.49 | 1.93 | 0.97 | 3.80 | 2.78 | 0.78 |
| 17 | 2.65 | 0.38 | 0.74 | 3.01 | 0.83 | 1.54 |
| 18 | 38.40 | 39.40 | 47.50 | 37.00 | 44.60 | 41.70 |
| 19 | 74.07 | 99.08 | 69.49 | 63.24 | 77.36 | 77.91 |
| 20 | 28.47 | 39.04 | 33.01 | 23.42 | 34.53 | 32.51 |
| 21 | 0.77 | 1.06 | 0.85 | 0.80 | 0.93 | 0.96 |
| 22 | 0.79 | 1.37 | 0.92 | 0.75 | 1.31 | 0.97 |
| 23 | 1.02 | 1.30 | 1.08 | 0.94 | 1.41 | 1.00 |
| 24 | 19.00 | 5.33 | 9.00 | 13.00 | 10.67 | 16.67 |
| 25 | 0.53 | 0.37 | 0.31 | 0.35 | 0.47 | 0.25 |
| 26 | 3.35 | 0.28 | 1.42 | 1.70 | 1.10 | 2.00 |
| 27 | 0.46 | 1.07 | 0.44 | 0.01 | 1.08 | 0.02 |
| 28 | 72.12 | 74.51 | 65.33 | 72.22 | 66.13 | 68.33 |
| 29 | 0.99 | 0.97 | 1.02 | 1.08 | 1.21 | 0.88 |
| 30 | 16.67 | 6.50 | 15.67 | 20.33 | 11.67 | 25.33 |
| 31 | 0.37 | 0.41 | 0.33 | 0.29 | 0.55 | 0.31 |
| 32 | 2.94 | 0.34 | 2.47 | 2.65 | 1.21 | 3.04 |
| 33 | 0.88 | 1.22 | 1.74 | 1.56 | 1.09 | 1.52 |
| 34 | 0.32 | 1.19 | 0.47 | 0.01 | 1.25 | 0.03 |
| 35 | 0.69 | 1.11 | 1.06 | 0.82 | 1.16 | 1.25 |
| 36 | 0.47 | 0.48 | 0.63 | 0.35 | 2.04 | 0.25 |
| 37 | 2.62 | 1.09 | 1.85 | 2.22 | 2.63 | 2.71 |
| 38 | 0.01 | 0.19 | 0.21 | 0.00 | 0.10 | 0.00 |
| 39 | 0.57 | 1.41 | 1.27 | 2.88 | 4.20 | 0.55 |
| 40 | 1.15 | 0.73 | 1.32 | 0.76 | 1.51 | 0.71 |
| 41 | 1.72 | 0.34 | 0.61 | 2.63 | 1.18 | 1.36 |

TABLE 13-continued

Measured parameters in Tomato accessions (lines 1-6)

| Ecotype/ Correlation ID No. | Line-1 | Line-2 | Line-3 | Line-4 | Line-5 | Line-6 |
|---|---|---|---|---|---|---|
| 42 | 0.19 | 24.37 | 25.38 | 0.02 | 20.26 | 0.04 |
| 43 | 0.83 | 0.34 | 0.49 | 0.12 | 0.49 | 0.45 |
| 44 | 1.53 | 3.17 | 3.02 | 0.84 | 2.24 | 1.98 |
| 45 | 0.05 | 0.01 | 0.01 | 0.29 | 0.01 | 0.05 |
| 46 | 49.70 | 37.20 | 55.80 | 46.40 | 48.20 | 43.40 |
| 47 | 72.83 | 76.47 | 64.29 | 67.07 | 54.79 | 77.61 |
| 48 | 36.17 | 28.45 | 35.89 | 31.09 | 26.38 | 33.68 |
| 49 | 5.67 | 19.33 | 6.33 | 7.67 | 9.67 | 8.33 |
| 50 | 1.17 | 0.34 | 0.69 | 56.35 | 0.44 | 11.31 |
| 56 | 0.01 | 0.02 | 0.01 | 0.02 | 0.04 | 0.01 |
| 57 | 0.14 | 0.03 | 0.07 | 0.11 | 0.05 | 0.09 |
| 58 | 0.09 | 0.35 | 0.18 | 0.15 | 0.42 | 0.10 |
| 59 | 0.16 | 0.05 | 0.08 | 0.13 | 0.09 | 0.11 |
| 60 | 565.93 | 384.77 | 294.83 | 378.00 | 476.39 | 197.08 |
| 61 | 6.40 | 5.92 | 3.69 | 5.43 | 6.95 | 3.73 |
| 62 | 3.47 | 1.97 | 1.79 | 2.55 | 3.52 | 1.73 |
| 63 | 0.87 | 3.66 | 0.57 | 0.37 | 3.40 | 0.68 |
| 64 | 140.04 | 317.12 | 131.29 | 148.82 | 257.51 | 64.34 |
| 65 | 0.00 | 0.00 | 0.00 | 0.00 | 0.00 | 0.00 |
| 66 | 0.00 | 0.00 | 0.00 | 0.00 | 0.01 | 0.01 |
| 67 | 1.06 | 6.87 | 0.65 | 0.53 | 7.17 | 0.44 |

Table 13. Provided are the values of each of the parameters (as described above in Table 12) measured in tomato accessions (Line number) under all growth conditions. Growth conditions are specified in the experimental procedure section.

TABLE 14

Measured parameters in Tomato accessions (lines 7-12)

| Ecotype/ Correlation ID No. | Line-7 | Line-8 | Line-9 | Line-10 | Line-11 | Line-12 |
|---|---|---|---|---|---|---|
| 1 | 0.01 | 0.01 | 0.00 | 0.01 | 0.02 | 0.00 |
| 2 | 0.02 | 0.04 | 0.05 | 0.05 | 0.05 | 0.08 |
| 3 | 0.38 | 0.17 | 0.06 | 0.10 | 0.27 | 0.05 |
| 4 | 0.03 | 0.05 | 0.06 | 0.06 | 0.06 | 0.08 |
| 5 | 947.59 | 233.35 | 340.73 | 339.11 | 190.14 | 421.79 |
| 6 | 7.85 | 6.22 | 6.16 | 5.65 | 4.39 | 4.44 |
| 7 | 4.44 | 3.15 | 3.37 | 3.13 | 2.40 | 2.02 |
| 8 | 6.32 | 5.75 | 0.38 | 0.30 | 1.95 | 2.53 |
| 9 | 5.32 | 5.24 | 0.61 | 0.66 | 2.70 | 0.70 |
| 10 | 1117.74 | 111.77 | 106.29 | 123.14 | 104.99 | 111.88 |
| 11 | 0.00 | 0.00 | 0.00 | 0.00 | 0.00 | 0.00 |
| 12 | 0.00 | 0.00 | 0.00 | 0.00 | 0.01 | 0.00 |
| 13 | 0.01 | 0.51 | 0.44 | 0.47 | 1.59 | 0.39 |
| 14 | 3.13 | 2.54 | 1.84 | 1.52 | 1.91 | 1.86 |
| 15 | 0.01 | 0.01 | 0.01 | 0.01 | 0.02 | 0.01 |
| 16 | 0.02 | 1.16 | 2.07 | 1.51 | 2.41 | 2.06 |
| 17 | 3.70 | 1.22 | 0.58 | 0.55 | 1.06 | 0.49 |
| 18 | 34.40 | 50.00 | 44.70 | 53.70 | 35.70 | 58.80 |
| 19 | 80.49 | 67.40 | 67.16 | 66.07 | 69.57 | 69.30 |
| 20 | 27.66 | 33.68 | 30.04 | 35.50 | 24.81 | 40.77 |
| 21 | 0.80 | 0.94 | 0.76 | 1.05 | 0.89 | 1.24 |
| 22 | 1.11 | 0.95 | 0.79 | 0.92 | 0.94 | 1.36 |
| 23 | 1.38 | 1.01 | 1.04 | 0.88 | 1.05 | 1.10 |
| 24 | 6.00 | 16.00 | 15.00 | 6.00 | 17.00 | 13.00 |
| 25 | 0.29 | 0.47 | 0.40 | 0.30 | 0.82 | 0.40 |
| 26 | 1.20 | 1.92 | 1.50 | 0.86 | 1.89 | 1.63 |
| 27 | 0.37 | 0.81 | 0.55 | 0.36 | 0.95 | 0.80 |
| 28 | 78.13 | 18.46 | 73.21 | 62.50 | 67.21 | 75.76 |
| 29 | 1.34 | 0.28 | 1.13 | 0.83 | 1.01 | 1.20 |
| 30 | 29.73 | 17.33 | 14.67 | 29.67 | 15.00 | 10.33 |
| 31 | 0.45 | 0.56 | 0.30 | 0.31 | 0.31 | 0.31 |
| 32 | 5.95 | 2.08 | 1.47 | 4.24 | 1.67 | 1.29 |
| 33 | 4.96 | 1.08 | 0.98 | 4.94 | 0.88 | 0.79 |
| 34 | 0.56 | 0.96 | 0.42 | 0.38 | 0.36 | 0.62 |
| 35 | 1.52 | 1.19 | 0.76 | 1.04 | 0.38 | 0.78 |
| 36 | 0.05 | 0.45 | 0.29 | 1.02 | 0.60 | 0.49 |
| 37 | 3.41 | 2.11 | 1.95 | 1.76 | 1.72 | 1.92 |
| 38 | 0.03 | 0.01 | 0.01 | 0.00 | 0.01 | 0.01 |
| 39 | 0.09 | 1.03 | 1.39 | 3.28 | 0.91 | 2.62 |

TABLE 14-continued

Measured parameters in Tomato accessions (lines 7-12)

| Ecotype/ Correlation ID No. | Line-7 | Line-8 | Line-9 | Line-10 | Line-11 | Line-12 |
|---|---|---|---|---|---|---|
| 40 | 5.06 | 0.89 | 0.67 | 2.17 | 0.38 | 1.27 |
| 41 | 4.02 | 1.01 | 0.61 | 0.64 | 0.95 | 0.51 |
| 42 | 0.15 | 0.02 | 0.86 | 0.74 | 0.09 | 1.72 |
| 43 | 0.53 | 0.44 | 0.21 | 0.31 | 0.66 | 0.19 |
| 44 | 0.85 | 2.09 | 3.21 | 2.75 | 1.81 | 3.77 |
| 45 | 0.23 | 0.29 | 0.01 | 0.01 | 0.06 | 0.01 |
| 46 | 42.90 | 53.30 | 58.50 | 51.10 | 40.00 | 47.60 |
| 47 | 58.18 | 66.51 | 64.71 | 75.25 | 66.23 | 63.21 |
| 48 | 24.98 | 35.47 | 37.87 | 38.43 | 26.49 | 30.07 |
| 49 | 5.00 | 8.33 | 10.00 | 7.00 | 9.00 | 8.00 |
| 50 | 0.79 | 0.58 | 0.73 | 0.83 | 0.86 | 0.50 |
| 51 |  |  |  |  |  | 337.63 |
| 52 |  |  |  |  |  | 5.15 |
| 53 |  |  |  |  |  | 2.55 |
| 54 |  |  |  |  |  | 0.80 |
| 55 |  |  |  |  |  | 0.89 |
| 56 | 0.00 | 0.02 | 0.01 | 0.01 | 0.06 | 0.01 |
| 57 | 0.11 | 0.08 | 0.06 | 0.04 | 0.08 | 0.05 |
| 58 | 0.00 | 0.17 | 0.19 | 0.24 | 0.45 | 0.17 |
| 59 | 0.11 | 0.09 | 0.08 | 0.06 | 0.14 | 0.06 |
| 60 | 453.24 | 625.51 | 748.01 | 453.96 | 164.85 | 338.30 |
| 61 | 4.39 | 6.72 | 6.66 | 4.39 | 3.90 | 5.29 |
| 62 | 1.87 | 3.54 | 3.28 | 2.52 | 2.61 | 2.61 |
| 63 | 0.45 | 0.47 | 0.54 | 0.19 | 0.97 | 0.91 |
| 64 | 144.60 | 246.05 | 405.55 | 299.32 | 86.19 | 182.32 |
| 65 | 0.00 | 0.00 | 0.00 | 0.00 | 0.01 | 0.00 |
| 66 | 0.00 | 0.00 | 0.00 | 0.00 | 0.02 | 0.00 |
| 67 |  | 0.55 | 0.75 | 0.58 | 1.27 | 1.34 |

Table 14. Provided are the values of each of the parameters (as described above in Table 12) measured in tomato accessions (Line number) under all growth conditions. Growth conditions are specified in the experimental procedure section.

TABLE 15

Measured parameters in Tomato accessions (lines 13-18)

| Ecotype/ Correlation ID No. | Line-13 | Line-14 | Line-15 | Line-16 | Line-17 | Line-18 |
|---|---|---|---|---|---|---|
| 1 | 0.01 | 0.01 | 0.01 | 0.01 | 0.01 | 0.00 |
| 2 | 0.03 | 0.04 | 0.05 | 0.03 | 0.07 | 0.04 |
| 3 | 0.31 | 0.12 | 0.14 | 0.17 | 0.09 | 0.11 |
| 4 | 0.05 | 0.05 | 0.06 | 0.04 | 0.08 | 0.04 |
| 5 | 581.33 | 807.51 | 784.06 | 351.80 | 255.78 | 1078.10 |
| 6 | 6.77 | 7.42 | 6.71 | 5.87 | 4.16 | 10.29 |
| 7 | 3.80 | 3.74 | 2.98 | 3.22 | 2.09 | 5.91 |
| 8 | 1.42 | 2.03 | 1.39 | 2.27 | 0.45 | 0.42 |
| 9 | 2.64 | 4.67 | 2.17 | 0.49 | 0.34 | 0.75 |
| 10 | 307.95 | 419.37 | 365.81 | 212.93 | 84.94 | 469.87 |
| 11 | 0.00 | 0.00 | 0.00 | 0.00 | 0.00 | 0.00 |
| 12 | 0.00 | 0.00 | 0.00 | 0.00 | 0.00 | 0.00 |
| 13 | 0.32 | 0.45 | 0.14 | 0.40 | 1.44 | 0.50 |
| 14 | 2.47 | 2.62 | 1.08 | 1.17 | 0.92 | 1.09 |
| 15 | 0.01 | 0.01 | 0.36 | 0.04 | 0.63 |  |
| 16 | 0.38 | 1.64 | 0.41 | 1.21 | 4.59 | 1.70 |
| 17 | 1.31 | 1.36 | 0.51 | 0.71 | 0.31 | 0.47 |
| 18 | 47.50 | 45.20 | 39.00 | 45.00 | 65.30 | 51.90 |
| 19 | 100.00 | 57.66 | 90.79 | 68.00 | 59.65 | 72.17 |
| 20 | 47.47 | 26.06 | 35.38 | 30.60 | 38.97 | 37.46 |
| 21 | 0.82 | 0.94 | 0.89 | 0.83 | 1.57 | 0.88 |
| 22 | 1.44 | 1.50 | 1.05 | 0.56 | 1.48 | 0.84 |
| 23 | 1.76 | 1.60 | 1.17 | 0.68 | 0.94 | 0.96 |
| 24 | 8.67 | 9.33 | 12.67 | 6.67 | 9.33 | 8.00 |
| 25 | 0.35 | 0.43 | 0.35 | 0.45 | 0.28 | 0.47 |
| 26 | 1.63 | 1.17 | 1.65 | 0.74 | 0.88 | 0.89 |
| 27 | 0.34 | 0.61 | 0.94 | 0.68 | 0.40 | 1.44 |
| 28 | 62.82 | 70.69 | 55.75 | 75.22 | 63.68 | 62.31 |
| 29 | 1.11 | 1.97 | 0.72 | 0.75 | 1.01 | 0.83 |
| 30 | 18.33 | 12.00 | 20.33 | 12.67 | 12.67 | 11.33 |
| 31 | 8.36 | 0.29 | 0.34 | 0.44 | 0.27 | 0.43 |
| 32 | 3.44 | 1.50 | 2.65 | 1.41 | 1.19 | 1.26 |

TABLE 15-continued

Measured parameters in Tomato accessions (lines 13-18)

| Ecotype/Correlation ID No. | Line-13 | Line-14 | Line-15 | Line-16 | Line-17 | Line-18 |
|---|---|---|---|---|---|---|
| 33 | 2.12 | 1.29 | 1.61 | 1.90 | 1.36 | 1.42 |
| 34 | 8.20 | 0.41 | 0.91 | 0.67 | 0.38 | 1.31 |
| 35 | 24.12 | 0.67 | 0.97 | 0.99 | 0.95 | 0.91 |
| 36 | 0.27 | 0.68 | 0.14 | 0.53 | 0.55 | 0.41 |
| 37 | 2.21 | 3.73 | 0.75 | 1.76 | 0.63 | 1.11 |
| 38 | 0.00 | 0.01 | 0.30 | 0.14 | 0.04 | 0.09 |
| 39 | 0.32 | 2.48 | 0.41 | 1.62 | 1.76 | 1.42 |
| 40 | 0.84 | 1.51 | 0.98 | 1.34 | 0.38 | 0.84 |
| 41 | 1.17 | 1.94 | 0.35 | 1.06 | 0.21 | 0.48 |
| 42 | 0.17 | 0.02 | 10.50 | 27.89 | 11.79 | 9.98 |
| 43 | 0.85 | 0.27 | 0.35 | 0.33 | 0.31 | 0.29 |
| 44 | 1.89 | 1.93 | 2.14 | 1.65 | 3.01 | 2.29 |
| 45 | 0.03 | 0.26 | 0.03 | 0.00 | 0.00 | 0.01 |
| 46 | 57.90 | 48.30 | 43.60 | 54.50 | 41.60 | 59.10 |
| 47 | 56.77 | 35.96 | 77.62 | 100.00 | 63.16 | 75.13 |
| 48 | 32.89 | 17.35 | 33.82 | 54.47 | 26.25 | 44.43 |
| 49 | 5.33 | 8.00 | 7.67 | 9.00 | 10.67 | 9.00 |
| 50 | 1.02 | 0.70 | 0.38 | 0.66 | 0.70 | 0.33 |
| 51 | 130.78 | 557.93 | 176.67 | 791.86 | 517.05 | 832.27 |
| 52 | 3.38 | 7.14 | 5.48 | 8.62 | 6.35 | 6.77 |
| 53 | 2.04 | 4.17 | 3.09 | 4.69 | 3.87 | 2.91 |
| 54 | 0.28 | 0.38 | 0.63 | 2.86 | 1.16 | 4.40 |
| 55 | 0.35 | 0.63 | 2.27 | 7.40 | 2.94 | 11.60 |
| 56 | 0.01 | 0.02 | 0.00 | 0.01 | 0.04 | 0.01 |
| 57 | 0.05 | 0.10 | 0.03 | 0.04 | 0.02 | 0.03 |
| 58 | 0.12 | 0.15 | 0.12 | 0.25 | 0.61 | 0.31 |
| 59 | 0.06 | 0.12 | 0.03 | 0.05 | 0.06 | 0.04 |
| 60 | 396.00 | 236.15 | 174.58 | 441.78 | 489.18 | 707.80 |
| 61 | 6.32 | 5.11 | 4.72 | 6.83 | 7.10 | 8.21 |
| 62 | 3.58 | 2.56 | 2.48 | 3.43 | 3.30 | 3.69 |
| 63 | 0.36 | 0.35 | 0.57 | 4.38 | 2.02 | 8.13 |
| 64 | 160.18 | 90.10 | 160.99 | 379.03 | 531.08 | 650.68 |
| 65 | 0.00 | 0.00 | 0.00 | 0.00 | 0.00 | 0.00 |
| 66 | 0.00 | 0.00 | 0.00 | 0.00 | 0.00 | 0.00 |
| 67 | 0.52 | 0.57 | 0.94 | 6.17 | 3.67 | 11.33 |

Table 15: Provided are the values of each of the parameters (as described above in Table 12) measured in tomato accessions (Line number) under all growth conditions. Growth conditions are specified in the experimental procedure section.

TABLE 16

Correlation between the expression level of selected genes of some embodiments of the invention in various tissues and the phenotypic performance under normal and stress conditions across tomato ecotypes

| Gene Name | R | P value | Exp. set | Corr. ID | Gene Name | R | P value | Exp. set | Corr. ID |
|---|---|---|---|---|---|---|---|---|---|
| LYD475 | 0.71 | 2.04E−02 | 1 | 20 | LYD475 | 0.79 | 6.15E−03 | 1 | 22 |
| LYD475 | 0.77 | 2.51E−02 | 2 | 12 | LYD475 | 0.75 | 3.15E−02 | 2 | 11 |
| LYD475 | 0.73 | 1.61E−02 | 12 | 19 | LYD477 | 0.87 | 9.33E−04 | 1 | 20 |
| LYD477 | 0.88 | 3.84E−03 | 2 | 12 | LYD477 | 0.84 | 9.63E−03 | 2 | 11 |
| LYD477 | 0.81 | 4.38E−03 | 11 | 35 | LYD477 | 0.80 | 5.67E−03 | 11 | 34 |
| LYD477 | 0.81 | 4.78E−03 | 11 | 31 | LYD478 | 0.73 | 1.69E−02 | 1 | 20 |
| LYD478 | 0.83 | 5.37E−03 | 2 | 3 | LYD478 | 0.85 | 4.01E−03 | 2 | 1 |
| LYD478 | 0.76 | 2.79E−02 | 2 | 9 | LYD478 | 0.88 | 1.78E−03 | 3 | 1 |
| LYD478 | 0.86 | 1.59E−03 | 9 | 35 | LYD478 | 0.83 | 2.72E−03 | 9 | 34 |
| LYD478 | 0.85 | 1.69E−03 | 9 | 31 | LYD478 | 0.88 | 8.98E−04 | 12 | 20 |
| LYD478 | 0.73 | 1.76E−02 | 12 | 23 | LYD478 | 0.82 | 3.55E−03 | 12 | 19 |
| LYD479 | 0.80 | 1.76E−02 | 2 | 11 | LYD479 | 0.73 | 1.63E−02 | 6 | 59 |
| LYD479 | 0.75 | 1.17E−02 | 6 | 57 | LYD479 | 0.77 | 9.70E−03 | 9 | 33 |
| LYD479 | 0.75 | 1.24E−02 | 9 | 30 | LYD479 | 0.74 | 1.37E−02 | 12 | 14 |
| LYD479 | 0.83 | 3.23E−03 | 12 | 17 | LYD479 | 0.77 | 8.56E−03 | 12 | 26 |
| LYD479 | 0.71 | 2.25E−02 | 11 | 33 | LYD479 | 0.76 | 1.10E−02 | 11 | 40 |
| LYD480 | 0.92 | 4.80E−04 | 3 | 3 | LYD480 | 0.81 | 8.33E−03 | 3 | 1 |
| LYD480 | 0.74 | 1.36E−02 | 8 | 46 | LYD481 | 0.89 | 1.16E−03 | 2 | 3 |
| LYD481 | 0.94 | 1.51E−04 | 2 | 1 | LYD481 | 0.82 | 1.18E−02 | 2 | 9 |
| LYD481 | 0.78 | 1.41E−02 | 3 | 4 | LYD482 | 0.73 | 4.01E−02 | 2 | 12 |
| LYD482 | 0.81 | 1.41E−02 | 2 | 11 | LYD482 | 0.76 | 1.13E−02 | 5 | 46 |
| LYD482 | 0.72 | 1.87E−02 | 11 | 35 | LYD482 | 0.82 | 3.41E−03 | 11 | 34 |
| LYD482 | 0.74 | 1.47E−02 | 11 | 31 | LYD483 | 0.77 | 2.42E−02 | 2 | 12 |
| LYD483 | 0.74 | 3.73E−02 | 2 | 11 | LYD483 | 0.75 | 1.95E−02 | 3 | 3 |
| LYD483 | 0.83 | 2.98E−03 | 8 | 46 | LYD484 | 0.73 | 1.63E−02 | 1 | 22 |
| LYD484 | 0.75 | 1.95E−02 | 2 | 3 | LYD484 | 0.81 | 8.10E−03 | 2 | 1 |
| LYD487 | 0.78 | 2.17E−02 | 2 | 12 | LYD487 | 0.74 | 2.39E−02 | 2 | 3 |
| LYD487 | 0.75 | 1.99E−02 | 2 | 1 | LYD487 | 0.84 | 9.32E−03 | 2 | 11 |
| LYD489 | 0.72 | 2.72E−02 | 3 | 3 | LYD489 | 0.90 | 2.63E−03 | 2 | 12 |
| LYD489 | 0.81 | 1.44E−02 | 2 | 11 | LYD489 | 0.81 | 4.72E−03 | 11 | 42 |
| LYD489 | 0.83 | 3.14E−03 | 11 | 38 | LYD491 | 0.70 | 5.16E−02 | 2 | 12 |
| LYD491 | 0.74 | 3.46E−02 | 2 | 11 | LYD491 | 0.74 | 2.24E−02 | 3 | 3 |
| LYD491 | 0.77 | 1.55E−02 | 3 | 1 | LYD491 | 0.75 | 1.26E−02 | 9 | 35 |
| LYD491 | 0.78 | 7.60E−03 | 9 | 34 | LYD491 | 0.75 | 1.31E−02 | 9 | 31 |
| LYD491 | 0.72 | 1.85E−02 | 11 | 34 | LYD491 | 0.71 | 2.25E−02 | 11 | 31 |
| LYD492 | 0.83 | 3.20E−03 | 1 | 20 | LYD492 | 0.73 | 1.67E−02 | 1 | 23 |
| LYD492 | 0.71 | 2.06E−02 | 1 | 22 | LYD492 | 0.76 | 1.07E−02 | 1 | 19 |
| LYD492 | 0.83 | 5.13E−03 | 3 | 3 | LYD492 | 0.80 | 1.04E−02 | 3 | 1 |

Table 16. Provided are the correlations (R) between the expression levels yield improving genes and their homologs in various tissues [Expression (Exp) sets] and the phenotypic performance [yield, biomass, growth rate and/or vigor components (Correlation vector (Corr.) ID)] under normal conditions across tomato ecotypes. P = p value.

Example 5

Production of B. juncea Transcriptom and High Throughput Correlation Analysis with Yield Parametrers Using 60K B. juncea Oligonucleotide Micro-Arrays In order to produce a high throughput correlation analysis, the present inventors utilized a *B. juncea* oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 60,000 *B. juncea* genes and transcripts. In order to define correlations between the levels of RNA expression with yield components or vigor related parameters, various plant characteristics of 11 different *B. juncea* varieties were analyzed and used for RNA expression analysis. The correlation between the RNA levels and the characterized parameters was analyzed using Pearson correlation test.

Correlation of *B. juncea* Genes' Expression Levels with Phenotypic Characteristics Across Ecotype Experimental Procedures 11 *B. juncea* varieties were grown in three repetitive plots, in field. Briefly, the growing protocol was as follows: *B. juncea* seeds were sown in soil and grown under normal condition till harvest. In order to define correlations between the levels of RNA expression with yield components or vigor related parameters, the 11 different *B. juncea* varieties were analyzed and used for gene expression analyses.

TABLE 17

Tissues used for *B. juncea* transcriptom expression sets

| Expression Set | Set ID |
|---|---|
| Meristem at vegetative stage under normal growth conditions | 1 |
| Flower at flowering stage under normal growth conditions | 2 |
| Leaf at vegetative stage under normal growth conditions | 3 |
| Pod (R1-R3) under normal growth conditions | 4 |
| Pod (R4-R5) under normal growth conditions | 5 |

Table 17: Provided are the identification (ID) digits of each of the *B. juncea* expression sets.

RNA extraction—All 11 selected *B. juncea* varieties were sample per each treatment. Plant tissues [leaf, Pod, Lateral meristem and flower] growing under normal conditions were sampled and RNA was extracted as described above.

The collected data parameters were as follows:

Fresh weight (plot-harvest) [gr/plant]—total fresh weight per plot at harvest time normalized to the number of plants per plot.

Seed Weight [milligrams/plant]—total seeds from each plot was extracted, weighted and normalized for plant number in each plot.

Harvest index—The harvest index was calculated: seed weight/fresh weight Days till bolting/flowering—number of days till 50% bolting/flowering for each plot.

SPAD—Chlorophyll content was determined using a Minolta SPAD 502 chlorophyll meter and measurement was performed at time of flowering. SPAD meter readings were done on young fully developed leaf. Three measurements per leaf were taken for each plot.

Main branch—average node length—total length/total number of nods on main branch.

Lateral branch—average node length—total length/total number of nods on lateral branch.

Main branch—20th length—the length of the pod on the $20^{th}$ node from the apex of main branch.

Lateral branch—20th length—the length of the pod on the $20^{th}$ node from the apex of lateral branch.

Main branch—20th seed No.—number of seeds in the pod on the $20^{th}$ node from the apex of main branch.

Lateral branch—20th seed number—number of seeds in the pod on the $20^{th}$ node from the apex of lateral branch.

Number of lateral branches—total number of lateral branches, average of three plants per plot.

Main branch height [cm]—total length of main branch.

Min-lateral branch position—lowest node on the main branch that has developed lateral branch.

Max-lateral branch position [#node of main branch]—highest node on the main branch that has developed lateral branch.

Max-number of nodes in lateral branch—the highest number of node that a lateral branch had per plant.

Max length of lateral branch [cm]—the highest length of lateral branch per plant.

Max diameter of lateral branch [mm]—the highest base diameter that a lateral branch had per plant.

Oil Content—Indirect oil content analysis was carried out using Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)];

Fresh weight (single plant) (gr/plant)—average fresh weight of three plants per plot taken at the middle of the season.

Main branch base diameter [mm]—the based diameter of main branch, average of three plants per plot.

1000 Seeds [gr]—weight of 1000 seeds per plot.

Experimental Results

Eleven different *B. juncea* varieties (i.e., Lines 1-11) were grown and characterized for 23 parameters as specified in Table 18, below. The average for each of the measured parameters was calculated using the JMP software and values are summarized in Tables 19-20 below. Subsequent correlation analysis between the various transcriptom expression sets and the average parameters was conducted (Table 21). Results were then integrated to the database.

TABLE 18

Measured parameters in *B. juncea* accessions

| Correlated parameter with | Correlation ID |
|---|---|
| Days till bolting (days) | 1 |
| Fresh weight (plot-harvest) [gr./plant] | 2 |
| Seed weight per plant (gr.) | 3 |
| Harvest index (ratio) | 4 |
| Days till flowering (days) | 5 |
| SPAD | 6 |
| Main branch - average node length (cm) | 7 |
| Lateral branch - average node length (cm) | 8 |
| Main branch - 20th length (cm) | 9 |
| Lateral branch - 20th length (cm) | 10 |
| Main branch - 20th seed number (number) | 11 |
| Lateral branch - 20th seed number (number) | 12 |
| Number of lateral branches (number) | 13 |
| Main branch height [cm] | 14 |
| Min-Lateral branch position ([No. of node of main branch) | 15 |
| Max-Lateral branch position [No. of node of main branch] | 16 |
| Max-Number of nodes in lateral branch (number) | 17 |
| Max-Length of lateral branch [cm] | 18 |

TABLE 18-continued

Measured parameters in B. juncea accessions

| Correlated parameter with | Correlation ID |
|---|---|
| Max-Diameter of lateral branch [mm] | 19 |
| Oil content (mg) | 20 |
| Fresh weight (single plant) [gr./plant] | 21 |
| Main branch base diameter [mm] | 22 |
| 1000 Seeds [gr.] | 23 |

Table 18. Provided are the B. juncea correlated parameters.
"gr." = grams;
mm = millimeters;
"cm" = centimeters;
"mg" = milligrams;
"SPAD" = chlorophyll levels;

TABLE 19

Measured parameters in B. juncea accessions (lines 1-6)

| Ecotype/Correlation ID No. | Line-1 | Line-2 | Line-3 | Line-4 | Line-5 | Line-6 |
|---|---|---|---|---|---|---|
| 1 | 57.33 | 60.33 | 59.67 | 56.33 | 55.00 | 46.67 |
| 2 | 69.24 | 45.22 | 39.27 | 49.11 | 43.95 | 46.42 |
| 3 | 0.00 | 0.01 | 0.01 | 0.01 | 0.01 | 0.01 |
| 4 | 0.00 | 0.00 | 0.00 | 0.00 | 0.00 | 0.00 |
| 5 | 66.00 | 69.67 | 69.33 | 66.00 | 61.33 | 53.00 |
| 6 | 33.02 | 30.01 | 32.83 | 37.53 | 41.44 | 35.41 |
| 7 | 0.48 | 0.41 | 0.63 | 0.43 | 0.38 | 0.68 |
| 8 | 0.65 | 0.43 | 0.74 | 0.57 | 0.56 | 0.79 |
| 9 | 4.28 | 3.72 | 3.62 | 3.50 | 2.74 | 5.20 |
| 10 | 4.32 | 3.69 | 4.14 | 3.37 | 3.06 | 3.96 |
| 11 | 13.22 | 13.67 | 10.44 | 14.11 | 9.78 | 15.22 |
| 12 | 13.00 | 14.00 | 13.22 | 13.44 | 11.00 | 13.11 |
| 13 | 15.22 | 14.89 | 13.56 | 14.89 | 14.00 | 9.78 |
| 14 | 140.72 | 125.22 | 112.44 | 133.39 | 142.00 | 101.50 |
| 15 | 6.78 | 6.33 | 5.56 | 3.67 | 3.00 | 3.11 |
| 16 | 15.22 | 14.89 | 13.56 | 14.89 | 14.00 | 10.89 |
| 17 | 5.22 | 7.00 | 5.22 | 7.00 | 6.56 | 9.44 |
| 18 | 40.44 | 47.22 | 41.61 | 60.50 | 59.78 | 59.44 |
| 19 | 4.20 | 4.85 | 4.34 | 5.74 | 5.87 | 5.68 |
| 20 | 40.19 | 40.71 | 40.91 | 38.57 | 40.14 | 42.63 |
| 21 | 197.78 | 142.22 | 147.22 | 243.33 | 192.33 | 163.78 |
| 22 | 14.53 | 11.99 | 19.91 | 14.32 | 12.59 | 12.30 |
| 23 | 3.76 | 2.21 | 3.26 | 2.36 | 2.00 | 3.12 |

Table 19: Provided are the values of each of the parameters (as described above) measured in B. juncea accessions (line numbers) under normal conditions.

TABLE 20

Measured parameters in B. juncea accessions (lines 7-11)

| Ecotype/Correlation ID No. | Line-7 | Line-8 | Line-9 | Line-10 | Line-11 |
|---|---|---|---|---|---|
| 1 | 59.00 | 54.33 | 59.67 | 57.33 | 53.00 |
| 2 | 36.14 | 32.58 | 33.16 | 63.23 | 60.94 |
| 3 | 0.00 | 0.00 | 0.00 | 0.01 | 0.01 |
| 4 | 0.00 | 0.00 | 0.00 | 0.00 | 0.00 |
| 5 | 69.67 | 63.67 | 69.67 | 71.00 | 58.33 |
| 6 | 33.17 | 32.87 | 34.80 | 31.82 | 41.49 |
| 7 | 0.40 | 0.63 | 0.57 | 0.59 | 1.55 |
| 8 | 0.57 | 0.76 | 0.96 | 0.78 | 0.90 |
| 9 | 3.91 | 3.98 | 3.46 | 3.73 | 4.04 |
| 10 | 4.33 | 4.21 | 4.14 | 4.04 | 3.88 |
| 11 | 12.00 | 12.67 | 9.89 | 11.56 | 15.56 |
| 12 | 11.89 | 13.44 | 11.22 | 13.22 | 14.00 |
| 13 | 16.44 | 14.33 | 14.56 | 14.11 | 16.78 |
| 14 | 145.39 | 131.56 | 129.89 | 131.56 | 116.44 |
| 15 | 7.78 | 6.22 | 5.56 | 4.89 | 5.33 |
| 16 | 16.44 | 14.33 | 14.56 | 14.11 | 16.78 |
| 17 | 6.11 | 5.22 | 5.67 | 6.56 | 6.00 |
| 18 | 47.28 | 47.33 | 44.67 | 58.67 | 47.17 |
| 19 | 4.52 | 4.89 | 4.68 | 5.56 | 5.49 |
| 20 | 41.34 | 40.82 | 40.82 | 38.14 | 37.21 |
| 21 | 164.44 | 181.11 | 176.22 | 217.89 | 261.11 |
| 22 | 12.60 | 12.91 | 12.56 | 13.77 | 13.56 |
| 23 | 3.34 | 3.09 | 3.39 | 3.40 | 2.39 |

Table 20: Provided are the values of each of the parameters (as described above) measured in B. juncea accessions (line numbers) under normal conditions.

TABLE 21

Correlation between the expression level of selected genes of some embodiments of the invention in various tissues and the phenotypic performance under normal conditions across B. Juncea accessions

| Gene Name | R | P value | Exp. set | Corr. Set ID | Gene Name | R | P value | Exp. set | Corr. Set ID |
|---|---|---|---|---|---|---|---|---|---|
| LYD346 | 0.76 | 6.81E−03 | 5 | 20 | LYD347 | 0.84 | 3.86E−02 | 2 | 3 |
| LYD347 | 0.77 | 7.40E−02 | 2 | 2 | LYD347 | 0.85 | 3.34E−02 | 2 | 12 |
| LYD348 | 0.70 | 1.18E−01 | 2 | 19 | LYD348 | 0.78 | 6.45E−02 | 2 | 11 |
| LYD348 | 0.96 | 2.23E−03 | 2 | 21 | LYD348 | 0.89 | 1.78E−02 | 2 | 3 |
| LYD348 | 0.79 | 6.14E−02 | 2 | 7 | LYD348 | 0.94 | 6.04E−03 | 2 | 2 |
| LYD348 | 0.77 | 5.36E−03 | 5 | 17 | LYD349 | 0.95 | 8.71E−05 | 1 | 21 |
| LYD349 | 0.79 | 6.32E−02 | 2 | 21 | LYD349 | 0.97 | 1.06E−03 | 2 | 3 |
| LYD349 | 0.77 | 7.19E−02 | 2 | 7 | LYD349 | 0.85 | 3.18E−02 | 2 | 2 |
| LYD349 | 0.74 | 9.30E−02 | 2 | 12 | LYD349 | 0.70 | 2.40E−02 | 3 | 22 |
| LYD349 | 0.84 | 1.32E−03 | 5 | 8 | LYD351 | 0.86 | 2.81E−03 | 1 | 2 |
| LYD351 | 0.70 | 1.20E−01 | 2 | 21 | LYD351 | 0.91 | 1.08E−02 | 2 | 3 |
| LYD351 | 0.92 | 9.53E−03 | 2 | 2 | LYD351 | 0.84 | 3.73E−02 | 2 | 12 |
| LYD351 | 0.73 | 1.02E−02 | 5 | 7 | LYD351 | 0.71 | 1.50E−02 | 5 | 8 |
| LYD352 | 0.78 | 1.24E−02 | 1 | 6 | LYD352 | 0.83 | 5.97E−03 | 1 | 21 |
| LYD352 | 0.78 | 1.30E−02 | 1 | 4 | LYD352 | 0.73 | 2.45E−02 | 1 | 3 |
| LYD352 | 0.90 | 1.11E−03 | 1 | 7 | LYD352 | 0.72 | 1.05E−01 | 2 | 20 |
| LYD352 | 0.85 | 3.11E−02 | 2 | 4 | LYD353 | 0.93 | 3.25E−04 | 1 | 11 |
| LYD353 | 0.71 | 3.22E−02 | 1 | 17 | LYD353 | 0.88 | 2.07E−02 | 2 | 11 |
| LYD353 | 0.80 | 5.37E−02 | 2 | 21 | LYD353 | 0.84 | 3.75E−02 | 2 | 3 |
| LYD353 | 0.97 | 1.03E−03 | 2 | 7 | LYD354 | 0.94 | 4.59E−03 | 2 | 3 |

TABLE 21-continued

Correlation between the expression level of selected genes of some embodiments of the invention in various tissues and the phenotypic performance under normal conditions across B. Juncea accessions

| Gene Name | R | P value | Exp. set | Corr. Set ID | Gene Name | R | P value | Exp. set | Corr. Set ID |
|---|---|---|---|---|---|---|---|---|---|
| LYD354 | 0.72 | 1.05E−01 | 2 | 2 | LYD354 | 0.77 | 7.17E−02 | 2 | 12 |
| LYD354 | 0.77 | 1.59E−02 | 1 | 17 | LYD354 | 0.74 | 2.15E−02 | 1 | 9 |
| LYD354 | 0.71 | 1.39E−02 | 5 | 20 | LYD354 | 0.72 | 1.20E−02 | 5 | 9 |
| LYD355 | 0.85 | 3.49E−03 | 1 | 11 | LYD355 | 0.90 | 8.14E−04 | 1 | 9 |
| LYD355 | 0.87 | 2.61E−02 | 2 | 21 | LYD355 | 0.95 | 3.74E−03 | 2 | 3 |
| LYD355 | 0.72 | 1.07E−01 | 2 | 7 | LYD355 | 0.94 | 5.40E−03 | 2 | 2 |
| LYD355 | 0.79 | 4.05E−03 | 5 | 8 | LYD356 | 0.73 | 1.68E−02 | 3 | 10 |
| LYD356 | 0.79 | 7.12E−03 | 3 | 23 | LYD357 | 0.92 | 8.69E−03 | 2 | 11 |
| LYD357 | 0.87 | 2.54E−02 | 2 | 21 | LYD357 | 0.88 | 2.07E−02 | 2 | 3 |
| LYD357 | 0.98 | 5.08E−04 | 2 | 7 | LYD357 | 0.73 | 1.02E−01 | 2 | 12 |
| LYD357 | 0.82 | 3.51E−03 | 3 | 4 | LYD358 | 0.86 | 2.81E−03 | 1 | 4 |
| LYD358 | 0.78 | 6.49E−02 | 2 | 20 | LYD358 | 0.86 | 2.77E−02 | 2 | 4 |
| LYD358 | 0.88 | 7.61E−04 | 3 | 6 | LYD358 | 0.72 | 1.29E−02 | 5 | 3 |
| LYD359 | 0.80 | 5.55E−02 | 2 | 6 | LYD359 | 0.78 | 6.68E−02 | 2 | 11 |
| LYD359 | 0.85 | 3.12E−02 | 2 | 21 | LYD359 | 0.94 | 5.89E−03 | 2 | 3 |
| LYD359 | 0.90 | 1.34E−02 | 2 | 7 | LYD359 | 0.79 | 6.11E−03 | 3 | 6 |
| LYD360 | 0.76 | 1.86E−02 | 1 | 4 | LYD360 | 0.70 | 1.21E−01 | 2 | 10 |
| LYD360 | 0.77 | 7.03E−02 | 2 | 1 | LYD360 | 0.89 | 1.89E−02 | 2 | 23 |
| LYD360 | 0.82 | 4.39E−02 | 2 | 5 | LYD360 | 0.91 | 1.14E−02 | 2 | 8 |
| LYD360 | 0.70 | 1.62E−02 | 5 | 4 | LYD361 | 0.91 | 1.23E−02 | 2 | 4 |
| LYD361 | 0.82 | 3.94E−03 | 3 | 7 | LYD361 | 0.85 | 1.84E−03 | 3 | 8 |
| LYD361 | 0.76 | 6.39E−03 | 5 | 22 | LYD362 | 0.82 | 7.41E−03 | 1 | 6 |
| LYD362 | 0.82 | 6.74E−03 | 1 | 7 | LYD362 | 0.78 | 6.84E−02 | 2 | 4 |
| LYD362 | 0.72 | 2.00E−02 | 3 | 2 | LYD364 | 0.75 | 1.97E−02 | 1 | 23 |
| LYD364 | 0.77 | 7.31E−02 | 2 | 21 | LYD364 | 0.92 | 9.20E−03 | 2 | 3 |
| LYD364 | 0.89 | 1.74E−02 | 2 | 2 | LYD364 | 0.72 | 1.05E−01 | 2 | 12 |
| LYD365 | 0.86 | 2.66E−02 | 2 | 11 | LYD365 | 0.83 | 3.98E−02 | 2 | 9 |
| LYD365 | 0.84 | 3.55E−02 | 2 | 16 | LYD365 | 0.84 | 3.55E−02 | 2 | 13 |
| LYD366 | 0.89 | 1.67E−02 | 2 | 11 | LYD366 | 0.90 | 1.55E−02 | 2 | 21 |
| LYD366 | 0.85 | 3.10E−02 | 2 | 3 | LYD366 | 0.82 | 4.41E−02 | 2 | 7 |
| LYD366 | 0.91 | 1.24E−02 | 2 | 2 | LYD366 | 0.80 | 5.80E−02 | 2 | 12 |
| LYD367 | 0.79 | 1.06E−02 | 1 | 7 | LYD367 | 0.74 | 2.23E−02 | 1 | 8 |
| LYD367 | 0.88 | 1.92E−02 | 2 | 11 | LYD367 | 0.71 | 1.10E−01 | 2 | 21 |
| LYD367 | 0.80 | 5.61E−02 | 2 | 3 | LYD367 | 0.94 | 4.77E−03 | 2 | 7 |
| LYD367 | 0.71 | 2.02E−02 | 3 | 6 | LYD368 | 0.78 | 1.35E−02 | 1 | 4 |
| LYD368 | 0.81 | 4.99E−02 | 2 | 6 | LYD368 | 0.78 | 6.86E−02 | 2 | 21 |
| LYD368 | 0.73 | 1.02E−01 | 2 | 3 | LYD368 | 0.87 | 2.58E−02 | 2 | 7 |
| LYD368 | 0.83 | 1.54E−03 | 5 | 23 | LYD497 | 0.81 | 7.77E−03 | 1 | 4 |
| LYD497 | 0.89 | 1.60E−02 | 2 | 16 | LYD497 | 0.89 | 1.60E−02 | 2 | 13 |
| LYD497 | 0.71 | 1.42E−02 | 5 | 18 | LYD497 | 0.72 | 1.21E−02 | 5 | 17 |
| LYD498 | 0.72 | 2.85E−02 | 1 | 7 | LYD498 | 0.94 | 6.09E−03 | 2 | 11 |
| LYD498 | 0.86 | 2.92E−02 | 2 | 7 | LYD498 | 0.87 | 2.44E−02 | 2 | 16 |
| LYD498 | 0.87 | 2.44E−02 | 2 | 13 | LYD498 | 0.74 | 1.54E−02 | 3 | 19 |
| LYD498 | 0.78 | 7.69E−03 | 3 | 18 | LYD499 | 0.71 | 1.12E−01 | 2 | 11 |
| LYD499 | 0.94 | 4.67E−03 | 2 | 21 | LYD499 | 0.84 | 3.73E−02 | 2 | 3 |
| LYD499 | 0.80 | 5.81E−02 | 2 | 7 | LYD499 | 0.93 | 7.27E−03 | 2 | 2 |
| LYD500 | 0.73 | 1.01E−01 | 2 | 20 | LYD500 | 0.78 | 6.91E−02 | 2 | 4 |
| LYD500 | 0.82 | 1.96E−03 | 5 | 20 | LYD501 | 0.91 | 6.50E−04 | 1 | 7 |
| LYD501 | 0.95 | 4.38E−03 | 2 | 11 | LYD501 | 0.84 | 3.49E−02 | 2 | 7 |
| LYD501 | 0.84 | 3.77E−02 | 2 | 9 | LYD501 | 0.91 | 1.21E−02 | 2 | 16 |
| LYD501 | 0.91 | 1.21E−02 | 2 | 13 | LYD501 | 0.72 | 1.99E−02 | 3 | 21 |

Table 21. Provided are the correlations (R) between the expression levels of yield improving genes and their homologues in tissues [Leaves, meristem, flower and pods; Expression sets (Exp)] and the phenotypic performance in various yield, biomass, growth rate and/or vigor components [Correlation vector (corr.) ID] under normal conditions across B, juncea accessions.
P = p value.

Example 6

Production of B. juncea Transcriptom and High Throughput Correlation Analysis with Yield Parameters of Juncea Grown Under Various Population Densities Using 60K B. juncea Oligonucleotide Micro-Arrays In order to produce a high throughput correlation analysis, the present inventors utilized a B. juncea oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 60,000 B. juncea genes and transcripts. In order to define correlations between the levels of RNA expression with yield components or vigor related parameters, various plant characteristics of two different B. juncea varieties grown under seven different population densities were analyzed and used for RNA expression analysis. The correlation between the RNA levels and the characterized parameters was analyzed using Pearson correlation test.

Correlation of B. juncea Genes' Expression Levels with Phenotypic Characteristics Across Seven Population Densities for Two Ecotypes Experimental Procedures Two *B. juncea* varieties were grown in a field under seven population densities (10, 60, 120, 160, 200, 250 and 300 plants per m$^2$) in two repetitive plots. Briefly, the growing protocol was as follows: *B. juncea* seeds were sown in soil and grown under normal condition till harvest. In order to define correlations between the levels of RNA expression with yield components or vigor related parameters, the two different *B. juncea* varieties grown under various population densities were analyzed and used for gene expression analyses. The correlation between the RNA levels and the characterized parameters was analyzed using Pearson correlation test for each ecotype independently.

TABLE 22

Tissues used for *B. juncea* transcriptom expression sets

| Expression Set | Set ID |
| --- | --- |
| Meristem under normal growth conditions various population densities | 1 + 2 |
| Flower under normal growth conditions various population densities | 3 |

Table 22: Provided are the identification (ID) digits of each of the *B. juncea* expression sets.

RNA extraction—the two *B. juncea* varieties grown under seven population densities were sample per each treatment. Plant tissues [Flower and Lateral meristem] growing under Normal conditions were sampled and RNA was extracted as described above. For convenience, each micro-array expression information tissue type has received a Set ID.

The collected data parameters were as follows:

Fresh weight (plot-harvest) [gr/plant]—total fresh weight per plot at harvest time normalized to the number of plants per plot.

Seed weight [gr/plant]—total seeds from each plot was extracted, weighted and normalized for plant number in each plot.

Harvest index—The harvest index was calculated: seed weight/fresh weight

Days till bolting/flowering—number of days till 50% bolting/flowering for each plot.

SPAD—Chlorophyll content was determined using a Minolta SPAD 502 chlorophyll meter and measurement was performed at time of flowering. SPAD meter readings were done on young fully developed leaf. Three measurements per leaf were taken for each plot.

Main branch—average node length—total length/total number of nods on main branch.

Lateral branch—average node length—total length/total number of nods on lateral branch.

Main branch—20th length—the length of the pod on the 20$^{th}$ node from the apex of main branch.

Lateral branch—20th length—the length of the pod on the 20$^{th}$ node from the apex of lateral branch.

Main branch—20th seed No.—number of seeds in the pod on the 20$^{th}$ node from the apex of main branch.

Lateral branch—20th seed number—number of seeds in the pod on the 20$^{th}$ node from the apex of lateral branch.

Number of lateral branches—total number of lateral branches, average of three plants per plot.

Main branch height [cm]—total length of main branch.

Min-Lateral branch position—lowest node on the main branch that has developed lateral branch.

Max-Lateral branch position [#node of main branch]—highest node on the main branch that has developed lateral branch.

Max-number of nodes in lateral branch—the highest number of node that a lateral branch had per plant.

Max-length of lateral branch [cm]—the highest length of lateral branch per plant.

Max diameter of lateral branch [mm]—the highest base diameter that a lateral branch had per plant.

Oil content—Indirect oil content analysis was carried out using Nuclear Magnetic Resonance (NMR) Spectroscopy, which measures the resonance energy absorbed by hydrogen atoms in the liquid state of the sample [See for example, Conway TF. and Earle F R., 1963, Journal of the American Oil Chemists' Society; Springer Berlin/Heidelberg, ISSN: 0003-021X (Print) 1558-9331 (Online)];

Fresh weight (single plant) (gr/plant)—average fresh weight of three plants per plot taken at the middle of the season.

Main branch base diameter [mm]—the based diameter of main branch, average of three plants per plot.

1000 Seeds [gr]—weight of 1000 seeds per plot.

Main branch-total number of pods—total number of pods on the main branch, average of three plants per plot.

Main branch-disc 1-20—the length between the youngest pod and pod number 20 on the main branch, average of three plants per plot.

Lateral branch-total number of pods—total number of pods on the lowest lateral branch, average of three plants per plot.

Lateral branch-dis. 1-20—the length between the youngest pod and pod number 20 on the lowest lateral branch, average of three plants per plot.

Dry weight/plant—weight of total plants per plot at harvest after three days at oven at 60° C. normalized for the number of plants per plot.

Total leaf area—Total leaf area per plot was calculated based on random three plants and normalized for number of plants per plot.

Total Perim.—total perimeter of leaves, was calculated based on random three plants and normalized for number of plants per plot.

Experimental Results

Two *B. juncea* varieties were grown under seven different population densities and characterized for 30 parameters as specified in Table 23 below. The average for each of the measured parameter was calculated using the JMP software and values are summarized in Tables 24-26 below. Subsequent correlation analysis between the expression of selected genes in various transcriptom expression sets and the average parameters was conducted. Results were then integrated to the database (Table 27).

TABLE 23

Correlation parameters in *B. juncea* accessions

| Correlated parameter with | Correlation ID |
| --- | --- |
| Main branch base diameter [mm] | 1 |
| Fresh Weight (single plant) [gr./plant] | 2 |
| Main branch height [cm] | 3 |
| Number of lateral branches (number) | 4 |
| Min-Lateral branch position (number of node on the main stem) | 5 |
| Max-Lateral branch position (number of node on the main stem) | 6 |
| Max-Number of nodes in lateral branch (number) | 7 |
| Max-Length of lateral branch [cm] | 8 |
| Max-Diameter of lateral branch [mm] | 9 |
| Main branch-total number of pods (number) | 10 |
| Main branch-dist. 1-20 | 11 |

TABLE 23-continued

Correlation parameters in *B. juncea* accessions

| Correlated parameter with | Correlation ID |
|---|---|
| Main branch-20th length (cm) | 12 |
| Main branch-20th seed number (number) | 13 |
| Lateral branch-total number of pods (number) | 14 |
| Lateral branch-dist. 1-20 | 15 |
| Lateral branch-20th length (cm) | 16 |
| Lateral branch-20th seed number (number) | 17 |
| Oil content (mg) | 18 |
| SPAD | 19 |
| days till bolting (days) | 20 |
| days till flowering (days) | 21 |
| Fresh weight (at harvest)/plant (gr/plant) | 22 |
| Dry weight/plant (gr./plant) | 23 |
| Seed weight/plant (gr./plant) | 24 |
| Fresh weight (harvest)/hectare (Kg/hectare) | 25 |
| Dry weight/hectare (Kg./hectare) | 26 |
| Seed weight/hectare | 27 |
| 1000Seeds [gr.] | 28 |
| Total leaf area (cm) | 29 |
| Total perim (cm). | 30 |

Table 23. Provided are the *B. juncea* correlated parameters.
"gr." = grams;
mm = millimeters;
"cm" = centimeters;
"mg" = milligrams;
"SPAD" = chlorophyll levels;
"Kg." = kilograms;

TABLE 24

Measured parameters in *B. juncea* varieties at various population densities

| Variety at population density/ Correlation ID No. | line 1-density: 10 | line 1-density: 120 | line 1-density: 160 | line 1-density: 200 | line 1-density: 250 |
|---|---|---|---|---|---|
| 1 | 14.7666667 | 6.9 | 5.61666667 | 4.99166667 | 6.45 |
| 2 | 0.3675 | 0.03583333 | 0.03333333 | 0.02416667 | 0.0375 |
| 3 | 118.666667 | 115.5 | 111.333333 | 106 | 117.5 |
| 4 | 17.1666667 | 19.1666667 | 15.8333333 | 19.3333333 | 18.333333 |
| 5 | 1 | 11 | 7 | 11 | 9 |
| 6 | 20 | 23 | 19 | 24 | 22 |
| 7 | 10 | 4 | 4 | 4 | 6 |
| 8 | 122 | 41 | 43 | 36 | 40 |
| 9 | 7.7 | 2.9 | 2.5 | 2 | 3.4 |
| 10 | 20 | 15.33333333 | 17.6666667 | 16.5 | 23.166667 |
| 11 | 42.35 | 27.9 | 31.2166667 | 26.05 | 27.716667 |
| 12 | 5.11666667 | 4.633333333 | 4.6 | 4.66666667 | 4.7333333 |
| 13 | 20 | 17.66666667 | 18 | 18.5 | 17.666667 |
| 14 | 17.3333333 | 11.66666667 | 10.6666667 | 10.1666667 | 12.5 |
| 15 | 40.7333333 | 17.53333333 | 19.0833333 | 15.65 | 15.233333 |
| 16 | 5.11666667 | 4.483333333 | 4.36666667 | 4.33333333 | 4.35 |
| 17 | 21.6666667 | 19.33333333 | 17 | 18.8333333 | 15.666667 |
| 18 | 28.855 | 29.615 | 29.57 | 30.585 | 29.87 |
| 19 | 43.49 | 41.95 | 40.48 | 37.93 | 39.5 |
| 20 | 53 | 50.5 | 48 | 53 | 50 |
| 21 | 67 | 64 | 64 | 64 | 64 |
| 22 | 0.25972617 | 0.017544463 | 0.01160373 | 0.00941177 | 0.0086383 |
| 23 | 0.07146015 | 0.007860795 | 0.00318829 | 0.00218658 | 0.0027891 |
| 24 | 0.02093378 | 0.001837079 | 0.00088821 | 0.00073613 | 0.0008761 |
| 25 | 22434.188 | 22067.23763 | 32929.2929 | 18596.0411 | 20654.321 |
| 26 | 6109.01654 | 9857.366286 | 8940.69724 | 4363.21162 | 6702.2185 |
| 27 | 1797.45096 | 2307.336938 | 2552.83939 | 1466.27328 | 2100.3779 |
| 28 | 1.80123016 | 1.7524685 | 1.62082389 | 1.98973809 | 1.9222969 |
| 29 | 508.273183 | 37.4855833 | 24.9985 | 14.33268 | 50.78652 |
| 30 | 862.832233 | 100.498267 | 67.98265 | 37.90552 | 97.50658 |

Table 24: Provided are the values of each of the parameters (as described in Table 23 above) measured in *B. juncea* 2 varieties at the indicated population densities under normal conditions. For example, "line 1 density: 10" refers to Juncea variety 1 grown at a population density of 10 plants per m$^2$.

TABLE 25

Measured parameters in *B. juncea* varieties at various population densities

| Variety at population density/ Correlation ID No. | line 1-density: 300 | line 1-density: 60 | line 2-density: 10 | line 2-density: 120 | line 2-density: 160 |
|---|---|---|---|---|---|
| 1 | 3.95 | 7.3666667 | 18.9 | 7.8083333 | 6.79166667 |
| 2 | 0.02166667 | 0.074 | 0.335 | 0.0433333 | 0.03166667 |
| 3 | 108 | 116 | 133.166667 | 144.58333 | 144.916667 |
| 4 | 17.8333333 | 16.166667 | 12.5 | 15.333333 | 16.8333333 |
| 5 | 9 | 5 | 1 | 8 | 9 |
| 6 | 20 | 20 | 14 | 17 | 21 |
| 7 | 4 | 6 | 11 | 6 | 5 |
| 8 | 42 | 78 | 127 | 42 | 34 |
| 9 | 2.5 | 4.4 | 8.4 | 3 | 2.6 |
| 10 | 16.83333333 | 15.166667 | 30.66666667 | 35.166667 | 29.83333333 |
| 11 | 31.85 | 37.583333 | 38.71666667 | 32.85 | 28.76666667 |
| 12 | 4.683333333 | 5.1 | 4.666666667 | 3.85 | 4.433333333 |
| 13 | 17.5 | 17.666667 | 14.33333333 | 10.333333 | 13.83333333 |
| 14 | 9.833333333 | 14 | 29.83333333 | 17.333333 | 12.83333333 |
| 15 | 17.73333333 | 28.25 | 33.41666667 | 14.266667 | 9.833333333 |
| 16 | 4.4 | 4.95 | 4.483333333 | 3.6666667 | 3.983333333 |
| 17 | 17.16666667 | 14.55 | 12.83333333 | 10.166667 | 12.33333333 |
| 18 | 25.215 | 26.775 | 34.39 | 38.65 | 39.66 |
| 19 | 45.57 | 40.89 | 43.83 | 41.31 | 40.86 |
| 20 | 51.5 | 53 | 55 | 50.5 | 47 |
| 21 | 62.5 | 62.5 | 64 | 61 | 61 |
| 22 | 0.009480434 | 0.0470682 | 0.186308744 | 0.015699 | 0.013530187 |
| 23 | 0.002374948 | 0.0111681 | 0.045443225 | 0.0045977 | 0.004239026 |
| 24 | 0.000755044 | 0.0031703 | 0.014292085 | 0.0015562 | 0.001265508 |
| 25 | 24019.71326 | 33376.441 | 16427.35043 | 15747.619 | 18531.76931 |
| 26 | 6009.085327 | 7906.6628 | 3979.782952 | 4609.2529 | 5801.024836 |
| 27 | 1901.668907 | 2247.0135 | 1270.039245 | 1560.5283 | 1732.849463 |
| 28 | 1.54010747 | 1.5648537 | 2.81538106 | 3.1954331 | 2.87691722 |
| 29 | 29.1283 | 76.394583 | 1338.57912 | 76.818567 | 34.4628 |
| 30 | 61.16926 | 219.13607 | 1518.31188 | 162.79095 | 82.7731667 |

Table 25: Provided are the values of each of the parameters (as described in Table 23 above) measured in *B. juncea* 2 varieties at the indicated population densities under normal conditions. For example, "line 2-density: 300" refers to Juncea variety 2 grown at a population density of 300 plants per $m^2$.

TABLE 26

Measured parameters in *B. juncea* varieties at various population densities

| Variety at population density/ Correlation ID No. | line 2-density: 200 | line 2-density: 250 | line 2-density: 300 | line 2-density: 60 |
|---|---|---|---|---|
| 1 | 6.95 | 7.533333 | 5.441667 | 8.766667 |
| 2 | 0.025 | 0.028333 | 0.024167 | 0.065833 |
| 3 | 138.5 | 144.1667 | 135.75 | 157.3333 |
| 4 | 16.66667 | 16.66667 | 15.5 | 12.83333 |
| 5 | 8 | 10 | 8 | 3 |
| 6 | 18 | 19 | 18 | 16 |
| 7 | 4 | 6 | 4 | 11 |
| 8 | 23 | 38 | 25 | 109 |
| 9 | 2.1 | 2.8 | 2.35 | 8 |
| 10 | 30.83333 | 29.33333 | 25.33333 | 33.83333 |
| 11 | 25.3 | 26.38333 | 25.06667 | 45.25 |
| 12 | 4.116667 | 4.116667 | 4.233333 | 4.433333 |
| 13 | 10.33333 | 11 | 10.66667 | 13.16667 |
| 14 | 11.16667 | 13 | 9 | 18.5 |
| 15 | 8.6 | 10.98333 | 6.35 | 21.58333 |
| 16 | 4.033333 | 3.966667 | 3.7 | 4.716667 |
| 17 | 10.66667 | 9.833333 | 9 | 11.16667 |
| 18 | 36.795 | 37.1 | 37.61 | 37.545 |
| 19 | 39.31 | 40.46 | 47.48 | 39.21 |
| 20 | 48 | 49 | 49 | 51.5 |
| 21 | 61 | 61 | 61 | 61 |
| 22 | 0.009797 | 0.008836 | 0.008388 | 0.039744 |
| 23 | 0.003773 | 0.002963 | 0.002531 | 0.011524 |
| 24 | 0.000842 | 0.000819 | 0.000729 | 0.0034 |
| 25 | 17182.54 | 16833.33 | 23055.66 | 20833.33 |
| 26 | 6581.384 | 5656.266 | 6882.516 | 6039.66 |

TABLE 26-continued

Measured parameters in *B. juncea* varieties at various population densities

| Variety at population density/ Correlation ID No. | line 2- density: 200 | line 2- density: 250 | line 2- density: 300 | line 2- density: 60 |
|---|---|---|---|---|
| 27 | 1472.184 | 1560.8 | 2005.713 | 1780.966 |
| 28 | 3.256972 | 3.276912 | 3.430244 | 2.773618 |
| 29 | 28.27737 | 41.3294 | 92.8963 | 218.1545 |
| 30 | 75.36597 | 83.49002 | 143.9019 | 328.9701 |

Table 26: Provided are the values of each of the parameters (as described in Table 23 above) measured in *B. juncea* 2 varieties at the indicated population densities under normal conditions. For example, "line 2-density: 200" refers to *Juncea* variety 2 grown at a population density of 200 plants per m².

TABLE 27

Correlation between the expression level of selected genes of some embodiments of the invention in various tissues and the phenotypic performance under normal conditions at different densities across *B. Juncea* accessions

| Gene Name | R | P value | Exp. set | Corr. Set ID | Gene Name | R | P value | Exp. set | Corr. Set ID |
|---|---|---|---|---|---|---|---|---|---|
| LYD347 | 0.81 | 2.84E−02 | 2 | 13 | LYD347 | 0.73 | 6.45E−02 | 2 | 21 |
| LYD348 | 0.71 | 7.58E−02 | 2 | 26 | LYD351 | 0.84 | 1.78E−02 | 2 | 6 |
| LYD351 | 0.76 | 4.93E−02 | 2 | 5 | LYD351 | 0.80 | 3.02E−02 | 2 | 4 |
| LYD352 | 0.89 | 6.74E−03 | 2 | 9 | LYD352 | 0.90 | 5.09E−03 | 2 | 8 |
| LYD352 | 0.91 | 4.34E−03 | 2 | 1 | LYD352 | 0.88 | 9.54E−03 | 2 | 7 |
| LYD352 | 0.91 | 4.60E−03 | 2 | 15 | LYD352 | 0.76 | 4.95E−02 | 2 | 16 |
| LYD352 | 0.95 | 9.24E−04 | 2 | 24 | LYD352 | 0.91 | 4.48E−03 | 2 | 13 |
| LYD352 | 0.95 | 9.57E−04 | 2 | 29 | LYD352 | 0.83 | 2.19E−02 | 2 | 11 |
| LYD352 | 0.96 | 6.22E−04 | 2 | 2 | LYD352 | 0.82 | 2.37E−02 | 2 | 14 |
| LYD352 | 0.95 | 1.11E−03 | 2 | 23 | LYD352 | 0.95 | 1.16E−03 | 2 | 30 |
| LYD352 | 0.84 | 1.90E−02 | 2 | 21 | LYD352 | 0.96 | 7.54E−04 | 2 | 22 |
| LYD354 | 0.94 | 1.36E−03 | 2 | 9 | LYD354 | 0.91 | 4.65E−03 | 2 | 8 |
| LYD354 | 0.98 | 6.32E−05 | 2 | 1 | LYD354 | 0.93 | 2.58E−03 | 2 | 7 |
| LYD354 | 0.80 | 3.11E−02 | 2 | 3 | LYD354 | 0.88 | 8.26E−03 | 2 | 15 |
| LYD354 | 0.88 | 8.18E−03 | 2 | 16 | LYD354 | 0.96 | 5.17E−04 | 2 | 24 |
| LYD354 | 0.84 | 1.69E−02 | 2 | 12 | LYD354 | 0.91 | 4.10E−03 | 2 | 13 |
| LYD354 | 0.96 | 4.81E−04 | 2 | 29 | LYD354 | 0.76 | 4.55E−02 | 2 | 11 |
| LYD354 | 0.97 | 3.23E−04 | 2 | 2 | LYD354 | 0.99 | 3.80E−05 | 2 | 14 |
| LYD354 | 0.96 | 5.20E−04 | 2 | 23 | LYD354 | 0.96 | 6.03E−04 | 2 | 30 |
| LYD354 | 0.92 | 3.42E−03 | 2 | 21 | LYD354 | 0.96 | 6.14E−04 | 2 | 22 |
| LYD355 | 0.89 | 7.35E−03 | 2 | 5 | LYD357 | 0.76 | 4.65E−02 | 2 | 9 |
| LYD357 | 0.78 | 3.83E−02 | 2 | 8 | LYD357 | 0.76 | 4.88E−02 | 2 | 7 |
| LYD357 | 0.76 | 4.52E−02 | 2 | 15 | LYD357 | 0.75 | 5.22E−02 | 2 | 24 |
| LYD357 | 0.75 | 5.38E−02 | 2 | 12 | LYD357 | 0.77 | 4.35E−02 | 2 | 29 |
| LYD357 | 0.83 | 2.20E−02 | 2 | 11 | LYD357 | 0.75 | 5.01E−02 | 2 | 2 |
| LYD357 | 0.74 | 5.71E−02 | 2 | 23 | LYD357 | 0.77 | 4.48E−02 | 2 | 30 |
| LYD357 | 0.76 | 4.68E−02 | 2 | 22 | LYD358 | 0.79 | 3.44E−02 | 2 | 9 |
| LYD358 | 0.79 | 3.65E−02 | 2 | 8 | LYD358 | 0.72 | 6.57E−02 | 2 | 1 |
| LYD358 | 0.78 | 3.87E−02 | 2 | 7 | LYD358 | 0.75 | 5.36E−02 | 2 | 3 |
| LYD358 | 0.75 | 5.09E−02 | 2 | 15 | LYD358 | 0.87 | 1.05E−02 | 2 | 16 |
| LYD358 | 0.93 | 2.62E−03 | 2 | 12 | LYD358 | 0.88 | 8.16E−03 | 2 | 14 |
| LYD360 | 0.85 | 1.57E−02 | 2 | 9 | LYD360 | 0.93 | 2.36E−03 | 2 | 8 |
| LYD360 | 0.78 | 3.78E−02 | 2 | 1 | LYD360 | 0.81 | 2.62E−02 | 2 | 7 |
| LYD360 | 0.94 | 1.87E−03 | 2 | 15 | LYD360 | 0.96 | 6.16E−04 | 2 | 16 |
| LYD360 | 0.87 | 1.10E−02 | 2 | 24 | LYD360 | 0.97 | 2.30E−04 | 2 | 12 |
| LYD360 | 0.79 | 3.33E−02 | 2 | 13 | LYD360 | 0.86 | 1.29E−02 | 2 | 29 |
| LYD360 | 0.95 | 8.96E−04 | 2 | 11 | LYD360 | 0.87 | 1.01E−02 | 2 | 2 |
| LYD360 | 0.84 | 1.75E−02 | 2 | 14 | LYD360 | 0.86 | 1.24E−02 | 2 | 23 |
| LYD360 | 0.88 | 9.10E−03 | 2 | 30 | LYD360 | 0.89 | 7.66E−03 | 2 | 22 |
| LYD361 | 0.75 | 5.01E−02 | 2 | 13 | LYD361 | 0.79 | 3.38E−02 | 2 | 21 |
| LYD362 | 0.78 | 3.75E−02 | 2 | 9 | LYD362 | 0.75 | 5.21E−02 | 2 | 8 |
| LYD362 | 0.86 | 1.28E−02 | 2 | 19 | LYD362 | 0.84 | 1.70E−02 | 2 | 27 |
| LYD362 | 0.74 | 5.47E−02 | 2 | 1 | LYD362 | 0.72 | 6.89E−02 | 2 | 7 |
| LYD362 | 0.76 | 4.69E−02 | 2 | 15 | LYD362 | 0.76 | 4.92E−02 | 2 | 24 |
| LYD362 | 0.77 | 4.33E−02 | 2 | 29 | LYD362 | 0.82 | 2.53E−02 | 2 | 11 |
| LYD362 | 0.76 | 4.58E−02 | 2 | 2 | LYD362 | 0.71 | 7.65E−02 | 2 | 14 |
| LYD362 | 0.76 | 4.79E−02 | 2 | 23 | LYD362 | 0.77 | 4.16E−02 | 2 | 30 |
| LYD362 | 0.76 | 4.95E−02 | 2 | 22 | LYD362 | 0.80 | 3.24E−02 | 2 | 26 |
| LYD364 | 0.74 | 5.61E−02 | 2 | 6 | LYD364 | 0.75 | 5.13E−02 | 2 | 28 |
| LYD364 | 0.75 | 5.25E−02 | 2 | 4 | LYD365 | 0.72 | 6.78E−02 | 2 | 18 |
| LYD366 | 0.91 | 4.39E−03 | 2 | 5 | LYD497 | 0.75 | 5.27E−02 | 2 | 5 |
| LYD498 | 0.83 | 2.09E−02 | 2 | 5 | LYD499 | 0.76 | 4.79E−02 | 2 | 1 |
| LYD499 | 0.78 | 3.69E−02 | 2 | 24 | LYD499 | 0.85 | 1.42E−02 | 2 | 13 |
| LYD499 | 0.78 | 4.03E−02 | 2 | 29 | LYD499 | 0.77 | 4.33E−02 | 2 | 2 |

TABLE 27-continued

Correlation between the expression level of selected genes of some embodiments of the invention in various tissues and the phenotypic performance under normal conditions at different densities across *B. Juncea* accessions

| Gene Name | R | P value | Exp. set | Corr. Set ID | Gene Name | R | P value | Exp. set | Corr. Set ID |
|---|---|---|---|---|---|---|---|---|---|
| LYD499 | 0.79 | 3.55E−02 | 2 | 23 | LYD499 | 0.73 | 6.11E−02 | 2 | 30 |
| LYD499 | 0.96 | 5.73E−04 | 2 | 21 | LYD499 | 0.76 | 4.68E−02 | 2 | 22 |
| LYD499 | 0.92 | 3.61E−03 | 2 | 17 | LYD501 | 0.71 | 7.41E−02 | 2 | 15 |
| LYD501 | 0.85 | 1.56E−02 | 2 | 16 | LYD501 | 0.82 | 2.45E−02 | 2 | 12 |
| LYD501 | 0.76 | 4.65E−02 | 2 | 11 | LYD501 | 0.74 | 5.64E−02 | 2 | 5 |

Table 27. Provided are the correlations (R) between the expression levels of yield improving genes and their homologues in tissues [meristem and flower; Expression sets (Exp)] and the phenotypic performance in various yield, biomass, growth rate and/or vigor components [Correlation vector (corr.) ID] under normal conditions across *B, juncea* accessions.
P = p value.

Example 7

Production of *Sorghum* Transcriptom and High Throughput Correlation Analysis with ABST Related Parameters Using 44K *Sorghum* Oligonucleotide Micro-Arrays In order to produce a high throughput correlation analysis between plant phenotype and gene expression level, the present inventors utilized a *sorghum* oligonucleotide microarray, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 44,000 *sorghum* genes and transcripts. In order to define correlations between the levels of RNA expression with ABST, yield and NUE components or vigor related parameters, various plant characteristics of 17 different *sorghum* hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of *Sorghum* Varieties Across Ecotypes Grown Under Regular Growth Conditions, Severe Drought Conditions and Low Nitrogen Conditions Experimental Procedures 17 *Sorghum* varieties were grown in 3 repetitive plots, in field. Briefly, the growing protocol was as follows:

1. Regular (normal) growth conditions: *sorghum* plants were grown in the field using commercial fertilization and irrigation protocols (370 liter per meter, fertilization of 14 units of 21% urea per entire growth period).

2. Drought conditions: *sorghum* seeds were sown in soil and grown under normal condition until around 35 days from sowing, around stage V8 (eight green leaves are fully expanded, booting not started yet). At this point, irrigation was stopped, and severe drought stress was developed.

3. Low Nitrogen fertilization conditions: *sorghum* plants were fertilized with 50% less amount of nitrogen in the field than the amount of nitrogen applied in the regular growth treatment. All the fertilizer was applied before flowering.

Analyzed *Sorghum* tissues—All 10 selected *Sorghum* hybrids were sample per each treatment. Tissues [Flag leaf, Flower meristem and Flower] from plants growing under normal conditions, severe drought stress and low nitrogen conditions were sampled and RNA was extracted as described above. Each micro-array expression information tissue type has received a Set ID as summarized in Table 28 below.

TABLE 28

*Sorghum* transcriptom expression sets

| Expression Set | Set ID |
|---|---|
| Flag leaf at flowering stage under drought growth conditions | 1 |
| Flag leaf at flowering stage under low nitrogen growth conditions | 2 |
| Flag leaf at flowering stage under normal growth conditions | 3 |
| Flower meristem at flowering stage under drought growth conditions | 4 |
| Flower meristem at flowering stage under low nitrogen growth conditions | 5 |
| Flower meristem at flowering stage under normal growth conditions | 6 |
| Flower at flowering stage under drought growth conditions | 7 |
| Flower at flowering stage under low nitrogen growth conditions | 8 |
| Flower at flowering stage under normal growth conditions | 9 |

Table 28: Provided are the *sorghum* transcriptom expression sets 1-9. Flag leaf = the leaf below the flower; Flower meristem = Apical meristem following panicle initiation; Flower = the flower at the anthesis day. Expression sets 1, 4 and 7 are from plants grown under drought conditions; Expresion sets 2, 5 and 8 are from plants grown under low nitrogen conditions; Expression sets 3, 6 and 9 are from plants grown under normal conditions.

The following parameters were collected using digital imaging system:

At the end of the growing period the grains were separated from the Plant 'Head' and the following parameters were measured and collected:

Average Grain Area ($cm^2$)—A sample of ~200 grains were weight, photographed and images were processed using the below described image processing system. The grain area was measured from those images and was divided by the number of grains.

(I) Upper and Lower Ratio Average of Grain Area, width, diameter and perimeter—Grain projection of area, width, diameter and perimeter were extracted from the digital images using open source package imagej (nih). Seed data was analyzed in plot average levels as follows:

Average of all seeds.

Average of upper 20% fraction—contained upper 20% fraction of seeds.

Average of lower 20% fraction—contained lower 20% fraction of seeds.

Further on, ratio between each fraction and the plot average was calculated for each of the data parameters.

At the end of the growing period 5 'Heads' were, photographed and images were processed using the below described image processing system.

(II) Head Average Area (cm$^2$)—At the end of the growing period 5 'Heads' were, photographed and images were processed using the below described image processing system. The 'Head' area was measured from those images and was divided by the number of 'Heads'.

(III) Head Average Length (cm)—At the end of the growing period 5 'Heads' were, photographed and images were processed using the below described image processing system. The 'Head' length (longest axis) was measured from those images and was divided by the number of 'Heads'.

(IV) Head Average width (cm)—At the end of the growing period 5 'Heads' were, photographed and images were processed using the below described image processing system. The 'Head' width was measured from those images and was divided by the number of 'Heads'.

(V) Head Average width (cm)—At the end of the growing period 5 'Heads' were, photographed and images were processed using the below described image processing system. The 'Head' perimeter was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Grain Weight/Head (gr.) (grain yield)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head/Plant gram—At the end of the experiment (when heads were harvested) total and 5 selected heads per plots within blocks A-C were collected separately. The heads (total and 5) were weighted (gr.) separately and the average fresh weight per plant was calculated for total (FW Head/Plant gr. based on plot) and for 5 (FW Head/Plant gr. based on 5 plants).

Plant height—Plants were characterized for height during growing period at 5 time points. In each measure, plants were measured for their height using a measuring tape. Height was measured from ground level to top of the longest leaf.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative fresh weight and Heads—At the end of the experiment (when Inflorescence were dry) all Inflorescence and vegetative material from plots within blocks A-C were collected. The biomass and Heads weight of each plot was separated, measured and divided by the number of Heads.

Plant biomass (Fresh weight)—At the end of the experiment (when Inflorescence were dry) the vegetative material from plots within blocks A-C were collected. The plants biomass without the Inflorescence were measured and divided by the number of Plants.

FW Heads/(FW Heads+FW Plants)—The total fresh weight of heads and their respective plant biomass were measured at the harvest day. The heads weight was divided by the sum of weights of heads and plants.

Experimental Results 17 different *sorghum* varieties were grown and characterized for different parameters (Table 29). The average for each of the measured parameter was calculated using the JMP software (Tables 30-31) and a subsequent correlation analysis between the various transcriptom sets (Table 28) and the average parameters (Tables 30-31) was conducted Results were then integrated to the database (Table 32).

TABLE 29

*Sorghum* correlated parameters (vectors)

| Correlated parameter with | Correlation ID |
|---|---|
| Total grain weight/Head gr (based on plot), Normal | 1 |
| Total grain weight/Head gr (based on 5 heads), Normal | 2 |
| Head Average Area (cm$^2$), Normal | 3 |
| Head Average Perimeter (cm), Normal | 4 |
| Head Average Length (cm), Normal | 5 |
| Head Average Width (cm), Normal | 6 |
| Average Grain Area (cm$^2$), Normal | 7 |
| Upper Ratio Average Grain Area, Normal | 8 |
| Lower Ratio Average Grain Area, Normal | 9 |
| Lower Ratio Average Grain Perimeter, Normal | 10 |
| Lower Ratio Average Grain Length, Normal | 11 |
| Lower Ratio Average Grain Width, Normal | 12 |
| Final Plant Height (cm), Normal | 13 |
| FW - Head/Plant gr (based on 5 plants), Normal | 14 |
| FW - Head/Plant gr (based on plot), Normal | 15 |
| FW/Plant gr (based on plot), Normal | 16 |
| Leaf SPAD 64 DPS (Days Post Sowing), Normal | 17 |
| FW Heads/(FW Heads + FW Plants) (all plot), Normal | 18 |
| [Plant biomass (FW)/SPAD 64 DPS], Normal | 19 |
| [Grain Yield + plant biomass/SPAD 64 DPS], Normal | 20 |
| [Grain yield/SPAD 64 DPS], Normal | 21 |
| Total grain weight/Head (based on plot) gr., Low N | 22 |
| Total grain weight/Head gr (based on 5 heads), Low N | 23 |
| Head Average Area (cm$^2$), Low N | 24 |
| Head Average Perimeter (cm), Low N | 25 |
| Head Average Length (cm), Low N | 26 |
| Head Average Width (cm), Low N | 27 |
| Average Grain Area (cm$^2$), Low N | 28 |
| Upper Ratio Average Grain Area, Low N | 29 |
| Lower Ratio Average Grain Area, Low N | 30 |
| Lower Ratio Average Grain Perimeter, Low N | 31 |
| Lower Ratio Average Grain Length, Low N | 32 |
| Lower Ratio Average Grain Width, Low N | 33 |
| Final Plant Height (cm), Low N | 34 |
| FW - Head/Plant gr. (based on 5 plants), Low N | 35 |
| FW - Head/Plant gr. (based on plot), Low N | 36 |
| FW/Plant gr. (based on plot), Low N | 37 |
| Leaf SPAD 64 DPS (Days Post Sowing), Low N | 38 |
| FW Heads/(FW Heads + FW Plants) (all plot), Low N | 39 |
| [Plant biomass (FW)/SPAD 64 DPS], Low N | 40 |
| [Grain Yield + plant biomass/SPAD 64 DPS], Low N | 41 |
| [Grain yield/SPAD 64 DPS], Low N | 42 |
| Total grain weight/Head gr, (based on plot) Drought | 43 |
| Head Average Area (cm$^2$), Drought | 44 |
| Head Average Perimeter (cm), Drought | 45 |
| Head Average Length (cm), Drought | 46 |
| Head Average Width (cm), Drought | 47 |
| Average Grain Area (cm$^2$), Drought | 48 |
| Upper Ratio Average Grain Area, Drought | 49 |
| Final Plant Height (cm), Drought | 50 |
| FW - Head/Plant gr. (based on plot), Drought | 51 |
| FW/Plant gr (based on plot), Drought | 52 |
| Leaf SPAD 64 DPS (Days Post Sowing), Drought | 53 |
| FW Heads/(FW Heads + FW Plants)(all plot), Drought | 54 |
| [Plant biomass (FW)/SPAD 64 DPS], Drought | 55 |

Table 29. Provided are the *Sorghum* correlated parameters (vectors). "gr." = grams; "SPAD" = chlorophyll levels; "FW" = Plant Fresh weight; "normal" = standard growth conditions.

TABLE 30

Measured parameters in *Sorghum* accessions (Lines 1-9)

| Ecotype/ Correlation ID No. | Line-1 | Line-2 | Line-3 | Line-4 | Line-5 | Line-6 | Line-7 | Line-8 | Line-9 |
|---|---|---|---|---|---|---|---|---|---|
| 1 | 31.12 | 26.35 | 18.72 | 38.38 | 26.67 | 28.84 | 47.67 | 31.00 | 39.99 |
| 2 | 47.40 | 46.30 | 28.37 | 70.40 | 32.15 | 49.23 | 63.45 | 44.45 | 56.65 |
| 3 | 120.14 | 167.60 | 85.14 | 157.26 | 104.00 | 102.48 | 168.54 | 109.32 | 135.13 |
| 4 | 61.22 | 67.90 | 56.26 | 65.38 | 67.46 | 67.46 | 74.35 | 56.16 | 61.64 |
| 5 | 25.58 | 26.84 | 21.02 | 26.84 | 23.14 | 21.82 | 31.33 | 23.18 | 25.70 |
| 6 | 5.97 | 7.92 | 4.87 | 7.43 | 5.58 | 5.88 | 6.78 | 5.99 | 6.62 |
| 7 | 0.10 | 0.11 | 0.13 | 0.13 | 0.14 | 0.14 | 0.11 | 0.11 | 0.10 |
| 8 | 1.22 | 1.30 | 1.13 | 1.14 | 1.16 | 1.15 | 1.19 | 1.23 | 1.25 |
| 9 | 0.83 | 0.74 | 0.78 | 0.80 | 0.70 | 0.70 | 0.83 | 0.81 | 0.84 |
| 10 | 0.91 | 0.87 | 0.91 | 0.95 | 0.90 | 0.91 | 0.91 | 0.91 | 0.92 |
| 11 | 0.91 | 0.88 | 0.92 | 0.91 | 0.89 | 0.88 | 0.91 | 0.90 | 0.92 |
| 12 | 0.91 | 0.83 | 0.85 | 0.87 | 0.79 | 0.80 | 0.90 | 0.89 | 0.91 |
| 13 | 95.25 | 79.20 | 197.85 | 234.20 | 189.40 | 194.67 | 117.25 | 92.80 | 112.65 |
| 14 | 406.50 | 518.00 | 148.00 | 423.00 | 92.00 | 101.33 | 423.50 | 386.50 | 409.50 |
| 15 | 175.15 | 223.49 | 56.40 | 111.62 | 67.34 | 66.90 | 126.18 | 107.74 | 123.86 |
| 16 | 162.56 | 212.59 | 334.83 | 313.46 | 462.28 | 318.26 | 151.13 | 137.60 | 167.98 |
| 17 | 43.01 | . | 43.26 | 44.74 | 45.76 | 41.61 | 45.21 | 45.14 | 43.03 |
| 18 | 0.51 | 0.51 | 0.12 | 0.26 | 0.12 | 0.18 | 0.46 | 0.43 | 0.42 |
| 19 | 0.72 | 0.43 | 0.86 | 0.58 | 0.69 | 1.05 | 0.69 | 0.93 | 0.84 |
| 20 | 4.50 | 8.17 | 7.87 | 10.68 | 8.34 | 4.40 | 3.74 | 4.83 | 3.67 |
| 21 | 3.78 | 7.74 | 7.01 | 10.10 | 7.65 | 3.34 | 3.05 | 3.90 | 2.83 |
| 22 | 25.95 | 30.57 | 19.37 | 35.62 | 25.18 | 22.18 | 49.96 | 27.48 | 51.12 |
| 23 | 50.27 | 50.93 | 36.13 | 73.10 | 37.87 | 36.40 | 71.67 | 35.00 | 76.73 |
| 24 | 96.24 | 214.72 | 98.59 | 182.83 | 119.64 | 110.19 | 172.36 | 84.81 | 156.25 |
| 25 | 56.32 | 79.20 | 53.25 | 76.21 | 67.27 | 59.49 | 79.28 | 51.52 | 69.88 |
| 26 | 23.22 | 25.58 | 20.93 | 28.43 | 24.32 | 22.63 | 32.11 | 20.38 | 26.69 |
| 27 | 5.26 | 10.41 | 5.93 | 8.25 | 6.19 | 6.12 | 6.80 | 5.25 | 7.52 |
| 28 | 0.11 | 0.11 | 0.14 | 0.12 | 0.14 | 0.13 | 0.12 | 0.12 | 0.12 |
| 29 | 1.18 | 1.31 | 1.11 | 1.21 | 1.19 | 1.18 | 1.16 | 1.23 | 1.17 |
| 30 | 0.82 | 0.77 | 0.81 | 0.79 | 0.78 | 0.80 | 0.83 | 0.79 | 0.81 |
| 31 | 0.90 | 0.88 | 0.92 | 0.90 | 0.92 | 0.92 | 0.92 | 0.89 | 0.90 |
| 32 | 0.91 | 0.90 | 0.92 | 0.90 | 0.91 | 0.93 | 0.92 | 0.89 | 0.90 |
| 33 | 0.90 | 0.85 | 0.89 | 0.88 | 0.86 | 0.87 | 0.91 | 0.89 | 0.90 |
| 34 | 104.00 | 80.93 | 204.73 | 125.40 | 225.40 | 208.07 | 121.40 | 100.27 | 121.13 |
| 35 | 388.00 | 428.67 | 297.67 | 280.00 | 208.33 | 303.67 | 436.00 | 376.33 | 474.67 |
| 36 | 214.78 | 205.05 | 73.49 | 122.96 | 153.07 | 93.23 | 134.11 | 77.43 | 129.63 |
| 37 | 204.78 | 199.64 | 340.51 | 240.60 | 537.78 | 359.40 | 149.20 | 129.06 | 178.71 |
| 38 | 38.33 | 38.98 | 42.33 | 40.90 | 43.15 | 39.85 | 42.68 | 43.31 | 39.01 |
| 39 | 0.51 | 0.51 | 0.17 | 0.39 | 0.21 | 0.19 | 0.48 | 0.37 | 0.42 |
| 40 | 5.34 | 5.12 | 8.05 | 5.88 | 12.46 | 9.02 | 3.50 | 2.98 | 4.58 |
| 41 | 6.02 | 5.91 | 8.50 | 6.75 | 13.05 | 9.58 | 4.67 | 3.61 | 5.89 |
| 42 | 0.68 | 0.78 | 0.46 | 0.87 | 0.58 | 0.56 | 1.17 | 0.63 | 1.31 |
| 43 | 22.11 | 16.77 | 9.19 | 104.44 | 3.24 | 22.00 | 9.97 | 18.58 | 29.27 |
| 44 | 83.14 | 107.79 | 88.68 | 135.91 | 90.76 | 123.95 | 86.06 | 85.20 | 113.10 |
| 45 | 52.78 | 64.49 | 56.59 | 64.37 | 53.21 | 71.66 | 55.61 | 52.96 | 69.83 |
| 46 | 21.63 | 21.94 | 21.57 | 22.01 | 20.99 | 28.60 | 21.35 | 20.81 | 24.68 |
| 47 | 4.83 | 6.31 | 5.16 | 7.78 | 5.28 | 5.49 | 5.04 | 5.07 | 5.77 |
| 48 | 0.10 | 0.11 | 0.11 | 0.09 | 0.09 | 0.11 | | | |
| 49 | 1.31 | 1.19 | 1.29 | 1.46 | 1.21 | 1.21 | | | |
| 50 | 89.40 | 75.73 | 92.10 | 94.30 | 150.80 | 110.73 | 99.20 | 84.00 | 99.00 |
| 51 | 154.90 | 122.02 | 130.51 | 241.11 | 69.03 | 186.41 | 62.11 | 39.02 | 58.94 |
| 52 | 207.99 | 138.02 | 255.41 | 402.22 | 233.55 | 391.75 | 89.31 | 50.61 | 87.02 |
| 53 | 40.58 | 40.88 | 45.01 | 42.30 | 45.24 | 40.56 | 44.80 | 45.07 | 40.65 |
| 54 | 0.42 | 0.47 | 0.42 | 0.37 | 0.23 | 0.31 | 0.41 | 0.44 | 0.40 |
| 55 | 5.13 | 3.38 | 5.67 | 9.51 | 5.16 | 9.66 | 1.99 | 1.12 | 2.14 |

Table 30: Provided are the values of each of the parameters (as described in Table 29 above) measured in *Sorghum* accessions (ecotype) under normal, low nitrogen and drought conditions. Growth conditions are specified in the experimental procedure section.

TABLE 31

Additional measured parameters in Sorghum accessions (Lines 10-17)

| Ecotype/ Correlation ID No. | Line-10 | Line-11 | Line-12 | Line-13 | Line-14 | Line-15 | Line-16 | Line-17 |
|---|---|---|---|---|---|---|---|---|
| 1 | 38.36 | 32.10 | 32.69 | 32.79 | 51.53 | 35.71 | 38.31 | 42.44 |
| 2 | 60.00 | 45.45 | 58.19 | 70.60 | 70.10 | 53.95 | 59.87 | 52.65 |
| 3 | 169.03 | 156.10 | 112.14 | 154.74 | 171.70 | 168.51 | 162.51 | 170.46 |
| 4 | 71.40 | 68.56 | 56.44 | 67.79 | 71.54 | 78.94 | 67.03 | 74.11 |
| 5 | 28.82 | 28.13 | 22.97 | 28.09 | 30.00 | 30.54 | 27.17 | 29.26 |

TABLE 31-continued

Additional measured parameters in Sorghum accessions (Lines 10-17)

| Ecotype/ Correlation ID No. | Line-10 | Line-11 | Line-12 | Line-13 | Line-14 | Line-15 | Line-16 | Line-17 |
|---|---|---|---|---|---|---|---|---|
| 6 | 7.42 | 6.98 | 6.19 | 7.02 | 7.18 | 7.00 | 7.39 | 7.35 |
| 7 | 0.12 | 0.12 | 0.11 | 0.12 | 0.11 | 0.10 | 0.11 | 0.11 |
| 8 | 1.24 | 1.32 | 1.22 | 1.18 | 1.18 | 1.22 | 1.25 | 1.22 |
| 9 | 0.79 | 0.77 | 0.80 | 0.81 | 0.82 | 0.81 | 0.82 | 0.82 |
| 10 | 0.93 | 0.91 | 0.92 | 0.90 | 0.91 | 0.90 | 0.91 | 0.91 |
| 11 | 0.92 | 0.89 | 0.91 | 0.91 | 0.91 | 0.90 | 0.90 | 0.91 |
| 12 | 0.85 | 0.86 | 0.88 | 0.90 | 0.90 | 0.91 | 0.90 | 0.90 |
| 13 | 97.50 | 98.00 | 100.00 | 105.60 | 151.15 | 117.10 | 124.45 | 126.50 |
| 14 | 328.95 | 391.00 | 435.75 | 429.50 | 441.00 | 415.75 | 429.50 | 428.50 |
| 15 | 102.75 | 82.33 | 77.59 | 91.17 | 150.44 | 109.10 | 107.58 | 130.88 |
| 16 | 128.97 | 97.62 | 99.32 | 112.24 | 157.42 | 130.55 | 135.66 | 209.21 |
| 17 | 45.59 | 44.83 | 45.33 | 46.54 | 43.99 | 45.09 | 45.14 | 43.13 |
| 18 | 0.44 | 0.46 | 0.45 | 0.45 | 0.51 | 0.46 | 0.44 | 0.39 |
| 19 | 0.72 | 0.72 | 0.70 | 1.17 | 0.79 | 0.85 | 0.98 | |
| 20 | 2.89 | 2.91 | 3.12 | 4.75 | 3.69 | 3.85 | 5.84 | |
| 21 | 2.18 | 2.19 | 2.41 | 3.58 | 2.90 | 3.01 | 4.85 | |
| 22 | 36.84 | 29.45 | 26.70 | 29.42 | 51.12 | 37.04 | 39.85 | 41.78 |
| 23 | 57.58 | 42.93 | 36.47 | 68.60 | 71.80 | 49.27 | 43.87 | 52.07 |
| 24 | 136.71 | 137.70 | 96.54 | 158.19 | 163.95 | 138.39 | 135.46 | 165.64 |
| 25 | 66.17 | 67.37 | 57.90 | 70.61 | 73.76 | 66.87 | 65.40 | 75.97 |
| 26 | 26.31 | 25.43 | 23.11 | 27.87 | 28.88 | 27.64 | 25.52 | 30.33 |
| 27 | 6.59 | 6.85 | 5.32 | 7.25 | 7.19 | 6.27 | 6.57 | 6.82 |
| 28 | 0.13 | 0.13 | 0.12 | 0.12 | 0.11 | 0.11 | 0.12 | 0.11 |
| 29 | 1.22 | 1.24 | 1.19 | 1.23 | 1.16 | 1.34 | 1.21 | 1.21 |
| 30 | 0.77 | 0.74 | 0.80 | 0.79 | 0.82 | 0.80 | 0.81 | 0.81 |
| 31 | 0.91 | 0.89 | 0.90 | 0.90 | 0.91 | 0.89 | 0.90 | 0.90 |
| 32 | 0.91 | 0.89 | 0.90 | 0.89 | 0.91 | 0.89 | 0.89 | 0.90 |
| 33 | 0.86 | 0.84 | 0.90 | 0.89 | 0.91 | 0.90 | 0.90 | 0.90 |
| 34 | 94.53 | 110.00 | 115.07 | 104.73 | 173.67 | 115.60 | 138.80 | 144.40 |
| 35 | 437.67 | 383.00 | 375.00 | 425.00 | 434.00 | 408.67 | 378.50 | 432.00 |
| 36 | 99.83 | 76.95 | 84.25 | 92.24 | 138.83 | 113.32 | 95.50 | 129.49 |
| 37 | 124.27 | 101.33 | 132.12 | 117.90 | 176.99 | 143.67 | 126.98 | 180.45 |
| 38 | 42.71 | 40.08 | 43.98 | 45.44 | 44.75 | 42.58 | 43.81 | 46.73 |
| 39 | 0.44 | 0.43 | 0.39 | 0.44 | 0.44 | 0.44 | 0.43 | 0.42 |
| 40 | 2.91 | 2.53 | 3.00 | 2.60 | 3.96 | 3.38 | 2.90 | 3.86 |
| 41 | 3.77 | 3.26 | 3.61 | 3.24 | 5.10 | 4.25 | 3.81 | 4.76 |
| 42 | 0.86 | 0.73 | 0.61 | 0.65 | 1.14 | 0.87 | 0.91 | 0.89 |
| 43 | 10.45 | 14.77 | 12.86 | 18.24 | 11.60 | 18.65 | 16.36 | |
| 44 | 100.79 | 80.41 | 126.89 | 86.41 | 92.29 | 77.89 | 76.93 | |
| 45 | 65.14 | 55.27 | 69.06 | 53.32 | 56.29 | 49.12 | 51.88 | |
| 46 | 24.28 | 21.95 | 24.98 | 19.49 | 20.42 | 16.81 | 18.88 | |
| 47 | 5.37 | 4.66 | 6.35 | 5.58 | 5.76 | 5.86 | 5.10 | |
| 50 | 92.20 | 81.93 | 98.80 | 86.47 | 99.60 | 83.00 | 83.53 | 92.30 |
| 51 | 76.37 | 33.47 | 42.20 | 41.53 | 131.67 | 60.84 | 44.33 | 185.44 |
| 52 | 120.43 | 37.21 | 48.18 | 44.20 | 231.60 | 116.01 | 123.08 | 342.50 |
| 53 | 45.43 | 42.58 | 44.18 | 44.60 | 42.41 | 43.25 | 40.30 | 40.75 |
| 54 | 0.44 | 0.47 | 0.47 | 0.48 | 0.35 | 0.35 | 0.23 | 0.33 |
| 55 | 2.65 | 0.87 | 1.09 | 0.99 | 5.46 | 2.68 | 3.05 | 8.40 |

Table 31: Provided are the values of each of the parameters (as described above) measured in Sorghum accessions (ecotype) under normal, low nitrogen and drought conditions. Growth conditions are specified in the experimental procedure section.

TABLE 32

Correlation between the expression level of selected genes of some embodiments of the invention in various tissues and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYD423 | 0.77 | 8.63E−03 | 6 | 13 | LYD423 | 0.72 | 1.85E−02 | 6 | 15 |
| LYD423 | 0.80 | 5.31E−03 | 6 | 16 | LYD423 | 0.81 | 4.12E−03 | 6 | 1 |
| LYD423 | 0.94 | 6.58E−05 | 2 | 29 | LYD423 | 0.84 | 2.13E−03 | 4 | 55 |
| LYD423 | 0.70 | 2.37E−02 | 4 | 51 | LYD423 | 0.84 | 2.18E−03 | 4 | 52 |
| LYD423 | 0.91 | 2.94E−04 | 5 | 36 | LYD423 | 0.73 | 1.72E−02 | 5 | 30 |
| LYD423 | 0.86 | 1.23E−03 | 5 | 41 | LYD423 | 0.91 | 2.82E−04 | 5 | 40 |
| LYD423 | 0.71 | 2.20E−02 | 5 | 39 | LYD423 | 0.85 | 2.08E−03 | 5 | 32 |
| LYD423 | 0.89 | 5.04E−04 | 5 | 37 | LYD423 | 0.76 | 1.15E−02 | 3 | 7 |
| LYD423 | 0.72 | 2.95E−02 | 7 | 44 | LYD423 | 0.76 | 1.81E−02 | 7 | 47 |
| LYD424 | 0.86 | 1.41E−03 | 6 | 13 | LYD424 | 0.72 | 1.87E−02 | 6 | 1 |

TABLE 32-continued

Correlation between the expression level of selected genes of some embodiments of the invention in various tissues and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYD424 | 0.83 | 2.76E−03 | 4 | 55 | LYD424 | 0.80 | 5.92E−03 | 4 | 51 |
| LYD424 | 0.84 | 2.20E−03 | 4 | 52 | LYD425 | 0.82 | 3.55E−03 | 6 | 13 |
| LYD425 | 0.84 | 2.37E−03 | 6 | 1 | LYD425 | 0.73 | 1.58E−02 | 5 | 35 |
| LYD425 | 0.71 | 2.25E−02 | 5 | 22 | LYD425 | 0.85 | 1.74E−03 | 1 | 55 |
| LYD425 | 0.72 | 1.95E−02 | 1 | 51 | LYD425 | 0.86 | 1.32E−03 | 1 | 52 |
| LYD427 | 0.77 | 9.39E−03 | 6 | 13 | LYD427 | 0.87 | 1.03E−03 | 6 | 1 |
| LYD427 | 0.73 | 1.75E−02 | 6 | 2 | LYD427 | 0.71 | 2.11E−02 | 6 | 11 |
| LYD427 | 0.89 | 4.79E−04 | 9 | 2 | LYD427 | 0.82 | 4.05E−03 | 4 | 55 |
| LYD427 | 0.72 | 1.87E−02 | 4 | 51 | LYD427 | 0.82 | 3.41E−03 | 4 | 52 |
| LYD427 | 0.71 | 2.16E−02 | 5 | 30 | LYD427 | 0.73 | 1.58E−02 | 5 | 37 |
| LYD427 | 0.81 | 4.42E−03 | 3 | 2 | LYD427 | 0.71 | 2.05E−02 | 1 | 50 |
| LYD428 | 0.73 | 1.59E−02 | 2 | 34 | LYD431 | 0.74 | 1.42E−02 | 6 | 13 |
| LYD431 | 0.87 | 9.18E−04 | 4 | 55 | LYD431 | 0.72 | 1.85E−02 | 4 | 51 |
| LYD431 | 0.86 | 1.24E−03 | 4 | 52 | LYD432 | 0.71 | 2.07E−02 | 6 | 8 |
| LYD432 | 0.70 | 2.31E−02 | 6 | 7 | LYD432 | 0.79 | 6.56E−03 | 2 | 34 |
| LYD432 | 0.83 | 3.06E−03 | 8 | 28 | LYD432 | 0.72 | 1.85E−02 | 3 | 2 |
| LYD432 | 0.73 | 1.69E−02 | 1 | 53 | LYD433 | 0.73 | 1.60E−02 | 6 | 5 |
| LYD433 | 0.81 | 4.12E−03 | 6 | 2 | LYD433 | 0.70 | 3.45E−02 | 4 | 44 |
| LYD433 | 0.70 | 2.39E−02 | 5 | 30 | LYD434 | 0.73 | 1.56E−02 | 6 | 13 |
| LYD434 | 0.74 | 1.35E−02 | 4 | 55 | LYD434 | 0.79 | 6.92E−03 | 4 | 51 |
| LYD434 | 0.75 | 1.29E−02 | 4 | 52 | LYD434 | 0.91 | 7.59E−04 | 7 | 44 |
| LYD434 | 0.81 | 7.61E−03 | 7 | 47 | LYD434 | 0.91 | 6.53E−04 | 7 | 45 |
| LYD434 | 0.72 | 2.77E−02 | 7 | 46 | LYD435 | 0.76 | 9.94E−03 | 6 | 7 |
| LYD435 | 0.72 | 1.97E−02 | 9 | 1 | LYD436 | 0.85 | 1.95E−03 | 6 | 13 |
| LYD436 | 0.77 | 9.58E−03 | 6 | 1 | LYD436 | 0.92 | 1.39E−04 | 4 | 55 |
| LYD436 | 0.84 | 2.39E−03 | 4 | 51 | LYD436 | 0.93 | 1.13E−04 | 4 | 52 |
| LYD436 | 0.77 | 9.25E−03 | 8 | 28 | LYD436 | 0.75 | 1.17E−02 | 5 | 37 |
| LYD507 | 0.71 | 2.17E−02 | 9 | 1 | LYD507 | 0.77 | 8.97E−03 | 8 | 32 |
| LYD507 | 0.74 | 1.54E−02 | 8 | 31 | LYD508 | 0.76 | 1.03E−02 | 6 | 1 |
| LYD508 | 0.75 | 1.16E−02 | 4 | 55 | LYD508 | 0.77 | 9.61E−03 | 4 | 52 |
| LYD508 | 0.77 | 8.64E−03 | 5 | 22 | LYD508 | 0.71 | 2.11E−02 | 5 | 42 |
| LYD508 | 0.73 | 1.72E−02 | 3 | 16 | LYD509 | 0.81 | 4.73E−03 | 6 | 8 |
| LYD509 | 0.71 | 2.16E−02 | 9 | 13 | LYD509 | 0.80 | 4.97E−03 | 9 | 1 |
| LYD509 | 0.74 | 2.22E−02 | 7 | 44 | LYD509 | 0.78 | 1.38E−02 | 7 | 47 |
| LYD509 | 0.71 | 3.30E−02 | 1 | 44 | LYD509 | 0.70 | 3.41E−02 | 1 | 45 |
| LYD509 | 0.81 | 7.56E−03 | 1 | 46 | LYD510 | 0.79 | 6.74E−03 | 6 | 13 |
| LYD510 | 0.73 | 1.76E−02 | 6 | 18 | LYD510 | 0.71 | 2.21E−02 | 6 | 4 |
| LYD510 | 0.73 | 1.68E−02 | 6 | 5 | LYD510 | 0.75 | 1.17E−02 | 6 | 1 |
| LYD510 | 0.87 | 1.03E−03 | 4 | 55 | LYD510 | 0.75 | 1.33E−02 | 4 | 51 |
| LYD510 | 0.87 | 9.50E−04 | 4 | 52 | LYD510 | 0.75 | 1.32E−02 | 5 | 37 |

Table 32. Provided are the correlations (R) between the expression levels of yield improving genes and their homologues in tissues[Flag leaf, Flower meristem, stem and Flower; Expression sets (Exp)] and the phenotypic performance in various yield, biomass, growth rate and/or vigor components [Correlation vector (corr.) ID] under stress conditions or normal conditions across Sorghum accessions.
P = p value.

Example 8

Production of Maize Transcriptom and High Throughput Correlation Analysis with Yield and NUE Related Parameters Using 60K Maize Oligonucleotide Micro-Arrays In order to produce a high throughput correlation analysis between plant phenotype and gene expression level, the present inventors utilized a maize oligonucleotide microarray, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 60,000 maize genes and transcripts.

Correlation of Maize Hybrids Across Ecotypes Grown Under Regular Growth Conditions Experimental Procedures 12 Maize hybrids were grown in 3 repetitive plots, in field. Maize seeds were planted and plants were grown in the field using commercial fertilization and irrigation protocols. In order to define correlations between the levels of RNA expression with stress and yield components or vigor related parameters, the 12 different maize hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Analyzed Maize tissues—All 10 selected maize hybrids were sampled per 3 time points (TP2=V6-V8, TP5=R1-R2, TP6=R3-R4). Four types of plant tissues [Ear, flag leaf indicated in Table 33 as "leaf", grain distal part, and internode] growing under Normal conditions were sampled and RNA was extracted as described above. Each micro-array expression information tissue type has received a Set ID as summarized in Table 33 below.

TABLE 33

Maize transcriptom expression sets under normal conditions

| Expression Set | Set ID |
|---|---|
| Ear at reproductive stage (R1-R2) | 1 |
| Leaf at reproductive stage (R3-R4) | 2 |
| Leaf at vegetative stage (V2-V3) | 3 |
| Internode at vegetative stage (V2-V3) | 4 |
| Internode at reproductive stage (R3-R4) | 5 |
| Ear at reproductive stage (R3-R4) | 6 |
| Internode at reproductive stage (R1-R2) | 7 |
| Leaf at reproductive stage (R1-R2) | 8 |

Table 33: Provided are the identification (ID) number of each of the Maize expression sets. Leaf = the leaf below the main ear; Ear = the female flower at the anthesis day; Internodes= internodes located above and below the main ear in the plant.

The following parameters were collected using digital imaging system:

Grain Area (cm$^2$)—At the end of the growing period the grains were separated from the ear. A sample of ~200 grains were weighted, photographed and images were processed using the below described image processing system. The grain area was measured from those images and was divided by the number (Num) of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area (cm$^2$)—At the end of the growing period 5 ears were, photographed and images were processed using the below described image processing system. The Ear area was measured from those images and was divided by the number of Ears.

Ear Length and Ear Width (cm)—At the end of the growing period 5 ears were, photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—At the end of the experiment all ears from plots within blocks A-C were collected. Six ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located.

Leaf number per plant—Plants were characterized for leaf number during growing period at 5 time points. In each measure, plants were measured for their leaf number by counting all the leaves of 3 selected plants per plot.

Relative Growth Rate of leaf number—was calculated using Formula IX (above).

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Dry weight per plant—At the end of the experiment (when inflorescence were dry) all vegetative material from plots within blocks A-C were collected.

Dry weight=total weight of the vegetative portion above ground (excluding roots) after drying at 70° C. in oven for 48 hours.

Harvest Index (HI) (Maize)—The harvest index was calculated using Formula X.

Harvest Index=Average grain dry weight per Ear/ (Average vegetative dry weight per Ear+Average Ear dry weight).

Percent Filled Ear [%]—it was calculated as the percentage of the Ear area with grains out of the total ear.

Filled per Whole Ear—it was calculated as the length of the ear with grains out of the total ear.

Cob diameter [cm]—The diameter of the cob without grains was measured using a ruler.

Kernel Row Number per Ear—The number of rows in each ear was counted.

Experimental Results 12 different maize hybrids were grown and characterized for different parameters. The correlated parameters are described in Table 34 below. The average for each of the measured parameter was calculated using the JMP software (Tables 35-36) and a subsequent correlation analysis was performed (Table 37). Results were then integrated to the database.

TABLE 34

Maize correlated parameters (vectors)

| Correlated parameter with | Correlation ID |
|---|---|
| Growth Rate Leaf Num (ratio) | 1 |
| Plant Height per Plot (cm) | 2 |
| Ear Height (cm) | 3 |
| Leaf Number per Plant(number) | 4 |
| Ear Length (cm) | 5 |
| Percent Filled Ear (percent) | 6 |
| Cob Diameter (mm) | 7 |
| Kernel Row Number per Ear(number) | 8 |
| DW per Plant based on 6 (gr). | 9 |
| Ear FW per Plant based on 6 (gr). | 10 |
| Normalized Grain Weight per plant based on 6 (gr). | 11 |
| Ears FW per plant based on all (gr). | 12 |
| Normalized Grain Weight per Plant based on all (gr). | 13 |
| Ear Area (cm$^2$) | 14 |
| Ear Width (cm) | 15 |
| Filled per Whole Ear (percent) | 16 |
| Grain Area (cm$^2$) | 17 |
| Grain Length (cm) | 18 |
| Grain Width (cm) | 19 |

TABLE 34-continued

| Maize correlated parameters (vectors) | |
|---|---|
| Correlated parameter with | Correlation ID |
| SPAD 46DPS TP2 | 20 |
| SPAD 54DPS TP5 | 21 |

Table 34. SPAD 46DPS and SPAD 54DPS: Chlorophyl level after 46 and 54 days after sowing (DPS). "FW" = fresh weight; "DW" = dry weight.

TABLE 35

Measured parameters in Maize accessions under normal conditions (lines 1-6)

| Ecotype/Correlation ID No. | Line-1 | Line-2 | Line-3 | Line-4 | Line-5 | Line-6 |
|---|---|---|---|---|---|---|
| 1 | 0.283 | 0.221 | 0.281 | 0.269 | 0.306 | 0.244 |
| 2 | 278.083 | 260.500 | 275.133 | 238.500 | 286.944 | 224.833 |
| 3 | 135.167 | 122.333 | 131.967 | 114.000 | 135.278 | 94.278 |
| 4 | 12.000 | 11.110 | 11.689 | 11.778 | 11.944 | 12.333 |
| 5 | 19.691 | 19.055 | 20.521 | 21.344 | 20.920 | 18.232 |
| 6 | 80.624 | 86.760 | 82.144 | 92.708 | 80.377 | 82.757 |
| 7 | 28.957 | 25.078 | 28.052 | 25.732 | 28.715 | 25.783 |
| 8 | 16.167 | 14.667 | 16.200 | 15.889 | 16.167 | 15.167 |
| 9 | 657.500 | 491.667 | 641.111 | 580.556 | 655.556 | 569.444 |
| 10 | 245.833 | 208.333 | 262.222 | 263.889 | 272.222 | 177.778 |
| 11 | 140.683 | 139.536 | 153.667 | 176.983 | 156.614 | 119.667 |
| 12 | 278.194 | 217.502 | 288.280 | 247.879 | 280.106 | 175.841 |
| 13 | 153.900 | 135.882 | 152.500 | 159.156 | 140.463 | 117.135 |
| 14 | 85.058 | 85.843 | 90.507 | 95.953 | 91.624 | 72.408 |
| 15 | 5.584 | 5.151 | 5.671 | 5.533 | 5.728 | 5.227 |
| 16 | 0.916 | 0.922 | 0.927 | 0.917 | 0.908 | 0.950 |
| 17 | 0.753 | 0.708 | 0.755 | 0.766 | 0.806 | 0.713 |
| 18 | 1.167 | 1.092 | 1.180 | 1.205 | 1.228 | 1.123 |
| 19 | 0.810 | 0.814 | 0.803 | 0.803 | 0.824 | 0.803 |
| 20 | 51.667 | 56.406 | 53.547 | 55.211 | 55.300 | 59.350 |
| 21 | 54.283 | 57.178 | 56.011 | 59.682 | 54.767 | 59.144 |

Table 35. Provided are the values of each of the parameters (as described above) measured in maize accessions (Seed ID) under regular growth conditions. Growth conditions are specified in the experimental procedure section.

TABLE 36

Additional measured parameters in Maize accessions under regular growth conditions (lines 7-12)

| Ecotype/Correlation ID No. | Line-7 | Line-8 | Line-9 | Line-10 | Line-11 | Line-12 |
|---|---|---|---|---|---|---|
| 1 | 0.244 | 0.266 | 0.194 | 0.301 | | |
| 2 | 264.444 | 251.611 | 163.778 | 278.444 | | |
| 3 | 120.944 | 107.722 | 60.444 | 112.500 | | |
| 4 | 12.444 | 12.222 | 9.278 | 12.556 | | |
| 5 | 19.017 | 18.572 | 16.689 | 21.702 | | |
| 6 | 73.248 | 81.061 | 81.056 | 91.601 | | |
| 7 | 26.432 | 25.192 | 26.668 | | | |
| 8 | 16.000 | 14.833 | 14.267 | 15.389 | | |
| 9 | 511.111 | 544.444 | 574.167 | 522.222 | | |
| 10 | 188.889 | 197.222 | 141.111 | 261.111 | | |
| 11 | 119.692 | 133.508 | 54.316 | 173.231 | | |
| 12 | 192.474 | 204.700 | 142.716 | 264.236 | | |
| 13 | 123.237 | 131.266 | 40.844 | 170.662 | | |
| 14 | 74.032 | 76.534 | 55.201 | 95.360 | | |
| 15 | 5.221 | 5.328 | 4.120 | 5.577 | | |
| 16 | 0.873 | 0.939 | 0.796 | 0.958 | | |
| 17 | 0.714 | 0.753 | 0.502 | 0.762 | | |
| 18 | 1.139 | 1.134 | 0.921 | 1.180 | | |
| 19 | 0.791 | 0.837 | 0.675 | 0.812 | | |
| 20 | 58.483 | 55.876 | 53.856 | 59.747 | 52.983 | 49.994 |
| 21 | 57.994 | 60.356 | 51.394 | 61.139 | 54.767 | 53.344 |

Table 36. Provided are the values of each of the parameters (as described above) measured in maize accessions (Seed ID) under regular growth conditions. Growth conditions are specified in the experimental procedure section.

TABLE 37

Correlation between the expression level of selected LYD genes of some embodiments of the invention in various tissues and the phenotypic performance under normal across maize accessions

| Gene Name | R | P value | Exp. set | Corr. Set ID | Gene Name | R | P value | Exp. set | Corr. Set ID |
|---|---|---|---|---|---|---|---|---|---|
| LYD391 | 0.75 | 3.14E−02 | 5 | 19 | LYD391 | 0.82 | 2.28E−02 | 7 | 14 |
| LYD391 | 0.75 | 5.23E−02 | 7 | 13 | LYD391 | 0.81 | 2.86E−02 | 7 | 2 |
| LYD391 | 0.92 | 3.41E−03 | 7 | 3 | LYD391 | 0.82 | 2.50E−02 | 7 | 12 |
| LYD391 | 0.77 | 4.39E−02 | 7 | 10 | LYD391 | 0.74 | 5.55E−02 | 7 | 11 |
| LYD391 | 0.93 | 6.47E−03 | 1 | 7 | LYD391 | 0.80 | 5.59E−02 | 6 | 19 |
| LYD503 | 0.81 | 2.75E−02 | 7 | 4 | LYD503 | 0.81 | 2.88E−02 | 7 | 16 |
| LYD503 | 0.76 | 4.79E−02 | 7 | 2 | LYD503 | 0.86 | 1.26E−02 | 7 | 19 |
| LYD503 | 0.89 | 6.73E−03 | 8 | 4 | LYD503 | 0.88 | 9.13E−03 | 8 | 21 |
| LYD503 | 0.71 | 7.16E−02 | 8 | 18 | LYD503 | 0.85 | 1.61E−02 | 8 | 16 |
| LYD503 | 0.72 | 6.56E−02 | 8 | 17 | LYD503 | 0.71 | 7.11E−02 | 8 | 19 |
| LYD503 | 0.75 | 5.03E−02 | 1 | 14 | LYD503 | 0.71 | 7.51E−02 | 1 | 13 |
| LYD503 | 0.79 | 3.45E−02 | 1 | 2 | LYD503 | 0.88 | 9.31E−03 | 1 | 3 |
| LYD503 | 0.70 | 7.77E−02 | 1 | 15 | LYD503 | 0.82 | 2.43E−02 | 1 | 12 |
| LYD503 | 0.73 | 6.20E−02 | 1 | 10 | LYD503 | 0.91 | 1.30E−02 | 6 | 4 |

Table 37. "Corr. ID"—correlation set ID according to the correlated parameters Table 34 above.
"Exp. Set"—Expression set.
"R" = Pearson correlation coefficient;
"P" = p value.

Example 9

Production of Soybean (*Glycine max*) Transcriptom and High Throughput Correlation Analysis with Yield Parameters Using 44K B. Soybean Oligonucleotide Micro-Arrays In order to produce a high throughput correlation analysis, the present inventors utilized a Soybean oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 42,000 Soybean genes and transcripts. In order to define correlations between the levels of RNA expression with yield components or plant architecture related parameters or plant vigor related parameters, various plant characteristics of 29 different *Glycine max* varieties were analyzed and 12 varieties were further used for RNA expression analysis. The correlation between the RNA levels and the characterized parameters was analyzed using Pearson correlation test.

Correlation of *Glycine max* Genes' Expression Levels with Phenotypic Characteristics Across Ecotype Experimental Procedures 29 Soybean varieties were grown in three repetitive plots, in field. Briefly, the growing protocol was as follows: Soybean seeds were sown in soil and grown under normal conditions until harvest. In order to define correlations between the levels of RNA expression with yield components or plant architecture related parameters or vigor related parameters, 12 different Soybean varieties (out of 29 varieties) were analyzed and used for gene expression analyses. Analysis was performed at two pre-determined time periods: at pod set (when the soybean pods are formed) and at harvest time (when the soybean pods are ready for harvest, with mature seeds). Table 39 describes the soybean correlated parameters. The average for each of the measured parameter was calculated using the JMP software (Tables 40-41) and a subsequent correlation analysis was performed (Table 42). Results were then integrated to the database.

TABLE 38

Soybean transcriptom expression sets

| Expression Set | Set ID |
|---|---|
| Apical meristem at vegetative stage under normal growth condition | 1 |
| Leaf at vegetative stage under normal growth condition | 2 |
| Leaf at flowering stage under normal growth condition | 3 |
| Leaf at pod setting stage under normal growth condition | 4 |
| Root at vegetative stage under normal growth condition | 5 |
| Root at flowering stage under normal growth condition | 6 |
| Root at pod setting stage under normal growth condition | 7 |
| Stem at vegetative stage under normal growth condition | 8 |
| Stem at pod setting stage under normal growth condition | 9 |
| Flower bud at flowering stage under normal growth condition | 10 |
| Pod (R3-R4) at pod setting stage under normal growth condition | 11 |

Table 38: Provided are the soybean transcriptom expression sets.

RNA extraction—All 12 selected Soybean varieties were sample per treatment. Plant tissues [leaf, root. Stem. Pod, apical meristem. Flower buds] growing under normal conditions were sampled and RNA was extracted as described above.

The collected data parameters were as follows:

Main branch base diameter [mm] at pod set—the diameter of the base of the main branch (based diameter) average of three plants per plot.

Fresh weight [gr/plant] at pod set—total weight of the vegetative portion above ground (excluding roots) before drying at pod set, average of three plants per plot.

Dry weight [gr/plant] at pod set—total weight of the vegetative portion above ground (excluding roots) after drying at 70° C. in oven for 48 hours at pod set, average of three plants per plot.

Total number of nodes with pods on lateral branches [value/plant]—counting of nodes which contain pods in lateral branches at pod set, average of three plants per plot.

Number of lateral branches at pod set [value/plant]—counting number of lateral branches at pod set, average of three plants per plot.

Total weight of lateral branches at pod set [gr/plant]—weight all lateral branches at pod set, average of three plants per plot.

Total weight of pods on main stem at pod set [gr/plant]—weight all pods on main stem at pod set, average of three plants per plot.

Total number of nodes on main stem [value/plant]—count of number of nodes on main stem starting from first node above ground, average of three plants per plot.

Total number of pods with 1 seed on lateral branches at pod set [value/plant]—count the number of pods containing 1 seed in all lateral branches at pod set, average of three plants per plot.

Total number of pods with 2 seeds on lateral branches at pod set [value/plant]—count the number of pods containing 2 seeds in all lateral branches at pod set, average of three plants per plot.

Total number of pods with 3 seeds on lateral branches at pod set [value/plant]—count the number of pods containing 3 seeds in all lateral branches at pod set, average of three plants per plot.

Total number of pods with 4 seeds on lateral branches at pod set [value/plant]—count the number of pods containing 4 seeds in all lateral branches at pod set, average of three plants per plot.

Total number of pods with 1 seed on main stem at pod set [value/plant]—count the number of pods containing 1 seed in main stem at pod set, average of three plants per plot.

Total number of pods with 2 seeds on main stem at pod set [value/plant]—count the number of pods containing 2 seeds in main stem at pod set, average of three plants per plot.

Total number of pods with 3 seeds on main stem at pod set [value/plant]—count the number of pods containing 3 seeds in main stem at pod set, average of three plants per plot.

Total number of pods with 4 seeds on main stem at pod set [value/plant]—count the number of pods containing 4 seeds in main stem at pod set, average of three plants per plot.

Total number of seeds per plant at pod set [value/plant]—count number of seeds in lateral branches and main stem at pod set, average of three plants per plot.

Total number of seeds on lateral branches at pod set [value/plant]—count total number of seeds on lateral branches at pod set, average of three plants per plot.

Total number of seeds on main stem at pod set [value/plant]—count total number of seeds on main stem at pod set, average of three plants per plot.

Plant height at pod set [cm/plant]—total length from above ground till the tip of the main stem at pod set, average of three plants per plot.

Plant height at harvest [cm/plant]—total length from above ground till the tip of the main stem at harvest, average of three plants per plot.

Total weight of pods on lateral branches at pod set [gr/plant]—weight of all pods on lateral branches at pod set, average of three plants per plot.

Ratio of the number of pods per node on main stem at pod set—calculated in formula XI, average of three plants per plot.

$$\text{Total number of pods on main stem/Total number of nodes on main stem, average of three plants per plot.} \quad \text{Formula XI:}$$

Ratio of total number of seeds in main stem to number of seeds on lateral branches—calculated in formula XII, average of three plants per plot.

$$\text{Total number of seeds on main stem at pod set/Total number of seeds on lateral branches at pod set.} \quad \text{Formula XII:}$$

Total weight of pods per plant at pod set [gr/plant]—weight all pods on lateral branches and main stem at pod set, average of three plants per plot.

Days till 50% flowering [days]—number of days till 50% flowering for each plot.

Days till 100% flowering [days]—number of days till 100% flowering for each plot.

Maturity [days]—measure as 95% of the pods in a plot have ripened (turned 100% brown). Delayed leaf drop and green stems are not considered in assigning maturity. Tests are observed 3 days per week, every other day, for maturity. The maturity date is the date that 95% of the pods have reached final color. Maturity is expressed in days after August 31 [according to the accepted definition of maturity in USA, Descriptor list for SOYBEAN, Hypertext Transfer Protocol://World Wide Web (dot) ars-grin (dot) gov/cgi-bin/npgs/html/desclist (dot) pl?51].

Seed quality [ranked 1-5]—measure at harvest, A visual estimate based on several hundred seeds. Parameter is rated according to the following scores considering the amount and degree of wrinkling, defective coat (cracks), greenishness, and moldy or other pigment. Rating is 1-very good, 2-good, 3-fair, 4-poor, 5-very poor.

Lodging [ranked 1-5]—is rated at maturity per plot according to the following scores: 1-most plants in a plot are erected, 2-All plants leaning slightly or a few plants down, 3-all plants leaning moderately, or 25%-50% down, 4-all plants leaning considerably, or 50%-80% down, 5-most plants down. Note: intermediate score such as 1.5 are acceptable.

Seed size [gr.]—weight of 1000 seeds per plot normalized to 13% moisture, measure at harvest.

Total weight of seeds per plant [gr./plant]—calculated at harvest (per 2 inner rows of a trimmed plot) as weight in grams of cleaned seeds adjusted to 13% moisture and divided by the total number of plants in two inner rows of a trimmed plot.

Yield at harvest [bushels/hectare]—calculated at harvest (per 2 inner rows of a trimmed plot) as weight in grams of cleaned seeds, adjusted to 13% moisture, and then expressed as bushels per acre.

Average lateral branch seeds per pod [number]—Calculate Num of Seeds on lateral branches—at pod set and divide by the Number of Total number of pods with seeds on lateral branches—at pod set.

Average main stem seeds per pod [number]—Calculate Total Number of Seeds on main stem at pod set and divide by the Number of Total number of pods with seeds on main stem at pod setting.

Main stem average internode length [cm]—Calculate Plant height at pod set and divide by the Total number of nodes on main stem at pod setting.

Total number of pods with seeds on main stem [number]—count all pods containing seeds on the main stem at pod setting.

Total number of pods with seeds on lateral branches [number]—count all pods containing seeds on the lateral branches at pod setting.

Total number of pods per plant at pod set [number]—count pods on main stem and lateral branches at pod setting.

Experimental Results

Twelve different Soybean varieties were grown and characterized for 40 parameters as specified in Table 39 below. The average for each of the measured parameters was calculated using the JMP software and values are summarized in Tables 40-41 below. Subsequent correlation analysis between the various transcriptom expression sets and the average parameters was conducted (Table 42). Results were then integrated to the database.

TABLE 39

Soybean correlated parameters (vectors)

| Correlated parameter with | Correlation ID |
|---|---|
| Base diameter at pod set (mm) | 1 |
| DW at pod set (gr.) | 2 |
| fresh weight at pod set (gr.) | 3 |
| Total number of nodes with pods on lateral branches (number) | 4 |
| Num of lateral branches (number) | 5 |
| Total weight of lateral branches at pod set (gr.) | 6 |
| Total weight of pods on main stem at pod set (gr.) | 7 |
| Total number of nodes on main stem (number) | 8 |
| Total no of pods with 1 seed on lateral branch (number) | 9 |
| Num of pods with 1 seed on main stem at pod set (number) | 10 |
| Total no of pods with 2 seed on lateral branch (number) | 11 |
| Num of pods with 2 seed on main stem (number) | 12 |
| Total no of pods with 3 seed on lateral branch (number) | 13 |
| Num of pods with 3 seed on main stem (number) | 14 |
| Total no of pods with 4 seed on lateral branch (number) | 15 |
| Num of pods with 4 seed on main stem (number) | 16 |
| Total number of seeds per plant | 17 |
| Total Number of Seeds on lateral branches | 18 |
| Total Number of Seeds on main stem at pod set | 19 |
| Plant height at pod set (cm) | 20 |
| Total weight of pods on lateral branches (gr.) | 21 |
| Ratio number of pods per node on main stem (ratio) | 22 |
| Ratio number of seeds per main stem to seeds per lateral branch (ratio) | 23 |
| Total weight of pods per plant (gr.) | 24 |
| 50 percent flowering (days) | 25 |
| Maturity (days) | 26 |
| 100 percent flowering (days) | 27 |
| Plant height at harvest (cm) | 28 |
| Seed quality (score 1-5) | 29 |
| Total weight of seeds per plant (gr./plant) | 30 |
| Seed size (gr.) | 31 |
| Lodging (score 1-5) | 32 |
| yield at harvest (bushel/hectare) | 33 |
| Average lateral branch seeds per pod (number) | 34 |
| Average main stem seeds per pod (number) | 35 |
| Total number of pods with seeds on main stem at pod set (number) | 36 |
| Num pods with seeds on lateral branches-at pod set (number) | 37 |
| Total number of pods per plant at pod set (number) | 38 |
| Main stem average internode length (cm/number) | 39 |
| Corrected Seed size (gr.) | 40 |

Table 39.

TABLE 40

Measured parameters in Soybean varieties (lines 1-6)

| Ecotype/ Correlation ID No. | Line 1 | Line 2 | Line 3 | Line 4 | Line 5 | Line 6 |
|---|---|---|---|---|---|---|
| 1 | 8.33 | 9.54 | 9.68 | 8.11 | 8.82 | 10.12 |
| 2 | 53.67 | 50.33 | 38.00 | 46.17 | 60.83 | 55.67 |
| 3 | 170.89 | 198.22 | 152.56 | 163.89 | 224.67 | 265.00 |
| 4 | 23.00 | 16.00 | 23.11 | 33.00 | 15.22 | 45.25 |
| 5 | 9.00 | 8.67 | 9.11 | 9.89 | 7.67 | 17.56 |
| 6 | 67.78 | 63.78 | 64.89 | 74.89 | 54.00 | 167.22 |
| 7 | 22.11 | 14.33 | 16.00 | 15.00 | 33.78 | 9.00 |
| 8 | 16.56 | 16.78 | 16.11 | 18.11 | 16.78 | 17.11 |
| 9 | 1.56 | 3.00 | 1.78 | 1.78 | 5.67 | 5.63 |
| 10 | 1.11 | 4.38 | 1.44 | 1.44 | 4.56 | 1.67 |
| 11 | 17.00 | 18.75 | 26.44 | 32.33 | 21.56 | 33.50 |
| 12 | 16.89 | 16.25 | 13.22 | 16.89 | 27.00 | 8.11 |
| 13 | 38.44 | 2.00 | 26.44 | 31.33 | 8.89 | 82.00 |
| 14 | 29.56 | 1.75 | 19.78 | 22.33 | 11.67 | 22.78 |
| 15 | 0.00 | 0.00 | 0.00 | 0.00 | 0.00 | 1.50 |
| 16 | 0.00 | 0.00 | 0.11 | 0.11 | 0.00 | 0.44 |
| 17 | 274.44 | 99.78 | 221.67 | 263.11 | 169.00 | 412.50 |
| 18 | 150.89 | 55.89 | 134.00 | 160.44 | 75.44 | 324.63 |
| 19 | 123.56 | 43.89 | 87.67 | 102.67 | 93.56 | 88.00 |
| 20 | 86.78 | 69.56 | 62.44 | 70.89 | 69.44 | 63.89 |
| 21 | 26.00 | 14.89 | 20.11 | 20.11 | 21.11 | 30.25 |
| 22 | 2.87 | 1.38 | 2.13 | 2.26 | 2.60 | 1.87 |
| 23 | 0.89 | 0.90 | 0.87 | 0.89 | 2.32 | 0.37 |
| 24 | 48.11 | 29.22 | 36.11 | 35.11 | 54.89 | 38.88 |
| 25 | 61.00 | 65.33 | 60.67 | 61.00 | 54.67 | 68.33 |
| 26 | 24.00 | 43.67 | 30.33 | 30.33 | 38.33 | 40.00 |
| 27 | 67.33 | 71.67 | 67.67 | 67.33 | 60.00 | 74.00 |
| 28 | 96.67 | 76.67 | 67.50 | 75.83 | 74.17 | 76.67 |
| 29 | 2.33 | 3.50 | 3.00 | 2.17 | 2.83 | 2.00 |
| 30 | 15.09 | 10.50 | 17.23 | 16.51 | 12.06 | 10.25 |
| 31 | 89.00 | 219.33 | 93.00 | 86.00 | 191.33 | 71.33 |
| 32 | 1.67 | 1.83 | 1.17 | 1.67 | 2.67 | 2.83 |
| 33 | 47.57 | 43.77 | 50.37 | 56.30 | 44.00 | 40.33 |
| 34 | 2.67 | 1.95 | 2.43 | 2.53 | 2.13 | 2.68 |
| 35 | 2.60 | 1.89 | 2.52 | 2.53 | 2.17 | 2.59 |
| 36 | 47.56 | 23.11 | 34.56 | 40.78 | 43.22 | 33.00 |
| 37 | 57.00 | 28.56 | 54.67 | 65.44 | 36.11 | 122.63 |
| 38 | 104.56 | 51.67 | 89.22 | 106.22 | 79.33 | 155.63 |
| 39 | 5.24 | 4.15 | 3.91 | 3.92 | 4.15 | 3.74 |
| 40 | 89.00 | * | 93.00 | 86.00 | * | 71.33 |

Table 40.

TABLE 41

Measured parameters in Soybean varieties (lines 7-12)

| Ecotype/ Correlation ID No. | Line 7 | Line 8 | Line 9 | Line 10 | Line 11 | Line 12 |
|---|---|---|---|---|---|---|
| 1 | 8.46 | 8.09 | 8.26 | 7.73 | 8.16 | 7.89 |
| 2 | 48.00 | 52.00 | 44.17 | 52.67 | 56.00 | 47.50 |
| 3 | 160.67 | 196.33 | 155.33 | 178.11 | 204.44 | 164.22 |
| 4 | 8.25 | 25.44 | 21.88 | 16.33 | 22.56 | 24.22 |
| 5 | 11.67 | 12.11 | 8.00 | 9.11 | 6.78 | 10.00 |
| 6 | 45.44 | 83.22 | 64.33 | 52.00 | 76.89 | 67.00 |
| 7 | 9.03 | 16.00 | 15.89 | 14.56 | 30.44 | 18.00 |
| 8 | 18.78 | 18.89 | 16.78 | 21.11 | 19.33 | 20.78 |
| 9 | 2.88 | 3.00 | 1.25 | 2.67 | 1.78 | 3.00 |
| 10 | 4.00 | 4.33 | 2.11 | 1.89 | 3.44 | 1.22 |
| 11 | 8.50 | 22.78 | 21.75 | 10.67 | 23.78 | 25.67 |
| 12 | 21.33 | 17.67 | 20.33 | 16.11 | 28.11 | 16.56 |
| 13 | 9.00 | 42.11 | 32.75 | 25.67 | 45.00 | 44.33 |
| 14 | 11.11 | 28.22 | 24.11 | 36.44 | 39.67 | 32.33 |
| 15 | 0.00 | 0.33 | 0.00 | 1.11 | 0.00 | 0.00 |
| 16 | 0.00 | 0.56 | 0.00 | 3.89 | 0.00 | 0.00 |
| 17 | 136.00 | 302.78 | 260.50 | 264.44 | 363.00 | 318.67 |
| 18 | 46.88 | 176.22 | 143.00 | 105.44 | 184.33 | 187.33 |
| 19 | 80.00 | 126.56 | 115.11 | 159.00 | 178.67 | 131.33 |
| 20 | 89.78 | 82.11 | 70.56 | 101.67 | 79.56 | 67.22 |
| 21 | 4.13 | 20.11 | 17.00 | 9.22 | 28.11 | 22.56 |
| 22 | 1.98 | 2.71 | 2.78 | 2.75 | 3.70 | 2.84 |
| 23 | 3.90 | 0.78 | 1.18 | 1.98 | 1.03 | 0.83 |
| 24 | 14.25 | 36.11 | 32.75 | 23.78 | 58.56 | 40.56 |
| 25 | 66.50 | 65.67 | 62.33 | 67.67 | 61.67 | 64.33 |
| 26 | 41.00 | 38.33 | 31.00 | 39.00 | 27.33 | 32.67 |
| 27 | 73.00 | 72.33 | 68.67 | 73.67 | 68.00 | 70.67 |
| 28 | 101.67 | 98.33 | 75.83 | 116.67 | 76.67 | 71.67 |
| 29 | 3.50 | 2.50 | 2.17 | 2.33 | 2.17 | 2.17 |
| 30 | 7.30 | 11.38 | 15.68 | 10.83 | 12.98 | 15.16 |
| 31 | 88.00 | 75.00 | 80.67 | 75.67 | 76.33 | 77.33 |
| 32 | 2.67 | 2.50 | 1.83 | 3.50 | 3.33 | 1.50 |
| 33 | 34.23 | 44.27 | 53.67 | 42.47 | 43.60 | 52.20 |
| 34 | 2.12 | 2.58 | 2.58 | 2.67 | 2.62 | 2.58 |
| 35 | 2.22 | 2.49 | 2.47 | 2.71 | 2.51 | 2.61 |
| 36 | 36.44 | 50.78 | 43.63 | 58.33 | 71.22 | 50.11 |

TABLE 41-continued

Measured parameters in Soybean varieties (lines 7-12)

| Ecotype/Correlation ID No. | Line 7 | Line 8 | Line 9 | Line 10 | Line 11 | Line 12 |
|---|---|---|---|---|---|---|
| 37 | 20.38 | 68.22 | 55.75 | 40.11 | 70.56 | 73.00 |
| 38 | 61.00 | 119.00 | 103.25 | 98.44 | 141.78 | 123.11 |
| 39 | 4.80 | 4.36 | 4.20 | 4.82 | 4.12 | 3.83 |
| 40 | 88.00 | 75.00 | 80.67 | 75.67 | 76.33 | 77.33 |

Table 41.

TABLE 42

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LYD437 | 0.71 | 2.10E−02 | 5 | 23 | LYD437 | 0.76 | 2.79E−02 | 9 | 14 |
| LYD437 | 0.84 | 9.58E−03 | 9 | 19 | LYD437 | 0.85 | 7.25E−03 | 9 | 22 |
| LYD437 | 0.73 | 7.53E−03 | 4 | 30 | LYD437 | 0.71 | 9.26E−03 | 4 | 33 |
| LYD438 | 0.86 | 1.38E−03 | 8 | 30 | LYD438 | 0.81 | 4.31E−03 | 8 | 33 |
| LYD438 | 0.71 | 1.02E−02 | 10 | 4 | LYD438 | 0.71 | 9.94E−03 | 10 | 17 |
| LYD439 | 0.79 | 6.84E−03 | 7 | 11 | LYD439 | 0.74 | 1.43E−02 | 8 | 3 |
| LYD439 | 0.79 | 7.01E−03 | 8 | 15 | LYD439 | 0.72 | 2.01E−02 | 8 | 9 |
| LYD439 | 0.82 | 4.05E−03 | 8 | 31 | LYD439 | 0.78 | 2.19E−02 | 9 | 30 |
| LYD439 | 0.73 | 3.97E−02 | 9 | 33 | LYD439 | 0.75 | 3.09E−02 | 9 | 19 |
| LYD439 | 0.82 | 1.18E−02 | 9 | 22 | LYD439 | 0.72 | 4.40E−02 | 9 | 7 |
| LYD439 | 0.76 | 6.38E−03 | 2 | 31 | LYD439 | 0.71 | 1.02E−02 | 10 | 3 |
| LYD440 | 0.84 | 2.29E−03 | 7 | 23 | LYD440 | 0.78 | 8.30E−03 | 7 | 30 |
| LYD440 | 0.76 | 1.02E−02 | 7 | 33 | LYD440 | 0.73 | 1.67E−02 | 7 | 31 |
| LYD440 | 0.76 | 4.52E−03 | 11 | 30 | LYD440 | 0.79 | 2.22E−03 | 11 | 33 |
| LYD440 | 0.81 | 4.12E−03 | 5 | 7 | LYD440 | 0.76 | 1.04E−02 | 8 | 15 |
| LYD440 | 0.71 | 4.81E−02 | 9 | 23 | LYD440 | 0.75 | 3.33E−02 | 9 | 33 |
| LYD440 | 0.76 | 2.84E−02 | 9 | 7 | LYD440 | 0.74 | 8.79E−03 | 2 | 31 |
| LYD440 | 0.79 | 2.00E−03 | 4 | 7 | LYD441 | 0.71 | 2.10E−02 | 7 | 18 |
| LYD441 | 0.80 | 5.65E−03 | 7 | 3 | LYD441 | 0.87 | 9.46E−04 | 7 | 6 |
| LYD441 | 0.77 | 9.62E−03 | 7 | 4 | LYD441 | 0.76 | 4.21E−03 | 11 | 30 |
| LYD441 | 0.83 | 7.65E−04 | 11 | 33 | LYD441 | 0.75 | 1.26E−02 | 5 | 3 |
| LYD441 | 0.83 | 2.98E−03 | 5 | 6 | LYD441 | 0.91 | 2.85E−04 | 5 | 1 |
| LYD441 | 0.72 | 1.88E−02 | 8 | 23 | LYD441 | 0.81 | 1.42E−02 | 9 | 25 |
| LYD441 | 0.84 | 8.80E−03 | 9 | 15 | LYD441 | 0.71 | 5.03E−02 | 9 | 6 |
| LYD441 | 0.93 | 8.95E−04 | 9 | 5 | LYD441 | 0.77 | 2.44E−02 | 9 | 27 |
| LYD441 | 0.83 | 1.08E−02 | 9 | 9 | LYD441 | 0.81 | 2.55E−03 | 2 | 31 |
| LYD441 | 0.77 | 3.63E−03 | 10 | 15 | LYD442 | 0.77 | 3.12E−03 | 11 | 30 |
| LYD442 | 0.86 | 3.26E−04 | 11 | 33 | LYD442 | 0.82 | 1.23E−02 | 9 | 5 |
| LYD442 | 0.80 | 1.92E−03 | 4 | 25 | LYD442 | 0.78 | 2.57E−03 | 4 | 27 |
| LYD443 | 0.74 | 1.49E−02 | 7 | 26 | LYD443 | 0.77 | 8.47E−03 | 7 | 3 |
| LYD443 | 0.78 | 7.44E−03 | 7 | 1 | LYD443 | 0.81 | 4.94E−03 | 7 | 9 |
| LYD443 | 0.78 | 3.05E−03 | 11 | 30 | LYD443 | 0.76 | 4.41E−03 | 11 | 33 |
| LYD443 | 0.77 | 8.92E−03 | 8 | 15 | LYD443 | 0.71 | 2.04E−02 | 8 | 28 |
| LYD443 | 0.73 | 1.60E−02 | 8 | 6 | LYD443 | 0.83 | 3.21E−03 | 8 | 5 |
| LYD443 | 0.80 | 1.64E−02 | 9 | 12 | LYD443 | 0.77 | 2.49E−02 | 9 | 31 |
| LYD443 | 0.80 | 2.99E−03 | 2 | 31 | LYD443 | 0.74 | 5.78E−03 | 10 | 32 |
| LYD445 | 0.74 | 1.39E−02 | 5 | 14 | LYD445 | 0.89 | 5.63E−04 | 5 | 13 |
| LYD445 | 0.88 | 8.05E−04 | 5 | 18 | LYD445 | 0.80 | 5.31E−03 | 5 | 11 |
| LYD445 | 0.80 | 5.46E−03 | 5 | 4 | LYD445 | 0.94 | 7.06E−05 | 5 | 17 |
| LYD445 | 0.71 | 2.28E−02 | 5 | 9 | LYD445 | 0.77 | 9.00E−03 | 8 | 13 |
| LYD445 | 0.77 | 8.50E−03 | 8 | 18 | LYD445 | 0.72 | 1.84E−02 | 8 | 4 |
| LYD445 | 0.73 | 1.62E−02 | 8 | 17 | LYD445 | 0.87 | 5.49E−03 | 9 | 30 |
| LYD445 | 0.75 | 3.37E−02 | 9 | 33 | LYD445 | 0.73 | 3.82E−02 | 9 | 12 |
| LYD445 | 0.80 | 1.61E−02 | 9 | 22 | LYD445 | 0.74 | 3.72E−02 | 9 | 7 |
| LYD445 | 0.75 | 4.89E−03 | 4 | 9 | LYD445 | 0.74 | 6.41E−03 | 1 | 3 |
| LYD445 | 0.80 | 1.66E−03 | 1 | 15 | LYD445 | 0.76 | 3.95E−03 | 1 | 6 |
| LYD445 | 0.71 | 9.11E−03 | 1 | 4 | LYD445 | 0.80 | 1.87E−03 | 10 | 13 |
| LYD445 | 0.76 | 3.87E−03 | 10 | 18 | LYD445 | 0.83 | 8.99E−04 | 10 | 17 |
| LYD446 | 0.92 | 1.56E−04 | 5 | 14 | LYD446 | 0.90 | 4.07E−04 | 5 | 19 |
| LYD446 | 0.75 | 1.29E−02 | 5 | 22 | LYD446 | 0.77 | 9.54E−03 | 5 | 17 |
| LYD446 | 0.71 | 2.07E−02 | 8 | 14 | LYD446 | 0.71 | 2.21E−02 | 8 | 30 |
| LYD446 | 0.84 | 2.62E−03 | 8 | 13 | LYD446 | 0.85 | 1.64E−03 | 8 | 18 |
| LYD446 | 0.76 | 1.05E−02 | 8 | 3 | LYD446 | 0.84 | 2.44E−03 | 8 | 15 |
| LYD446 | 0.92 | 1.63E−04 | 8 | 6 | LYD446 | 0.73 | 1.65E−02 | 8 | 5 |
| LYD446 | 0.89 | 5.06E−04 | 8 | 4 | LYD446 | 0.74 | 1.35E−02 | 8 | 17 |
| LYD446 | 0.72 | 4.46E−02 | 9 | 30 | LYD446 | 0.76 | 2.75E−02 | 9 | 33 |
| LYD446 | 0.73 | 7.17E−03 | 10 | 13 | LYD446 | 0.76 | 3.96E−03 | 10 | 18 |

TABLE 42-continued

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LYD446 | 0.75 | 5.36E−03 | 10 | 6 | LYD446 | 0.73 | 7.15E−03 | 10 | 5 |
| LYD446 | 0.74 | 5.80E−03 | 10 | 4 | LYD447 | 0.85 | 1.75E−03 | 7 | 9 |
| LYD447 | 0.76 | 1.09E−02 | 5 | 30 | LYD447 | 0.81 | 4.88E−03 | 5 | 33 |
| LYD447 | 0.76 | 1.02E−02 | 5 | 13 | LYD447 | 0.73 | 1.73E−02 | 5 | 18 |
| LYD447 | 0.81 | 4.43E−03 | 5 | 17 | LYD447 | 0.82 | 3.68E−03 | 8 | 13 |
| LYD447 | 0.78 | 8.36E−03 | 8 | 18 | LYD447 | 0.75 | 1.28E−02 | 8 | 5 |
| LYD447 | 0.73 | 1.67E−02 | 8 | 4 | LYD447 | 0.71 | 2.20E−02 | 8 | 17 |
| LYD447 | 0.81 | 1.46E−02 | 9 | 1 | LYD447 | 0.71 | 9.48E−03 | 10 | 14 |
| LYD448 | 0.71 | 8.97E−03 | 10 | 18 | LYD449 | 0.74 | 5.72E−03 | 11 | 1 |
| LYD449 | 0.84 | 2.61E−03 | 5 | 13 | LYD449 | 0.84 | 2.54E−03 | 5 | 18 |
| LYD449 | 0.72 | 1.97E−02 | 5 | 11 | LYD449 | 0.71 | 2.09E−02 | 5 | 3 |
| LYD449 | 0.80 | 5.74E−03 | 5 | 15 | LYD449 | 0.89 | 4.94E−04 | 5 | 6 |
| LYD449 | 0.79 | 6.50E−03 | 5 | 5 | LYD449 | 0.84 | 2.53E−03 | 5 | 4 |
| LYD449 | 0.71 | 2.13E−02 | 5 | 1 | LYD449 | 0.76 | 1.09E−02 | 5 | 17 |
| LYD449 | 0.80 | 5.69E−03 | 8 | 13 | LYD449 | 0.83 | 2.98E−03 | 8 | 18 |
| LYD449 | 0.83 | 3.13E−03 | 8 | 11 | LYD449 | 0.71 | 2.07E−02 | 8 | 3 |
| LYD449 | 0.72 | 1.88E−02 | 8 | 15 | LYD449 | 0.75 | 1.22E−02 | 8 | 6 |
| LYD449 | 0.85 | 1.93E−03 | 8 | 4 | LYD449 | 0.75 | 1.20E−02 | 8 | 21 |
| LYD449 | 0.75 | 1.31E−02 | 8 | 17 | LYD449 | 0.77 | 9.18E−03 | 8 | 9 |
| LYD449 | 0.76 | 2.78E−02 | 9 | 30 | LYD449 | 0.73 | 3.86E−02 | 9 | 33 |
| LYD449 | 0.72 | 1.31E−02 | 2 | 1 | LYD449 | 0.87 | 2.18E−04 | 1 | 1 |
| LYD449 | 0.80 | 1.58E−03 | 10 | 13 | LYD449 | 0.82 | 9.57E−04 | 10 | 18 |
| LYD449 | 0.72 | 8.90E−03 | 10 | 11 | LYD449 | 0.79 | 2.43E−03 | 10 | 4 |
| LYD449 | 0.74 | 5.57E−03 | 10 | 17 | LYD450 | 0.79 | 6.69E−03 | 7 | 29 |
| LYD450 | 0.71 | 2.08E−02 | 7 | 10 | LYD450 | 0.78 | 2.78E−03 | 11 | 30 |
| LYD450 | 0.84 | 5.95E−04 | 11 | 33 | LYD450 | 0.77 | 9.22E−03 | 5 | 29 |
| LYD450 | 0.71 | 1.02E−02 | 10 | 17 | LYD451 | 0.74 | 1.42E−02 | 7 | 3 |
| LYD451 | 0.84 | 2.49E−03 | 7 | 9 | LYD451 | 0.73 | 1.62E−02 | 5 | 22 |
| LYD451 | 0.74 | 1.53E−02 | 8 | 16 | LYD451 | 0.91 | 3.10E−04 | 8 | 15 |
| LYD451 | 0.81 | 4.43E−03 | 8 | 31 | LYD451 | 0.73 | 4.05E−02 | 9 | 3 |
| LYD451 | 0.87 | 4.57E−03 | 9 | 15 | LYD451 | 0.80 | 1.63E−02 | 9 | 6 |
| LYD451 | 0.84 | 8.79E−03 | 9 | 5 | LYD451 | 0.81 | 1.39E−02 | 9 | 1 |
| LYD451 | 0.82 | 1.32E−02 | 9 | 9 | LYD451 | 0.86 | 6.35E−03 | 9 | 31 |
| LYD452 | 0.71 | 1.04E−02 | 11 | 12 | LYD452 | 0.71 | 2.09E−02 | 5 | 13 |
| LYD452 | 0.73 | 1.58E−02 | 5 | 18 | LYD452 | 0.83 | 3.18E−03 | 5 | 15 |
| LYD452 | 0.74 | 1.51E−02 | 5 | 6 | LYD452 | 0.80 | 5.59E−03 | 5 | 4 |
| LYD452 | 0.80 | 5.69E−03 | 8 | 13 | LYD452 | 0.83 | 2.98E−03 | 8 | 18 |
| LYD452 | 0.72 | 1.86E−02 | 8 | 11 | LYD452 | 0.72 | 1.88E−02 | 8 | 15 |
| LYD452 | 0.76 | 1.13E−02 | 8 | 6 | LYD452 | 0.85 | 1.93E−03 | 8 | 4 |
| LYD452 | 0.75 | 1.31E−02 | 8 | 17 | LYD452 | 0.83 | 1.11E−02 | 9 | 30 |
| LYD452 | 0.82 | 1.19E−02 | 9 | 33 | LYD452 | 0.86 | 3.76E−04 | 1 | 3 |
| LYD452 | 0.76 | 4.29E−03 | 1 | 6 | LYD452 | 0.71 | 9.90E−03 | 10 | 14 |
| LYD452 | 0.76 | 4.05E−03 | 10 | 13 | LYD452 | 0.80 | 1.84E−03 | 10 | 18 |
| LYD452 | 0.70 | 1.10E−02 | 10 | 11 | LYD452 | 0.72 | 8.81E−03 | 10 | 19 |
| LYD452 | 0.79 | 2.43E−03 | 10 | 4 | LYD452 | 0.72 | 7.85E−03 | 10 | 17 |
| LYD453 | 0.85 | 4.98E−04 | 11 | 30 | LYD453 | 0.72 | 8.84E−03 | 11 | 33 |
| LYD453 | 0.75 | 1.34E−02 | 5 | 1 | LYD453 | 0.81 | 4.59E−03 | 8 | 31 |
| LYD453 | 0.76 | 2.90E−02 | 9 | 30 | LYD453 | 0.70 | 1.09E−02 | 1 | 12 |
| LYD453 | 0.71 | 9.90E−03 | 1 | 7 | LYD453 | 0.74 | 5.81E−03 | 10 | 11 |
| LYD454 | 0.86 | 1.55E−03 | 7 | 30 | LYD454 | 0.88 | 6.89E−04 | 7 | 33 |
| LYD454 | 0.71 | 9.99E−03 | 11 | 30 | LYD454 | 0.72 | 8.14E−03 | 11 | 33 |
| LYD454 | 0.71 | 4.67E−02 | 9 | 14 | LYD454 | 0.74 | 3.42E−02 | 9 | 30 |
| LYD454 | 0.79 | 2.08E−02 | 9 | 24 | LYD454 | 0.70 | 5.13E−02 | 9 | 19 |
| LYD454 | 0.75 | 3.24E−02 | 9 | 22 | LYD454 | 0.73 | 3.78E−02 | 9 | 7 |
| LYD454 | 0.76 | 4.31E−03 | 1 | 9 | LYD455 | 0.77 | 2.41E−02 | 9 | 14 |
| LYD455 | 0.71 | 4.73E−02 | 9 | 30 | LYD455 | 0.85 | 7.57E−03 | 9 | 19 |
| LYD455 | 0.89 | 3.40E−03 | 9 | 22 | LYD455 | 0.72 | 4.49E−02 | 9 | 7 |
| LYD455 | 0.72 | 8.28E−03 | 10 | 14 | LYD455 | 0.71 | 1.01E−02 | 10 | 19 |
| LYD456 | 0.73 | 1.59E−02 | 7 | 33 | LYD456 | 0.72 | 1.89E−02 | 8 | 30 |
| LYD456 | 0.74 | 1.51E−02 | 8 | 33 | LYD456 | 0.77 | 2.40E−02 | 9 | 33 |
| LYD456 | 0.70 | 1.12E−02 | 10 | 33 | LYD458 | 0.74 | 1.54E−02 | 7 | 15 |
| LYD458 | 0.77 | 3.18E−03 | 11 | 30 | LYD458 | 0.79 | 2.45E−03 | 11 | 33 |
| LYD458 | 0.78 | 7.66E−03 | 8 | 14 | LYD458 | 0.72 | 4.25E−02 | 9 | 21 |
| LYD458 | 0.72 | 8.47E−03 | 4 | 30 | LYD458 | 0.76 | 4.03E−03 | 10 | 30 |
| LYD458 | 0.78 | 2.91E−03 | 10 | 33 | LYD459 | 0.75 | 1.16E−02 | 7 | 13 |
| LYD459 | 0.75 | 1.28E−02 | 7 | 18 | LYD459 | 0.73 | 1.74E−02 | 7 | 3 |
| LYD459 | 0.76 | 1.13E−02 | 7 | 15 | LYD459 | 0.75 | 1.32E−02 | 7 | 4 |
| LYD459 | 0.74 | 1.47E−02 | 7 | 17 | LYD459 | 0.71 | 1.02E−02 | 11 | 30 |
| LYD459 | 0.71 | 1.03E−02 | 11 | 33 | LYD459 | 0.75 | 1.24E−02 | 5 | 13 |
| LYD459 | 0.79 | 6.80E−03 | 5 | 18 | LYD459 | 0.83 | 2.69E−03 | 5 | 6 |
| LYD459 | 0.85 | 1.97E−03 | 5 | 4 | LYD459 | 0.73 | 1.70E−02 | 5 | 21 |
| LYD459 | 0.87 | 9.66E−04 | 8 | 23 | LYD459 | 0.91 | 1.75E−03 | 9 | 16 |

TABLE 42-continued

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LYD459 | 0.78 | 2.26E−02 | 9 | 13 | LYD459 | 0.77 | 2.67E−02 | 9 | 18 |
| LYD459 | 0.87 | 5.14E−03 | 9 | 15 | LYD459 | 0.84 | 8.68E−03 | 9 | 6 |
| LYD459 | 0.74 | 3.58E−02 | 9 | 5 | LYD459 | 0.82 | 1.24E−02 | 9 | 4 |
| LYD459 | 0.79 | 3.82E−03 | 2 | 14 | LYD459 | 0.73 | 1.15E−02 | 2 | 13 |
| LYD459 | 0.71 | 1.51E−02 | 2 | 17 | LYD459 | 0.77 | 3.18E−03 | 10 | 13 |
| LYD459 | 0.82 | 1.07E−03 | 10 | 18 | LYD459 | 0.80 | 1.89E−03 | 10 | 11 |
| LYD459 | 0.73 | 6.67E−03 | 10 | 6 | LYD459 | 0.88 | 1.34E−04 | 10 | 4 |
| LYD460 | 0.77 | 3.26E−03 | 11 | 33 | LYD460 | 0.72 | 1.87E−02 | 5 | 18 |
| LYD460 | 0.75 | 1.31E−02 | 5 | 11 | LYD460 | 0.74 | 1.36E−02 | 5 | 6 |
| LYD460 | 0.77 | 8.54E−03 | 5 | 4 | LYD460 | 0.87 | 1.06E−03 | 8 | 1 |
| LYD460 | 0.73 | 1.64E−02 | 8 | 31 | LYD460 | 0.73 | 3.86E−02 | 9 | 25 |
| LYD460 | 0.81 | 1.50E−02 | 9 | 15 | LYD460 | 0.92 | 1.31E−03 | 9 | 5 |
| LYD460 | 0.73 | 3.79E−02 | 9 | 27 | LYD460 | 0.74 | 3.67E−02 | 9 | 9 |
| LYD461 | 0.73 | 1.56E−02 | 5 | 14 | LYD461 | 0.87 | 1.04E−03 | 5 | 16 |
| LYD461 | 0.83 | 2.91E−03 | 5 | 19 | LYD461 | 0.79 | 6.99E−03 | 5 | 20 |
| LYD461 | 0.75 | 1.24E−02 | 8 | 16 | LYD461 | 0.72 | 2.00E−02 | 8 | 28 |
| LYD461 | 0.82 | 1.26E−02 | 9 | 30 | LYD461 | 0.76 | 3.02E−02 | 9 | 33 |
| LYD461 | 0.72 | 8.13E−03 | 10 | 1 | LYD461 | 0.72 | 8.18E−03 | 10 | 9 |
| LYD462 | 0.80 | 4.97E−03 | 7 | 1 | LYD462 | 0.77 | 8.82E−03 | 5 | 31 |
| LYD462 | 0.79 | 6.57E−03 | 8 | 13 | LYD462 | 0.83 | 2.86E−03 | 8 | 18 |
| LYD462 | 0.84 | 2.63E−03 | 8 | 11 | LYD462 | 0.80 | 4.98E−03 | 8 | 6 |
| LYD462 | 0.82 | 3.73E−03 | 8 | 4 | LYD462 | 0.71 | 2.22E−02 | 8 | 21 |
| LYD462 | 0.73 | 6.65E−03 | 10 | 3 | LYD462 | 0.86 | 3.56E−04 | 10 | 6 |
| LYD462 | 0.75 | 4.62E−03 | 10 | 5 | LYD462 | 0.71 | 9.09E−03 | 10 | 4 |
| LYD465 | 0.75 | 1.32E−02 | 8 | 14 | LYD465 | 0.79 | 6.48E−03 | 8 | 8 |
| LYD465 | 0.90 | 2.48E−03 | 9 | 23 | LYD465 | 0.71 | 4.93E−02 | 9 | 29 |
| LYD465 | 0.78 | 2.36E−02 | 9 | 20 | LYD465 | 0.77 | 3.25E−03 | 10 | 14 |
| LYD465 | 0.70 | 1.09E−02 | 10 | 13 | LYD465 | 0.72 | 8.67E−03 | 10 | 18 |
| LYD465 | 0.72 | 8.23E−03 | 10 | 17 | LYD466 | 0.76 | 3.99E−03 | 11 | 30 |
| LYD466 | 0.72 | 8.54E−03 | 11 | 33 | LYD466 | 0.71 | 2.19E−02 | 8 | 22 |
| LYD466 | 0.72 | 4.42E−02 | 9 | 30 | LYD466 | 0.84 | 9.75E−03 | 9 | 13 |
| LYD466 | 0.80 | 1.68E−02 | 9 | 18 | LYD466 | 0.71 | 4.74E−02 | 9 | 4 |
| LYD466 | 0.81 | 1.54E−02 | 9 | 17 | LYD466 | 0.72 | 8.41E−03 | 10 | 30 |
| LYD467 | 0.73 | 1.61E−02 | 7 | 15 | LYD467 | 0.78 | 7.61E−03 | 7 | 5 |
| LYD467 | 0.70 | 2.36E−02 | 7 | 9 | LYD467 | 0.75 | 5.30E−03 | 11 | 30 |
| LYD467 | 0.83 | 7.26E−04 | 11 | 33 | LYD467 | 0.75 | 3.35E−02 | 9 | 3 |
| LYD467 | 0.91 | 1.66E−03 | 9 | 32 | LYD467 | 0.71 | 9.53E−03 | 10 | 33 |
| LYD468 | 0.76 | 4.49E−03 | 11 | 2 | LYD468 | 0.72 | 1.89E−02 | 5 | 3 |
| LYD468 | 0.82 | 3.59E−03 | 8 | 3 | LYD468 | 0.88 | 8.27E−04 | 8 | 15 |
| LYD468 | 0.77 | 9.51E−03 | 8 | 1 | LYD468 | 0.90 | 4.11E−04 | 8 | 9 |
| LYD468 | 0.79 | 1.99E−02 | 9 | 16 | LYD468 | 0.92 | 1.13E−03 | 9 | 3 |
| LYD468 | 0.92 | 1.05E−03 | 9 | 15 | LYD468 | 0.90 | 2.35E−03 | 9 | 6 |
| LYD468 | 0.84 | 8.94E−03 | 9 | 5 | LYD468 | 0.77 | 2.53E−02 | 9 | 4 |
| LYD468 | 0.77 | 2.57E−02 | 9 | 1 | LYD468 | 0.84 | 9.40E−03 | 9 | 9 |
| LYD468 | 0.78 | 2.36E−02 | 9 | 31 | LYD468 | 0.83 | 7.90E−04 | 4 | 3 |
| LYD468 | 0.80 | 1.87E−03 | 4 | 9 | LYD468 | 0.71 | 9.38E−03 | 1 | 1 |
| LYD469 | 0.76 | 2.98E−02 | 9 | 33 | LYD469 | 0.72 | 8.28E−03 | 4 | 31 |
| LYD469 | 0.79 | 2.34E−03 | 1 | 14 | LYD469 | 0.87 | 2.30E−04 | 1 | 19 |
| LYD469 | 0.84 | 6.80E−04 | 1 | 22 | LYD469 | 0.81 | 1.52E−03 | 1 | 20 |
| LYD469 | 0.74 | 5.47E−03 | 1 | 28 | LYD469 | 0.81 | 1.57E−03 | 10 | 13 |
| LYD469 | 0.81 | 1.29E−03 | 10 | 18 | LYD469 | 0.76 | 4.26E−03 | 10 | 15 |
| LYD469 | 0.82 | 1.09E−03 | 10 | 6 | LYD469 | 0.73 | 7.61E−03 | 10 | 4 |
| LYD469 | 0.71 | 9.96E−03 | 10 | 17 | LYD470 | 0.77 | 9.29E−03 | 7 | 30 |
| LYD470 | 0.86 | 1.56E−03 | 7 | 33 | LYD470 | 0.75 | 4.59E−03 | 11 | 30 |
| LYD470 | 0.80 | 1.72E−03 | 11 | 33 | LYD470 | 0.71 | 2.17E−02 | 8 | 14 |
| LYD470 | 0.72 | 4.21E−02 | 9 | 12 | LYD470 | 0.71 | 1.35E−02 | 2 | 13 |
| LYD471 | 0.71 | 9.41E−03 | 11 | 8 | LYD471 | 0.72 | 4.57E−02 | 9 | 30 |
| LYD471 | 0.83 | 9.21E−04 | 10 | 14 | LYD471 | 0.79 | 2.25E−03 | 10 | 13 |
| LYD471 | 0.75 | 4.99E−03 | 10 | 18 | LYD471 | 0.73 | 6.93E−03 | 10 | 19 |
| LYD471 | 0.82 | 9.63E−04 | 10 | 17 | LYD472 | 0.75 | 5.11E−03 | 11 | 30 |
| LYD472 | 0.76 | 3.89E−03 | 11 | 33 | LYD472 | 0.77 | 9.44E−03 | 5 | 1 |
| LYD472 | 0.84 | 2.35E−03 | 8 | 3 | LYD472 | 0.87 | 1.00E−03 | 8 | 9 |
| LYD472 | 0.76 | 3.87E−03 | 4 | 23 | LYD472 | 0.72 | 7.78E−03 | 10 | 33 |
| LYD473 | 0.71 | 2.08E−02 | 7 | 33 | LYD473 | 0.82 | 1.15E−03 | 11 | 30 |
| LYD473 | 0.75 | 4.94E−03 | 11 | 33 | LYD473 | 0.73 | 1.76E−02 | 8 | 14 |
| LYD473 | 0.70 | 2.29E−02 | 8 | 17 | LYD511 | 0.77 | 3.19E−03 | 11 | 30 |
| LYD511 | 0.74 | 1.46E−02 | 8 | 33 | LYD511 | 0.73 | 3.80E−02 | 9 | 11 |
| LYD511 | 0.73 | 4.10E−02 | 9 | 3 | LYD511 | 0.79 | 2.07E−02 | 9 | 15 |
| LYD511 | 0.82 | 1.35E−02 | 9 | 6 | LYD511 | 0.81 | 1.55E−02 | 9 | 4 |
| LYD511 | 0.71 | 4.90E−02 | 9 | 1 | LYD511 | 0.80 | 1.70E−02 | 9 | 9 |
| LYD512 | 0.82 | 3.84E−03 | 7 | 1 | LYD512 | 0.80 | 1.76E−02 | 9 | 30 |
| LYD512 | 0.78 | 2.26E−02 | 9 | 1 | LYD512 | 0.79 | 2.15E−03 | 1 | 9 |

TABLE 42-continued

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LYD512 | 0.70 | 1.10E−02 | 10 | 7 | LYD513 | 0.81 | 4.46E−03 | 7 | 14 |
| LYD513 | 0.77 | 9.82E−03 | 7 | 17 | LYD513 | 0.73 | 6.73E−03 | 11 | 30 |
| LYD513 | 0.75 | 3.10E−02 | 9 | 14 | LYD513 | 0.86 | 6.80E−03 | 9 | 30 |
| LYD513 | 0.78 | 2.18E−02 | 9 | 33 | LYD513 | 0.76 | 2.93E−02 | 9 | 24 |
| LYD513 | 0.71 | 9.31E−03 | 10 | 30 | LYD514 | 0.72 | 1.83E−02 | 7 | 33 |
| LYD514 | 0.77 | 8.89E−03 | 8 | 33 | LYD514 | 0.77 | 9.14E−03 | 8 | 16 |
| LYD514 | 0.87 | 5.28E−03 | 9 | 30 | LYD514 | 0.79 | 1.85E−02 | 9 | 33 |
| LYD514 | 0.79 | 1.94E−02 | 9 | 22 | LYD514 | 0.76 | 3.02E−02 | 9 | 7 |
| LYD514 | 0.73 | 6.55E−03 | 4 | 22 | LYD515 | 0.79 | 6.42E−03 | 7 | 31 |
| LYD515 | 0.70 | 1.10E−02 | 10 | 19 | LYD515 | 0.77 | 3.68E−03 | 10 | 22 |
| LYD515 | 0.71 | 9.80E−03 | 10 | 7 | LYD516 | 0.80 | 5.60E−03 | 5 | 11 |
| LYD516 | 0.78 | 8.06E−03 | 5 | 24 | LYD516 | 0.71 | 2.08E−02 | 5 | 1 |
| LYD516 | 0.70 | 5.24E−02 | 9 | 18 | LYD516 | 0.82 | 1.17E−02 | 9 | 11 |
| LYD516 | 0.79 | 1.85E−02 | 9 | 4 | LYD516 | 0.84 | 8.76E−03 | 9 | 21 |
| LYD516 | 0.71 | 1.44E−02 | 2 | 22 | LYD516 | 0.72 | 7.87E−03 | 10 | 18 |
| LYD516 | 0.82 | 1.08E−03 | 10 | 11 | LYD516 | 0.82 | 1.11E−03 | 10 | 4 |
| LYD516 | 0.75 | 5.39E−03 | 10 | 21 | LYD517 | 0.71 | 2.05E−02 | 7 | 19 |
| LYD517 | 0.74 | 1.41E−02 | 7 | 22 | LYD517 | 0.73 | 1.72E−02 | 7 | 6 |
| LYD517 | 0.72 | 1.84E−02 | 5 | 28 | LYD517 | 0.83 | 3.03E−03 | 8 | 13 |
| LYD517 | 0.82 | 3.63E−03 | 8 | 18 | LYD517 | 0.75 | 1.26E−02 | 8 | 6 |
| LYD517 | 0.82 | 3.99E−03 | 8 | 4 | LYD517 | 0.77 | 9.66E−03 | 8 | 17 |
| LYD517 | 0.79 | 2.08E−02 | 9 | 13 | LYD517 | 0.84 | 9.14E−03 | 9 | 18 |
| LYD517 | 0.96 | 1.54E−04 | 9 | 11 | LYD517 | 0.71 | 4.76E−02 | 9 | 6 |
| LYD517 | 0.82 | 1.25E−02 | 9 | 4 | LYD517 | 0.75 | 3.29E−02 | 9 | 21 |
| LYD517 | 0.78 | 2.36E−02 | 9 | 17 | LYD517 | 0.76 | 4.40E−03 | 1 | 23 |
| LYD518 | 0.74 | 6.32E−03 | 11 | 19 | LYD518 | 0.77 | 3.58E−03 | 11 | 22 |
| LYD518 | 0.82 | 3.68E−03 | 5 | 13 | LYD518 | 0.81 | 4.43E−03 | 5 | 18 |
| LYD518 | 0.74 | 1.53E−02 | 5 | 15 | LYD518 | 0.89 | 5.61E−04 | 5 | 6 |
| LYD518 | 0.87 | 1.09E−03 | 5 | 5 | LYD518 | 0.85 | 1.84E−03 | 5 | 4 |
| LYD518 | 0.80 | 5.64E−03 | 8 | 3 | LYD518 | 0.74 | 1.42E−02 | 8 | 15 |
| LYD518 | 0.87 | 1.03E−03 | 8 | 9 | LYD518 | 0.95 | 9.67E−06 | 2 | 16 |
| LYD518 | 0.93 | 3.97E−05 | 2 | 15 | LYD519 | 0.92 | 1.56E−04 | 5 | 14 |
| LYD519 | 0.76 | 1.02E−02 | 5 | 13 | LYD519 | 0.71 | 2.12E−02 | 5 | 18 |
| LYD519 | 0.90 | 4.07E−04 | 5 | 19 | LYD519 | 0.75 | 1.29E−02 | 5 | 22 |
| LYD519 | 0.89 | 6.26E−04 | 5 | 17 | LYD519 | 0.92 | 1.44E−04 | 8 | 13 |
| LYD519 | 0.93 | 8.02E−05 | 8 | 18 | LYD519 | 0.72 | 1.91E−02 | 8 | 11 |
| LYD519 | 0.76 | 1.05E−02 | 8 | 3 | LYD519 | 0.85 | 1.74E−03 | 8 | 15 |
| LYD519 | 0.92 | 1.63E−04 | 8 | 6 | LYD519 | 0.83 | 3.28E−03 | 8 | 5 |
| LYD519 | 0.94 | 6.38E−05 | 8 | 4 | LYD519 | 0.79 | 6.00E−03 | 8 | 17 |
| LYD519 | 0.75 | 3.27E−02 | 9 | 30 | LYD519 | 0.85 | 7.67E−03 | 9 | 33 |
| LYD519 | 0.73 | 7.33E−03 | 10 | 13 | LYD519 | 0.74 | 6.23E−03 | 10 | 18 |
| LYD519 | 0.72 | 8.64E−03 | 10 | 6 | LYD519 | 0.72 | 8.31E−03 | 10 | 5 |
| LYD520 | 0.88 | 1.72E−04 | 11 | 30 | LYD520 | 0.84 | 7.18E−04 | 11 | 33 |
| LYD437 | 0.83 | 1.02E−02 | 9 | 36 | LYD437 | 0.73 | 6.79E−03 | 10 | 36 |
| LYD438 | 0.72 | 8.21E−03 | 10 | 34 | LYD439 | 0.71 | 2.11E−02 | 7 | 37 |
| LYD439 | 0.73 | 4.03E−02 | 9 | 36 | LYD441 | 0.72 | 1.80E−02 | 7 | 37 |
| LYD443 | 0.73 | 1.58E−02 | 8 | 39 | LYD445 | 0.86 | 1.31E−03 | 5 | 37 |
| LYD445 | 0.76 | 1.15E−02 | 5 | 35 | LYD445 | 0.84 | 2.47E−03 | 5 | 34 |
| LYD445 | 0.92 | 1.33E−04 | 5 | 38 | LYD445 | 0.77 | 9.23E−03 | 8 | 37 |
| LYD445 | 0.72 | 2.01E−02 | 8 | 35 | LYD445 | 0.71 | 2.10E−02 | 8 | 38 |
| LYD445 | 0.74 | 5.62E−03 | 10 | 37 | LYD445 | 0.84 | 6.84E−04 | 10 | 38 |
| LYD446 | 0.81 | 4.93E−03 | 5 | 35 | LYD446 | 0.84 | 2.19E−03 | 5 | 36 |
| LYD446 | 0.79 | 6.69E−03 | 5 | 34 | LYD446 | 0.74 | 1.45E−02 | 5 | 38 |
| LYD446 | 0.86 | 1.56E−03 | 8 | 37 | LYD446 | 0.73 | 1.72E−02 | 8 | 35 |
| LYD446 | 0.74 | 1.47E−02 | 8 | 34 | LYD446 | 0.74 | 1.36E−02 | 8 | 38 |
| LYD446 | 0.77 | 3.47E−03 | 10 | 37 | LYD447 | 0.70 | 2.36E−02 | 5 | 37 |
| LYD447 | 0.81 | 4.59E−03 | 5 | 38 | LYD447 | 0.75 | 1.25E−02 | 8 | 37 |
| LYD447 | 0.71 | 2.04E−02 | 8 | 35 | LYD448 | 0.72 | 8.31E−03 | 10 | 37 |
| LYD449 | 0.83 | 2.77E−03 | 5 | 37 | LYD449 | 0.77 | 9.16E−03 | 5 | 38 |
| LYD449 | 0.84 | 2.35E−03 | 8 | 37 | LYD449 | 0.74 | 1.39E−02 | 8 | 38 |
| LYD449 | 0.82 | 9.71E−04 | 10 | 37 | LYD449 | 0.73 | 6.85E−03 | 10 | 38 |
| LYD450 | 0.72 | 8.82E−03 | 10 | 38 | LYD452 | 0.73 | 1.56E−02 | 5 | 37 |
| LYD452 | 0.84 | 2.35E−03 | 8 | 37 | LYD452 | 0.74 | 1.39E−02 | 8 | 38 |
| LYD452 | 0.81 | 1.55E−03 | 10 | 37 | LYD452 | 0.72 | 7.82E−03 | 10 | 38 |
| LYD455 | 0.83 | 1.08E−02 | 9 | 36 | LYD458 | 0.79 | 6.01E−03 | 8 | 35 |
| LYD458 | 0.71 | 2.25E−02 | 8 | 34 | LYD458 | 0.73 | 9.99E−03 | 2 | 35 |
| LYD459 | 0.74 | 1.53E−02 | 7 | 37 | LYD459 | 0.72 | 1.78E−02 | 7 | 35 |
| LYD459 | 0.79 | 6.83E−03 | 7 | 34 | LYD459 | 0.71 | 2.24E−02 | 7 | 38 |
| LYD459 | 0.80 | 5.82E−03 | 5 | 37 | LYD459 | 0.76 | 3.02E−02 | 9 | 37 |
| LYD459 | 0.87 | 4.49E−04 | 2 | 35 | LYD459 | 0.82 | 1.84E−03 | 2 | 34 |
| LYD459 | 0.83 | 8.59E−04 | 10 | 37 | LYD460 | 0.74 | 1.42E−02 | 5 | 37 |
| LYD461 | 0.82 | 3.93E−03 | 5 | 36 | LYD462 | 0.85 | 1.90E−03 | 8 | 37 |

TABLE 42-continued

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LYD465 | 0.72 | 8.92E−03 | 10 | 37 | LYD465 | 0.76 | 4.04E−03 | 10 | 34 |
| LYD466 | 0.78 | 2.17E−02 | 9 | 37 | LYD466 | 0.91 | 1.89E−03 | 9 | 35 |
| LYD466 | 0.85 | 8.07E−03 | 9 | 34 | LYD466 | 0.78 | 2.33E−02 | 9 | 38 |
| LYD468 | 0.70 | 1.06E−02 | 1 | 34 | LYD469 | 0.88 | 1.65E−04 | 1 | 36 |
| LYD469 | 0.81 | 1.53E−03 | 10 | 37 | LYD471 | 0.72 | 1.99E−02 | 8 | 35 |
| LYD471 | 0.73 | 7.63E−03 | 10 | 37 | LYD471 | 0.71 | 9.52E−03 | 10 | 35 |
| LYD471 | 0.72 | 8.58E−03 | 10 | 34 | LYD471 | 0.81 | 1.48E−03 | 10 | 38 |
| LYD473 | 0.70 | 2.40E−02 | 8 | 35 | LYD473 | 0.72 | 1.86E−02 | 8 | 34 |
| LYD511 | 0.72 | 4.53E−02 | 9 | 37 | LYD513 | 0.92 | 1.56E−04 | 7 | 35 |
| LYD513 | 0.90 | 3.48E−04 | 7 | 34 | LYD513 | 0.72 | 1.82E−02 | 7 | 38 |
| LYD514 | 0.75 | 1.24E−02 | 8 | 35 | LYD514 | 0.74 | 5.59E−03 | 4 | 36 |
| LYD515 | 0.79 | 2.45E−03 | 10 | 36 | LYD516 | 0.72 | 4.34E−02 | 9 | 37 |
| LYD516 | 0.75 | 4.91E−03 | 10 | 37 | LYD516 | 0.71 | 9.74E−03 | 10 | 38 |
| LYD517 | 0.72 | 1.83E−02 | 7 | 36 | LYD517 | 0.81 | 4.61E−03 | 8 | 37 |
| LYD517 | 0.78 | 7.26E−03 | 8 | 38 | LYD517 | 0.86 | 6.47E−03 | 9 | 37 |
| LYD517 | 0.79 | 1.93E−02 | 9 | 38 | LYD518 | 0.81 | 1.40E−03 | 11 | 36 |
| LYD518 | 0.80 | 5.27E−03 | 5 | 37 | LYD519 | 0.81 | 4.93E−03 | 5 | 35 |
| LYD519 | 0.84 | 2.19E−03 | 5 | 36 | LYD519 | 0.80 | 5.26E−03 | 5 | 34 |
| LYD519 | 0.87 | 9.29E−04 | 5 | 38 | LYD519 | 0.93 | 8.53E−05 | 8 | 37 |
| LYD519 | 0.79 | 6.99E−03 | 8 | 38 | LYD519 | 0.74 | 6.38E−03 | 10 | 37 |
| LYD437 | 0.74 | 3.55E−02 | 7 | 40 | LYD438 | 0.74 | 3.46E−02 | 7 | 40 |
| LYD438 | 0.79 | 6.15E−03 | 4 | 40 | LYD438 | 0.71 | 2.21E−02 | 1 | 40 |
| LYD440 | 0.74 | 5.82E−02 | 9 | 40 | LYD440 | 0.72 | 1.90E−02 | 10 | 40 |
| LYD447 | 0.71 | 2.25E−02 | 11 | 40 | LYD447 | 0.72 | 1.97E−02 | 1 | 40 |
| LYD448 | 0.78 | 2.31E−02 | 5 | 40 | LYD449 | 0.83 | 1.02E−02 | 7 | 40 |
| LYD449 | 0.76 | 1.77E−02 | 2 | 40 | LYD449 | 0.77 | 9.76E−03 | 4 | 40 |
| LYD455 | 0.73 | 1.62E−02 | 11 | 40 | LYD465 | 0.73 | 6.40E−02 | 9 | 40 |
| LYD514 | 0.73 | 1.71E−02 | 1 | 40 | LYD517 | 0.74 | 1.47E−02 | 11 | 40 |

Table 42. Provided are the correlations (R) between the expression levels yield improving genes and their homologs in various tissues [Expression (Exp) sets] and the phenotypic performance [yield, biomass, and plant architecture (Correlation vector (Corr.) ID)] under normal conditions across soybean varieties.
P = p value.

Example 10

Production of Barley Transcriptom and High Throughput Correlation Analysis Using 44K Barley Oligonucleotide Micro-Array In order to produce a high throughput correlation analysis, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 47,500 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Five tissues at different developmental stages [meristem, flower, booting spike, stem, flag leaf], representing different plant characteristics, were sampled and RNA was extracted as described hereinabove under "GENERAL EXPERIMENTAL AND BIOINFORMATICS METHODS".

For convenience, each micro-array expression information tissue type has received a Set ID as summarized in Table 43 below.

TABLE 43

Barley transcriptom expression sets

| Expression Set | Set ID |
|---|---|
| booting spike at flowering stage | 1 |
| Stem at flowering stage | 2 |
| flowering spike at flowering stage | 3 |
| Meristem at flowering stage | 4 |

Table 43: Provided are the identification (ID) digits of each of the Barley expression sets.

Barley yield components and vigor related parameters assessment—13 Barley accessions in 4 repetitive blocks (named A, B, C, and D), each containing 4 plants per plot were grown at net house. Plants were phenotyped on a daily basis following the standard descriptor of barley (Table 44, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

TABLE 44

Barley standard descriptors

| Trait | Parameter | Range | Description |
| --- | --- | --- | --- |
| Growth habit | Scoring | 1-9 | Prostrate (1) or Erect (9) |
| Hairiness of basal leaves | Scoring | P (Presence)/A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 44.

At the end of the experiment (50% of the spikes were dry) all spikes from plots within blocks A-D were collected, and the following measurements were performed:

(i) Grains per spike—The total number of grains from 5 spikes that were manually threshed was counted. The average grain per spike was calculated by dividing the total grain number by the number of spikes.

(ii) Grain average size (cm)—The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

(iii) Grain average weight (mgr)—The total grains from 5 spikes that were manually threshed were counted and weight. The average weight was calculated by dividing the total weight by the total grain number.

(iv) Grain yield per spike (gr)—The total grains from 5 spikes that were manually threshed were weight. The grain yield was calculated by dividing the total weight by the spike number.

(v) Spike length analysis—The five chosen spikes per plant were measured using measuring tape excluding the awns.

(vi) Spike number analysis—The spikes per plant were counted.

Additional parameters were measured as follows:

Growth habit scoring—At growth stage 10 (booting), each of the plants was scored for its growth habit nature. The scale that was used was 1 for prostate nature till 9 for erect.

Hairiness of basal leaves—At growth stage 5 (leaf sheath strongly erect; end of tillering), each of the plants was scored for its hairiness nature of the leaf before the last. The scale that was used was 1 for prostate nature till 9 for erect.

Plant height—At harvest stage (50% of spikes were dry), each of the plants was measured for its height using measuring tape. Height was measured from ground level to top of the longest spike excluding awns.

Days to flowering—Each of the plants was monitored for flowering date. Days of flowering was calculated from sowing date till flowering date.

Stem pigmentation—At growth stage 10 (booting), each of the plants was scored for its stem color. The scale that was used was 1 for green till 5 for full purple.

Vegetative dry weight and spike yield—At the end of the experiment (50% of the spikes were dry) all spikes and vegetative material from plots within blocks A-D are collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr.) after drying at 30° C. in oven for 48 hours.

TABLE 45

Barley correlated parameters (vectors)

| Correlated parameter with | Correlation ID |
| --- | --- |
| Spikes per plant (number) | 1 |
| days to flowering (days) | 2 |
| Grain weight (gr) | 3 |
| Spike length (cm) | 4 |
| Grains Size (mm) | 5 |
| Grains per spike (number) | 6 |
| Growth habit (score 1-9) | 7 |
| Hairiness of basal leaves(score 1-9) | 8 |
| Plant height (cm) | 9 |
| Seed Yield of 5 Spikes (gr.) | 10 |
| Stem pigmentation(score 1-5) | 11 |
| Vegetative dry weight (gr.) | 12 |

Table 45. Provided are the Barley correlated parameters (vectors).

Experimental Results 13 different Barley accessions were grown and characterized for 12 parameters as described above. The average for each of the measured parameter was calculated using the JMP software and values are summarized in Tables 46 and 47 below. Subsequent correlation analysis between the various transcriptom expression sets (Table 43) and the average parameters (Tables 46-47) was conducted. Follow, results were integrated to the database (Table 48 below).

TABLE 46

Measured parameters of correlation Ids in Barley accessions (lines 1-6)

| Ecotype/Correlation ID No. | Line-1 | Line-2 | Line-3 | Line-4 | Line-5 | Line-6 |
|---|---|---|---|---|---|---|
| 1 | 48.846 | 48.273 | 37.417 | 61.917 | 33.273 | 41.692 |
| 2 | 62.400 | 64.083 | 65.154 | 58.917 | 63.000 | 70.538 |
| 3 | 35.046 | 28.065 | 28.761 | 17.869 | 41.216 | 29.734 |
| 4 | 12.036 | 10.932 | 11.825 | 9.900 | 11.682 | 11.532 |
| 5 | 0.265 | 0.229 | 0.244 | 0.166 | 0.295 | 0.275 |
| 6 | 20.229 | 17.983 | 17.267 | 17.733 | 14.467 | 16.783 |
| 7 | 2.600 | 2.000 | 1.923 | 3.167 | 4.333 | 2.692 |
| 8 | 1.533 | 1.333 | 1.692 | 1.083 | 1.417 | 1.692 |
| 9 | 134.267 | 130.500 | 138.769 | 114.583 | 127.750 | 129.385 |
| 10 | 3.559 | 2.538 | 2.583 | 1.574 | 3.030 | 2.517 |
| 11 | 1.133 | 2.500 | 1.692 | 1.750 | 2.333 | 2.308 |
| 12 | 78.871 | 66.141 | 68.491 | 53.389 | 68.300 | 74.173 |

Table 46. Provided are the values of each of the parameters measured in Barley accessions according to the correlation identifications (see Table 45).

TABLE 47

Barley accessions, additional measured parameters (lines 7-13)

| Ecotype/Correlation ID No. | Line-7 | Line-8 | Line-9 | Line-10 | Line-11 | Line-12 | Line-13 |
|---|---|---|---|---|---|---|---|
| 1 | 40.000 | 40.625 | 62.000 | 49.333 | 50.600 | 43.091 | 51.400 |
| 2 | 52.800 | 60.875 | 58.100 | 53.000 | 60.400 | 64.583 | 56.000 |
| 3 | 25.224 | 34.994 | 20.580 | 27.501 | 37.126 | 29.564 | 19.583 |
| 4 | 8.863 | 11.216 | 11.108 | 8.583 | 10.179 | 10.505 | 9.803 |
| 5 | 0.220 | 0.278 | 0.187 | 0.224 | 0.273 | 0.271 | 0.179 |
| 6 | 12.120 | 14.067 | 21.540 | 12.100 | 13.400 | 15.283 | 17.067 |
| 7 | 3.600 | 3.500 | 3.000 | 3.667 | 2.467 | 3.500 | 3.000 |
| 8 | 1.300 | 1.188 | 1.000 | 1.167 | 1.600 | 1.083 | 1.167 |
| 9 | 103.889 | 121.625 | 126.800 | 99.833 | 121.400 | 118.417 | 117.167 |
| 10 | 1.549 | 2.624 | 2.300 | 1.678 | 2.677 | 2.353 | 1.673 |
| 11 | 1.700 | 2.188 | 2.300 | 1.833 | 3.067 | 1.583 | 2.167 |
| 12 | 35.354 | 58.334 | 62.230 | 38.322 | 68.306 | 56.148 | 42.682 |

Table 47. Provided are the values of each of the parameters measured in Barley accessions according to the correlation identifications (see Table 45).

TABLE 48

Correlation between the expression level of the selected polynucleotides of the invention and their homologues in specific tissues or developmental stages and the phenotypic performance across Barley accessions

| Gene Name | R | P value | Exp. set | Corr. Set ID | Gene Name | R | P value | Exp. set | Corr. Set ID |
|---|---|---|---|---|---|---|---|---|---|
| LYD370 | 0.71 | 4.80E−02 | 4 | 1 | LYD371 | 0.78 | 2.21E−02 | 4 | 1 |

Table 48. Provided are the correlations (R) between the expression levels yield improving genes and their homologs in various tissues [Expression (Exp) sets] and the phenotypic performance (Correlation vector (Corr.) ID)] under normal conditions across barley varieties.
P = p value.

Example 11

Production of Cotton Transcriptom and High Throughput Correlation Analysis for Plant Fiber Development Using Cotton Oligonucleotide Microarray In order to conduct high throughput gene expression correlation analysis, the present inventors used cotton oligonucleotide microarray, designed and produced by "Comparative Evolutionary Genomics of Cotton" [Hypertext Transfer Protocol www.cottonevolution (dot) info/). This Cotton Oligonucleotide Microarray is composed of 12,006 Integrated DNA Technologies (IDT) oligonucleotides derived from an assembly of more than 180,000 Gossypium ESTs sequenced from 30 cDNA libraries. For additional details see PCT/IL2005/000627 and PCT/IL2007/001590 which are fully incorporated herein by reference.

TABLE 49

Cotton transcriptom experimental sets

| Expression Set | Set ID |
|---|---|
| cotton fiber length 15 days post anthesis | 1 |
| cotton fiber length 5 days post anthesis | 2 |
| cotton fiber length 10 days post anthesis | 3 |

Table 49. Provided are the cotton transcriptom expression sets.

In order to define correlations between the levels of RNA expression and fiber length, fibers from 8 different cotton lines were analyzed. These fibers were selected showing very good fiber quality and high lint index (Pima types, originating from other cotton species, namely *G. barbadense*), different levels of quality and lint indexes from various *G. hirsutum* lines: good quality and high lint index (Acala type), and poor quality and short lint index (Tamcot type, and old varieties). A summary of the fiber length of the different lines is provided in Table 51.

length of longer half of the fiber distribution. The fibrograph measures length in span lengths at a given percentage point World Wide Web (dot) cottoninc (dot) com/Classification-ofCotton/?Pg=4#Length].

Experimental Results

Eight different cotton lines were grown, and their fiber length was measured. The fibers UHM values are summarized in Table 51 herein below. The correlation between expression level of genes of some embodiments of the invention and cotton fiber length under normal growth conditions was performed (Table 52).

TABLE 50

Cotton correlation parameter

| Correlated parameter with | Correlation ID |
|---|---|
| Fiber Length | 1 |

Table 50.

TABLE 51

Summary of the fiber length (UHM) of the 8 different cotton lines

| Correlation ID No./Ecotype | 1 |
|---|---|
| Line-1 | 1.21 |
| Line-2 | 1.1 |
| Line-3 | 1.36 |
| Line-4 | 1.26 |
| Line-5 | 0.89 |
| Line-6 | 1.01 |
| Line-7 | 1.06 |
| Line-8 | 1.15 |

Table 51: Presented are the UHM of 8 different cotton lines.

TABLE 52

Correlation between the expression level of selected LYD genes of some embodiments of the invention in various tissues and cotton fiber length under normal growth conditions in cotton

| Gene Name | R | P value | Exp. set | Corr. Set ID | Gene Name | R | P value | Exp. set | Corr. Set ID |
|---|---|---|---|---|---|---|---|---|---|
| LYD380 | 0.84 | 1.92E−02 | 3 | 1 | LYD382 | 0.79 | 1.92E−02 | 2 | 1 |
| LYD382 | 0.87 | 1.08E−02 | 3 | 1 | LYD383 | 0.72 | 4.20E−02 | 1 | 1 |
| LYD385 | 0.77 | 2.52E−02 | 1 | 1 | LYD386 | 0.76 | 2.70E−02 | 2 | 1 |
| LYD386 | 0.77 | 4.35E−02 | 3 | 1 | LYD387 | 0.84 | 9.34E−03 | 1 | 1 |
| LYD388 | 0.88 | 9.63E−03 | 3 | 1 | LYD502 | 0.73 | 6.19E−02 | 3 | 1 |

Table 52. Provided are the correlations between the expression level of the genes and the effect on fiber length.
"Exp. Set"—Expression set.
"R" = Pearson correlation coefficient;
"P" = p value.

Experimental Procedures

RNA extraction—Fiber development stages, representing different fiber characteristics, at 5, 10 and 15 DPA (Days After Anthesis) were sampled and RNA was extracted as described above.

Fiber length assessment—Fiber length of the selected cotton lines was measured using fibrograph. The fibrograph system was used to compute length in terms of "Upper Half Mean" length. The upper half mean (UHM) is the average

Example 12

Identification of Genes which Increase Yield, Biomass, Growth Rate, Vigor, Oil Content, Abiotic Stress Tolerance of Plants and Nitrogen Use Efficiency Based on the above described bioinformatics and experimental tools, the present inventors have identified 201 genes which have a major impact on yield, seed yield, oil yield, biomass, growth rate, vigor, oil content, fiber yield, fiber quality, abiotic stress tolerance, and/or fertilizer (e.g., nitrogen) use efficiency when expression thereof is increased in plants. The identified genes (including genes identified by bioinformatics tools, variants, curated sequences thereof and cloned sequences), and polypeptide sequences encoded thereby are summarized in Table 53, hereinbelow.

TABLE 53

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Cluster Name | Organism | Polyn. SEQ ID NO: | Polyp. SEQ ID NO: |
|---|---|---|---|---|
| LYD289 | arabidopsis\|10v1\|AT1G02040 | arabidopsis | 1 | 456 |
| LYD290 | arabidopsis\|10v1\|AT1G09560 | arabidopsis | 2 | 457 |
| LYD291 | arabidopsis\|10v1\|AT1G10970 | arabidopsis | 3 | 458 |
| LYD292 | arabidopsis\|10v1\|AT1G13740 | arabidopsis | 4 | 459 |
| LYD293 | arabidopsis\|10v1\|AT1G14620 | arabidopsis | 5 | 460 |
| LYD294 | arabidopsis\|10v1\|AT1G27300 | arabidopsis | 6 | 461 |
| LYD295 | arabidopsis\|10v1\|AT1G27900 | arabidopsis | 7 | 462 |
| LYD296 | arabidopsis\|10v1\|AT1G30820 | arabidopsis | 8 | 463 |
| LYD297 | arabidopsis\|10v1\|AT1G51440 | arabidopsis | 9 | 464 |
| LYD298 | arabidopsis\|10v1\|AT1G55910 | arabidopsis | 10 | 465 |
| LYD299 | arabidopsis\|10v1\|AT1G61600 | arabidopsis | 11 | 466 |
| LYD300 | arabidopsis\|10v1\|AT1G61790 | arabidopsis | 12 | 467 |
| LYD301 | arabidopsis\|10v1\|AT1G74790 | arabidopsis | 13 | 468 |
| LYD302 | arabidopsis\|10v1\|AT1G77060 | arabidopsis | 14 | 469 |
| LYD303 | arabidopsis\|10v1\|AT2G01710 | arabidopsis | 15 | 470 |
| LYD304 | arabidopsis\|10v1\|AT2G03810 | arabidopsis | 16 | 471 |
| LYD305 | arabidopsis\|10v1\|AT2G05220 | arabidopsis | 17 | 472 |
| LYD306 | arabidopsis\|10v1\|AT2G07674 | arabidopsis | 18 | 473 |
| LYD307 | arabidopsis\|10v1\|AT2G17990 | arabidopsis | 19 | 474 |
| LYD308 | arabidopsis\|10v1\|AT2G37478 | arabidopsis | 20 | 475 |
| LYD309 | arabidopsis\|10v1\|AT2G40020 | arabidopsis | 21 | 476 |
| LYD310 | arabidopsis\|10v1\|AT2G40300 | arabidopsis | 22 | 477 |
| LYD311 | arabidopsis\|10v1\|AT2G40510 | arabidopsis | 23 | 478 |
| LYD312 | arabidopsis\|10v1\|AT2G42770 | arabidopsis | 24 | 479 |
| LYD313 | arabidopsis\|10v1\|AT3G04620 | arabidopsis | 25 | 480 |
| LYD315 | arabidopsis\|10v1\|AT3G05390 | arabidopsis | 26 | 481 |
| LYD316 | arabidopsis\|10v1\|AT3G09030 | arabidopsis | 27 | 482 |
| LYD318 | arabidopsis\|10v1\|AT3G11900 | arabidopsis | 28 | 483 |
| LYD319 | arabidopsis\|10v1\|AT3G14070 | arabidopsis | 29 | 484 |
| LYD320 | arabidopsis\|10v1\|AT3G15810 | arabidopsis | 30 | 485 |
| LYD321 | arabidopsis\|10v1\|AT3G18750 | arabidopsis | 31 | 486 |
| LYD322 | arabidopsis\|10v1\|AT3G21190 | arabidopsis | 32 | 487 |
| LYD323 | arabidopsis\|10v1\|AT3G44280 | arabidopsis | 33 | 488 |
| LYD324 | arabidopsis\|10v1\|AT3G47860 | arabidopsis | 34 | 489 |
| LYD325 | arabidopsis\|10v1\|AT3G49390 | arabidopsis | 35 | 490 |
| LYD326 | arabidopsis\|10v1\|AT3G49490 | arabidopsis | 36 | 491 |
| LYD327 | arabidopsis\|10v1\|AT3G51895 | arabidopsis | 37 | 492 |
| LYD328 | arabidopsis\|10v1\|AT3G59210 | arabidopsis | 38 | 493 |
| LYD329 | arabidopsis\|10v1\|AT3G62270 | arabidopsis | 39 | 494 |
| LYD330 | arabidopsis\|10v1\|AT4G13070 | arabidopsis | 40 | 495 |
| LYD331 | arabidopsis\|10v1\|AT4G17440 | arabidopsis | 41 | 496 |
| LYD332 | arabidopsis\|10v1\|AT4G35110 | arabidopsis | 42 | 497 |
| LYD334 | arabidopsis\|10v1\|AT5G03870 | arabidopsis | 43 | 498 |
| LYD335 | arabidopsis\|10v1\|AT5G04140 | arabidopsis | 44 | 499 |
| LYD337 | arabidopsis\|10v1\|AT5G11740 | arabidopsis | 45 | 500 |
| LYD338 | arabidopsis\|10v1\|AT5G12410 | arabidopsis | 46 | 501 |
| LYD339 | arabidopsis\|10v1\|AT5G13560 | arabidopsis | 47 | 502 |
| LYD340 | arabidopsis\|10v1\|AT5G16420 | arabidopsis | 48 | 503 |
| LYD341 | arabidopsis\|10v1\|AT5G36700 | arabidopsis | 49 | 504 |
| LYD342 | arabidopsis\|10v1\|AT5G44680 | arabidopsis | 50 | 505 |
| LYD343 | arabidopsis\|10v1\|AT5G46150 | arabidopsis | 51 | 506 |
| LYD344 | arabidopsis\|10v1\|AT5G64810 | arabidopsis | 52 | 507 |
| LYD346 | b__juncea\|10v2\|BJ1SLX00003156 | b__juncea | 53 | 508 |
| LYD347 | b__juncea\|10v2\|BJ1SLX00219277D1 | b__juncea | 54 | 509 |
| LYD348 | b__juncea\|10v2\|BJ1SLX01241733D1 | b__juncea | 55 | 510 |
| LYD349 | b__juncea\|10v2\|E6ANDIZ01A0PVA | b__juncea | 56 | 511 |
| LYD351 | b__juncea\|10v2\|E6ANDIZ01A2WXZ | b__juncea | 57 | 512 |
| LYD352 | b__juncea\|10v2\|E6ANDIZ01A7124 | b__juncea | 58 | 513 |
| LYD353 | b__juncea\|10v2\|E6ANDIZ01AK44C | b__juncea | 59 | 514 |
| LYD354 | b__juncea\|10v2\|E6ANDIZ01ALST2 | b__juncea | 60 | 515 |
| LYD355 | b__juncea\|10v2\|E6ANDIZ01AM1M7 | b__juncea | 61 | 516 |
| LYD356 | b__juncea\|10v2\|E6ANDIZ01AR3Y3 | b__juncea | 62 | 517 |
| LYD357 | b__juncea\|10v2\|E6ANDIZ01AU0CH | b__juncea | 63 | 518 |
| LYD358 | b__juncea\|10v2\|E6ANDIZ01AUG5K | b__juncea | 64 | 519 |
| LYD359 | b__juncea\|10v2\|E6ANDIZ01AVIGM | b__juncea | 65 | 520 |
| LYD360 | b__juncea\|10v2\|E6ANDIZ01BHOKJ | b__juncea | 66 | 521 |

TABLE 53-continued

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Cluster Name | Organism | Polyn. SEQ ID NO: | Polyp. SEQ ID NO: |
|---|---|---|---|---|
| LYD361 | b_juncea|10v2|E6ANDIZ01BIDFA | b_juncea | 67 | 522 |
| LYD362 | b_juncea|10v2|E6ANDIZ01C68KB | b_juncea | 68 | 523 |
| LYD364 | b_juncea|10v2|E6ANDIZ01ET44E | b_juncea | 69 | 524 |
| LYD365 | b_juncea|10v2|E6ANDIZ01EWUI0 | b_juncea | 70 | 525 |
| LYD366 | b_juncea|10v2|E6ANDIZ02FS13L | b_juncea | 71 | 526 |
| LYD367 | b_juncea|10v2|E6ANDIZ02GKPXS | b_juncea | 72 | 527 |
| LYD368 | b_juncea|10v2|OXBJ1SLX00002741D1T1 | b_juncea | 73 | 528 |
| LYD370 | barley|10v2|AV834829 | barley | 74 | 529 |
| LYD371 | barley|10v2|BJ450532 | barley | 75 | 530 |
| LYD372 | canola|10v1|CD828626 | canola | 76 | 531 |
| LYD375 | canola|10v1|DY011663 | canola | 77 | 532 |
| LYD376 | canola|10v1|ES964015 | canola | 78 | 533 |
| LYD377 | canola|10v1|EV098360 | canola | 79 | 534 |
| LYD378 | canola|10v1|EV114958 | canola | 80 | 535 |
| LYD379 | canola|10v1|EV129887 | canola | 81 | 536 |
| LYD380 | cotton|10v1barbadense|BE054896 | cotton | 82 | 537 |
| LYD381 | cotton|10v1|AI727565 | cotton | 83 | 538 |
| LYD382 | cotton|10v2|AI726887 | cotton | 84 | 539 |
| LYD383 | cotton|10v2|BG447338 | cotton | 85 | 540 |
| LYD385 | cotton|10v2|DN799940 | cotton | 86 | 541 |
| LYD386 | cotton|10v2|DN804420 | cotton | 87 | 542 |
| LYD387 | cotton|10v2|DT466425 | cotton | 88 | 543 |
| LYD388 | cotton|10v2|EX167553 | cotton | 89 | 544 |
| LYD390 | cotton|gb164|AI055341 | cotton | 90 | 545 |
| LYD391 | maize|10v1|AA011869 | maize | 91 | 546 |
| LYD392 | maize|10v1|BE512624 | maize | 92 | 547 |
| LYD393 | medicago|09v1|AI974481 | medicago | 93 | 548 |
| LYD395 | medicago|09v1|AL379818 | medicago | 94 | 549 |
| LYD396 | medicago|09v1|AW256719 | medicago | 95 | 550 |
| LYD397 | medicago|09v1|AW257291 | medicago | 96 | 551 |
| LYD398 | medicago|09v1|AW329709 | medicago | 97 | 552 |
| LYD399 | medicago|09v1|AW688882 | medicago | 98 | 553 |
| LYD401 | medicago|09v1|AW690536 | medicago | 99 | 554 |
| LYD402 | medicago|09v1|AW694333 | medicago | 100 | 555 |
| LYD403 | medicago|09v1|AW698677 | medicago | 101 | 556 |
| LYD404 | medicago|09v1|AW736500 | medicago | 102 | 557 |
| LYD405 | medicago|09v1|AW775077 | medicago | 103 | 558 |
| LYD407 | medicago|09v1|BE322971 | medicago | 104 | 559 |
| LYD408 | medicago|09v1|BE324051 | medicago | 105 | 560 |
| LYD409 | medicago|09v1|BF521188 | medicago | 106 | 561 |
| LYD410 | medicago|09v1|BG452469 | medicago | 107 | 562 |
| LYD413 | medicago|09v1|BQ124797 | medicago | 108 | 563 |
| LYD414 | medicago|09v1|BQ157221 | medicago | 109 | 564 |
| LYD415 | medicago|09v1|CX516971 | medicago | 110 | 565 |
| LYD416 | medicago|09v1|LLAJ388869 | medicago | 111 | 566 |
| LYD417 | medicago|09v1|LLAL373168 | medicago | 112 | 567 |
| LYD418 | medicago|09v1|LLAW688750 | medicago | 113 | 568 |
| LYD419 | medicago|09v1|LLAW698759 | medicago | 114 | 569 |
| LYD420 | medicago|09v1|LLAW776476 | medicago | 115 | 570 |
| LYD421 | medicago|09v1|LLBI271813 | medicago | 116 | 571 |
| LYD422 | medicago|09v1|MT454X026824 | medicago | 117 | 572 |
| LYD423 | sorghum|09v1|SB01G027910 | sorghum | 118 | 573 |
| LYD424 | sorghum|09v1|SB01G046300 | sorghum | 119 | 574 |
| LYD425 | sorghum|09v1|SB02G004290 | sorghum | 120 | 575 |
| LYD427 | sorghum|09v1|SB03G025240 | sorghum | 121 | 576 |
| LYD428 | sorghum|09v1|SB04G002930 | sorghum | 122 | 577 |
| LYD431 | sorghum|09v1|SB05G020810 | sorghum | 123 | 578 |
| LYD432 | sorghum|09v1|SB06G021780 | sorghum | 124 | 579 |
| LYD433 | sorghum|09v1|SB07G014630 | sorghum | 125 | 580 |
| LYD434 | sorghum|09v1|SB07G019310 | sorghum | 126 | 581 |
| LYD435 | sorghum|09v1|SB07G019840 | sorghum | 127 | 582 |
| LYD436 | sorghum|09v1|SB09G003870 | sorghum | 128 | 583 |
| LYD437 | soybean|11v1|GLYMA01G09460 | soybean | 129 | 584 |
| LYD438 | soybean|11v1|GLYMA02G33320 | soybean | 130 | 585 |
| LYD439 | soybean|11v1|GLYMA03G34340 | soybean | 131 | 586 |
| LYD440 | soybean|11v1|GLYMA03G40870 | soybean | 132 | 587 |
| LYD441 | soybean|11v1|GLYMA04G36500 | soybean | 133 | 588 |
| LYD442 | soybean|11v1|GLYMA04G39480 | soybean | 134 | 589 |
| LYD443 | soybean|11v1|GLYMA04G41020 | soybean | 135 | 590 |
| LYD445 | soybean|11v1|GLYMA06G03510 | soybean | 136 | 591 |
| LYD446 | soybean|11v1|GLYMA06G17910 | soybean | 137 | 592 |
| LYD447 | soybean|11v1|GLYMA07G07150 | soybean | 138 | 593 |

TABLE 53-continued

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Cluster Name | Organism | Polyn. SEQ ID NO: | Polyp. SEQ ID NO: |
|---|---|---|---|---|
| LYD448 | soybean\|11v1\|GLYMA07G08010 | soybean | 139 | 594 |
| LYD449 | soybean\|11v1\|GLYMA07G10060 | soybean | 140 | 595 |
| LYD450 | soybean\|11v1\|GLYMA09G26770 | soybean | 141 | 596 |
| LYD451 | soybean\|11v1\|GLYMA09G29610 | soybean | 142 | 597 |
| LYD452 | soybean\|11v1\|GLYMA09G31720 | soybean | 143 | 598 |
| LYD453 | soybean\|11v1\|GLYMA11G01120 | soybean | 144 | 599 |
| LYD454 | soybean\|11v1\|GLYMA11G03570 | soybean | 145 | 600 |
| LYD455 | soybean\|11v1\|GLYMA11G11560 | soybean | 146 | 601 |
| LYD456 | soybean\|11v1\|GLYMA12G01770 | soybean | 147 | 602 |
| LYD458 | soybean\|11v1\|GLYMA13G22110 | soybean | 148 | 603 |
| LYD459 | soybean\|11v1\|GLYMA13G23920 | soybean | 149 | 604 |
| LYD460 | soybean\|11v1\|GLYMA13G28620 | soybean | 150 | 605 |
| LYD461 | soybean\|11v1\|GLYMA15G37980 | soybean | 151 | 606 |
| LYD462 | soybean\|11v1\|GLYMA16G04350 | soybean | 152 | 607 |
| LYD465 | soybean\|11v1\|GLYMA17G18250 | soybean | 153 | 608 |
| LYD466 | soybean\|11v1\|GLYMA18G49340 | soybean | 154 | 609 |
| LYD467 | soybean\|11v1\|GLYMA19G14700 | soybean | 155 | 610 |
| LYD468 | soybean\|11v1\|GLYMA19G36240 | soybean | 156 | 611 |
| LYD469 | soybean\|11v1\|GLYMA19G38830 | soybean | 157 | 612 |
| LYD470 | soybean\|11v1\|GLYMA19G43610 | soybean | 158 | 613 |
| LYD471 | soybean\|11v1\|GLYMA20G38820 | soybean | 159 | 614 |
| LYD472 | soybean\|gb168\|AW348492 | soybean | 160 | 615 |
| LYD473 | soybean\|gb168\|BE661322 | soybean | 161 | 616 |
| LYD474 | sunflower\|10v1\|CD849185 | sunflower | 162 | 617 |
| LYD475 | tomato\|09v1\|AI485596 | tomato | 163 | 618 |
| LYD477 | tomato\|09v1\|BP884530 | tomato | 164 | 619 |
| LYD478 | tomato\|10v1\|AI483112 | tomato | 165 | 620 |
| LYD479 | tomato\|10v1\|AI484249 | tomato | 166 | 621 |
| LYD480 | tomato\|10v1\|AI771275 | tomato | 167 | 622 |
| LYD481 | tomato\|10v1\|AI771986 | tomato | 168 | 623 |
| LYD482 | tomato\|10v1\|AI777950 | tomato | 169 | 624 |
| LYD483 | tomato\|10v1\|AW738746 | tomato | 170 | 625 |
| LYD484 | tomato\|10v1\|AW929870 | tomato | 171 | 626 |
| LYD487 | tomato\|10v1\|BG127385 | tomato | 172 | 627 |
| LYD489 | tomato\|10v1\|BG131472 | tomato | 173 | 628 |
| LYD491 | tomato\|10v1\|BM061560 | tomato | 174 | 629 |
| LYD492 | tomato\|10v1\|DB714406 | tomato | 175 | 630 |
| LYD495 | wheat\|gb164\|BG604441 | wheat | 176 | 631 |
| LYD497 | b_juncea\|10v2\|E6ANDIZ01AJCUK | b_juncea | 177 | 632 |
| LYD498 | b_juncea\|10v2\|E6ANDIZ01AJQJC | b_juncea | 178 | 633 |
| LYD499 | b_juncea\|10v2\|E6ANDIZ01B9PEA | b_juncea | 179 | 634 |
| LYD500 | b_juncea\|10v2\|E6ANDIZ02FZU2Y2 | b_juncea | 180 | 635 |
| LYD501 | b_juncea\|10v2\|E6ANDIZ02G70KP | b_juncea | 181 | 636 |
| LYD502 | cotton\|10v2\|DW503396 | cotton | 182 | 637 |
| LYD503 | maize\|10v1\|AI637036 | maize | 183 | 638 |
| LYD504 | medicago\|09v1\|AA660909 | medicago | 184 | 639 |
| LYD505 | medicago\|09v1\|AJ388789 | medicago | 185 | 640 |
| LYD506 | medicago\|09v1\|BE239698 | medicago | 186 | 641 |
| LYD507 | sorghum\|09v1\|SB01G017330 | sorghum | 187 | 642 |
| LYD508 | sorghum\|09v1\|SB02G014460 | sorghum | 188 | 643 |
| LYD509 | sorghum\|09v1\|SB02G028300 | sorghum | 189 | 644 |
| LYD510 | sorghum\|09v1\|SB09G025320 | sorghum | 190 | 645 |
| LYD511 | soybean\|11v1\|BE660230 | soybean | 191 | 646 |
| LYD512 | soybean\|11v1\|GLYMA03G36420 | soybean | 192 | 647 |
| LYD513 | soybean\|11v1\|GLYMA03G39480 | soybean | 193 | 648 |
| LYD514 | soybean\|11v1\|GLYMA05G04990 | soybean | 194 | 649 |
| LYD515 | soybean\|11v1\|GLYMA07G36970 | soybean | 195 | 650 |
| LYD516 | soybean\|11v1\|GLYMA13G24040 | soybean | 196 | 651 |
| LYD517 | soybean\|11v1\|GLYMA15G06930 | soybean | 197 | 652 |
| LYD518 | soybean\|11v1\|GLYMA18G48880 | soybean | 198 | 653 |
| LYD519 | soybean\|gb168\|AW686841 | soybean | 199 | 654 |
| LYD520 | soybean\|gb168\|FG994976 | soybean | 200 | 655 |
| LYD496 | arabidopsis\|10v1\|AT1G58235 | arabidopsis | 201 | — |
| LYD299 | arabidopsis\|10v1\|AT1G61600 | arabidopsis | 202 | 466 |
| LYD331 | arabidopsis\|10v1\|AT4G17440 | arabidopsis | 203 | 496 |
| LYD340 | arabidopsis\|10v1\|AT5G16420 | arabidopsis | 204 | 503 |
| LYD372 | canola\|10v1\|CD828626 | canola | 225 | 531 |
| LYD379 | canola\|10v1\|EV129887 | canola | 229 | 536 |
| LYD420 | medicago\|09v1\|LLAW776476 | medicago | 237 | 570 |
| LYD477 | tomato\|09v1\|BP884530 | tomato | 248 | 619 |
| LYD479 | tomato\|10v1\|AI484249 | tomato | 249 | 621 |
| LYD489 | tomato\|10v1\|BG131472 | tomato | 251 | 628 |

TABLE 53-continued

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Cluster Name | Organism | Polyn. SEQ ID NO: | Polyp. SEQ ID NO: |
|---|---|---|---|---|
| LYD346 | b_juncea|10v2|BJ1SLX00003156 | b_juncea | 205 | 656 |
| LYD347 | b_juncea|10v2|BJ1SLX00219277D1 | b_juncea | 206 | 657 |
| LYD348 | b_juncea|10v2|BJ1SLX01241733D1 | b_juncea | 207 | 658 |
| LYD349 | b_juncea|10v2|E6ANDIZ01A0PVA | b_juncea | 208 | 659 |
| LYD351 | b_juncea|10v2|E6ANDIZ01A2WXZ | b_juncea | 209 | 660 |
| LYD352 | b_juncea|10v2|E6ANDIZ01A7124 | b_juncea | 210 | 661 |
| LYD353 | b_juncea|10v2|E6ANDIZ01AK44C | b_juncea | 211 | 662 |
| LYD354 | b_juncea|10v2|E6ANDIZ01ALST2 | b_juncea | 212 | 663 |
| LYD355 | b_juncea|10v2|E6ANDIZ01AM1M7 | b_juncea | 213 | 664 |
| LYD356 | b_juncea|10v2|E6ANDIZ01AR3Y3 | b_juncea | 214 | 665 |
| LYD357 | b_juncea|10v2|E6ANDIZ01AU0CH | b_juncea | 215 | 666 |
| LYD358 | b_juncea|10v2|E6ANDIZ01AUG5K | b_juncea | 216 | 667 |
| LYD359 | b_juncea|10v2|E6ANDIZ01AVIGM | b_juncea | 217 | 668 |
| LYD360 | b_juncea|10v2|E6ANDIZ01BHOKJ | b_juncea | 218 | 669 |
| LYD361 | b_juncea|10v2|E6ANDIZ01BIDFA | b_juncea | 219 | 670 |
| LYD364 | b_juncea|10v2|E6ANDIZ01ET44E | b_juncea | 220 | 671 |
| LYD365 | b_juncea|10v2|E6ANDIZ01EWUI0 | b_juncea | 221 | 672 |
| LYD366 | b_juncea|10v2|E6ANDIZ02FS13L | b_juncea | 222 | 673 |
| LYD367 | b_juncea|10v2|E6ANDIZ02GKPXS | b_juncea | 223 | 674 |
| LYD371 | barley|10v2|BJ450532 | barley | 224 | 675 |
| LYD376 | canola|10v1|ES964015 | canola | 226 | 676 |
| LYD377 | canola|10v1|EV098360 | canola | 227 | 677 |
| LYD378 | canola|10v1|EV114958 | canola | 228 | 678 |
| LYD380 | cotton|10v1barbadense|BE054896 | cotton | 230 | 679 |
| LYD383 | cotton|10v2|BG447338 | cotton | 231 | 680 |
| LYD388 | cotton|10v2|EX167553 | cotton | 232 | 681 |
| LYD390 | cotton|gb164|AI055341 | cotton | 233 | 682 |
| LYD413 | medicago|09v1|BQ124797 | medicago | 234 | 683 |
| LYD417 | medicago|09v1|LLAL373168 | medicago | 235 | 684 |
| LYD418 | medicago|09v1|LLAW688750 | medicago | 236 | 685 |
| LYD421 | medicago|09v1|LLBI271813 | medicago | 238 | 686 |
| LYD422 | medicago|09v1|MT454X026824 | medicago | 239 | 687 |
| LYD431 | sorghum|09v1|SB05G020810 | sorghum | 240 | 688 |
| LYD434 | sorghum|09v1|SB07G019310 | sorghum | 241 | 689 |
| LYD443 | soybean|11v1|GLYMA04G41020 | soybean | 242 | 690 |
| LYD446 | soybean|11v1|GLYMA06G17910 | soybean | 243 | 691 |
| LYD448 | soybean|11v1|GLYMA07G08010 | soybean | 244 | 692 |
| LYD458 | soybean|11v1|GLYMA13G22110 | soybean | 245 | 693 |
| LYD461 | soybean|11v1|GLYMA15G37980 | soybean | 246 | 694 |
| LYD471 | soybean|11v1|GLYMA20G38820 | soybean | 247 | 695 |
| LYD483 | tomato|10v1|AW738746 | tomato | 250 | 696 |
| LYD495 | wheat|gb164|BG604441 | wheat | 252 | 697 |
| LYD497 | b_juncea|10v2|E6ANDIZ01AJCUK | b_juncea | 253 | 698 |
| LYD499 | b_juncea|10v2|E6ANDIZ01B9PEA | b_juncea | 254 | 699 |
| LYD500 | b_juncea|10v2|E6ANDIZ02FZU2Y2 | b_juncea | 255 | 700 |
| LYD501 | b_juncea|10v2|E6ANDIZ02G70KP | b_juncea | 256 | 701 |
| LYD514 | soybean|11v1|GLYMA05G04990 | soybean | 257 | 702 |
| LYD496 | arabidopsis|10v1|AT1G58235 | arabidopsis | 258 | — |
| LYD289 | arabidopsis|10v1|AT1G02040 | arabidopsis | 259 | 456 |
| LYD290 | arabidopsis|10v1|AT1G09560 | arabidopsis | 260 | 457 |
| LYD291 | arabidopsis|10v1|AT1G10970 | arabidopsis | 261 | 458 |
| LYD292 | arabidopsis|10v1|AT1G13740 | arabidopsis | 262 | 459 |
| LYD293 | arabidopsis|10v1|AT1G14620 | arabidopsis | 263 | 460 |
| LYD294 | arabidopsis|10v1|AT1G27300 | arabidopsis | 264 | 461 |
| LYD295 | arabidopsis|10v1|AT1G27900 | arabidopsis | 265 | 462 |
| LYD296 | arabidopsis|10v1|AT1G30820 | arabidopsis | 266 | 463 |
| LYD298 | arabidopsis|10v1|AT1G55910 | arabidopsis | 268 | 465 |
| LYD299 | arabidopsis|10v1|AT1G61600 | arabidopsis | 269 | 466 |
| LYD300 | arabidopsis|10v1|AT1G61790 | arabidopsis | 270 | 467 |
| LYD301 | arabidopsis|10v1|AT1G74790 | arabidopsis | 271 | 468 |
| LYD302 | arabidopsis|10v1|AT1G77060 | arabidopsis | 272 | 469 |
| LYD303 | arabidopsis|10v1|AT2G01710 | arabidopsis | 273 | 470 |
| LYD304 | arabidopsis|10v1|AT2G03810 | arabidopsis | 274 | 471 |
| LYD305 | arabidopsis|10v1|AT2G05220 | arabidopsis | 275 | 472 |
| LYD307 | arabidopsis|10v1|AT2G17990 | arabidopsis | 277 | 474 |
| LYD309 | arabidopsis|10v1|AT2G40020 | arabidopsis | 279 | 476 |
| LYD311 | arabidopsis|10v1|AT2G40510 | arabidopsis | 281 | 478 |
| LYD312 | arabidopsis|10v1|AT2G42770 | arabidopsis | 282 | 479 |
| LYD313 | arabidopsis|10v1|AT3G04620 | arabidopsis | 283 | 480 |
| LYD316 | arabidopsis|10v1|AT3G09030 | arabidopsis | 285 | 482 |
| LYD318 | arabidopsis|10v1|AT3G11900 | arabidopsis | 286 | 483 |
| LYD319 | arabidopsis|10v1|AT3G14070 | arabidopsis | 287 | 484 |

TABLE 53-continued

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Cluster Name | Organism | Polyn. SEQ ID NO: | Polyp. SEQ ID NO: |
|---|---|---|---|---|
| LYD320 | arabidopsis\|10v1\|AT3G15810 | arabidopsis | 288 | 485 |
| LYD321 | arabidopsis\|10v1\|AT3G18750 | arabidopsis | 289 | 486 |
| LYD322 | arabidopsis\|10v1\|AT3G21190 | arabidopsis | 290 | 487 |
| LYD323 | arabidopsis\|10v1\|AT3G44280 | arabidopsis | 291 | 488 |
| LYD324 | arabidopsis\|10v1\|AT3G47860 | arabidopsis | 292 | 489 |
| LYD325 | arabidopsis\|10v1\|AT3G49390 | arabidopsis | 293 | 490 |
| LYD326 | arabidopsis\|10v1\|AT3G49490 | arabidopsis | 294 | 491 |
| LYD327 | arabidopsis\|10v1\|AT3G51895 | arabidopsis | 295 | 492 |
| LYD328 | arabidopsis\|10v1\|AT3G59210 | arabidopsis | 296 | 493 |
| LYD329 | arabidopsis\|10v1\|AT3G62270 | arabidopsis | 297 | 494 |
| LYD330 | arabidopsis\|10v1\|AT4G13070 | arabidopsis | 298 | 495 |
| LYD331 | arabidopsis\|10v1\|AT4G17440 | arabidopsis | 299 | 496 |
| LYD332 | arabidopsis\|10v1\|AT4G35110 | arabidopsis | 300 | 497 |
| LYD334 | arabidopsis\|10v1\|AT5G03870 | arabidopsis | 301 | 498 |
| LYD335 | arabidopsis\|10v1\|AT5G04140 | arabidopsis | 302 | 499 |
| LYD337 | arabidopsis\|10v1\|AT5G11740 | arabidopsis | 303 | 500 |
| LYD338 | arabidopsis\|10v1\|AT5G12410 | arabidopsis | 304 | 501 |
| LYD339 | arabidopsis\|10v1\|AT5G13560 | arabidopsis | 305 | 502 |
| LYD340 | arabidopsis\|10v1\|AT5G16420 | arabidopsis | 306 | 503 |
| LYD341 | arabidopsis\|10v1\|AT5G36700 | arabidopsis | 307 | 504 |
| LYD342 | arabidopsis\|10v1\|AT5G44680 | arabidopsis | 308 | 505 |
| LYD343 | arabidopsis\|10v1\|AT5G46150 | arabidopsis | 309 | 506 |
| LYD344 | arabidopsis\|10v1\|AT5G64840 | arabidopsis | 310 | 507 |
| LYD346 | b_juncea\|10v2\|BJ1SLX00003156 | b_juncea | 311 | 508 |
| LYD355 | b_juncea\|10v2\|E6ANDIZ01AM1M7 | b_juncea | 319 | 516 |
| LYD362 | b_juncea\|10v2\|E6ANDIZ01C68KB | b_juncea | 326 | 523 |
| LYD368 | b_juncea\|10v2\|OXBJ1SLX00002741D1T1 | b_juncea | 331 | 528 |
| LYD372 | canola\|10v1\|CD828626 | canola | 333 | 531 |
| LYD376 | canola\|10v1\|ES964015 | canola | 335 | 533 |
| LYD380 | cotton\|10v1barbadense\|BE054896 | cotton | 339 | 537 |
| LYD395 | medicago\|09v1\|AL379818 | medicago | 350 | 549 |
| LYD399 | medicago\|09v1\|AW688882 | medicago | 354 | 553 |
| LYD401 | medicago\|09v1\|AW690536 | medicago | 355 | 554 |
| LYD402 | medicago\|09v1\|AW694333 | medicago | 356 | 555 |
| LYD407 | medicago\|09v1\|BE322971 | medicago | 360 | 559 |
| LYD414 | medicago\|09v1\|BQ157221 | medicago | 365 | 564 |
| LYD423 | sorghum\|09v1\|SB01G027910 | sorghum | 373 | 573 |
| LYD424 | sorghum\|09v1\|SB01G046300 | sorghum | 374 | 574 |
| LYD425 | sorghum\|09v1\|SB02G004290 | sorghum | 375 | 575 |
| LYD427 | sorghum\|09v1\|SB03G025240 | sorghum | 376 | 576 |
| LYD431 | sorghum\|09v1\|SB05G020810 | sorghum | 378 | 578 |
| LYD432 | sorghum\|09v1\|SB06G021780 | sorghum | 379 | 579 |
| LYD433 | sorghum\|09v1\|SB07G014630 | sorghum | 380 | 580 |
| LYD434 | sorghum\|09v1\|SB07G019310 | sorghum | 381 | 581 |
| LYD435 | sorghum\|09v1\|SB07G019840 | sorghum | 382 | 582 |
| LYD437 | soybean\|11v1\|GLYMA01G09460 | soybean | 384 | 584 |
| LYD438 | soybean\|11v1\|GLYMA02G33320 | soybean | 385 | 585 |
| LYD439 | soybean\|11v1\|GLYMA03G34340 | soybean | 386 | 586 |
| LYD440 | soybean\|11v1\|GLYMA03G40870 | soybean | 387 | 587 |
| LYD441 | soybean\|11v1\|GLYMA04G36500 | soybean | 388 | 588 |
| LYD442 | soybean\|11v1\|GLYMA04G39480 | soybean | 389 | 589 |
| LYD443 | soybean\|11v1\|GLYMA04G41020 | soybean | 390 | 590 |
| LYD445 | soybean\|11v1\|GLYMA06G03510 | soybean | 391 | 591 |
| LYD448 | soybean\|11v1\|GLYMA07G08010 | soybean | 393 | 594 |
| LYD450 | soybean\|11v1\|GLYMA09G26770 | soybean | 395 | 596 |
| LYD451 | soybean\|11v1\|GLYMA09G29610 | soybean | 396 | 597 |
| LYD453 | soybean\|11v1\|GLYMA11G01120 | soybean | 398 | 599 |
| LYD454 | soybean\|11v1\|GLYMA11G03570 | soybean | 399 | 600 |
| LYD458 | soybean\|11v1\|GLYMA13G22110 | soybean | 402 | 603 |
| LYD459 | soybean\|11v1\|GLYMA13G23920 | soybean | 403 | 604 |
| LYD460 | soybean\|11v1\|GLYMA13G28620 | soybean | 404 | 605 |
| LYD461 | soybean\|11v1\|GLYMA15G37980 | soybean | 405 | 606 |
| LYD465 | soybean\|11v1\|GLYMA17G18250 | soybean | 407 | 608 |
| LYD466 | soybean\|11v1\|GLYMA18G49340 | soybean | 408 | 609 |
| LYD467 | soybean\|11v1\|GLYMA19G14700 | soybean | 409 | 610 |
| LYD468 | soybean\|11v1\|GLYMA19G36240 | soybean | 410 | 611 |
| LYD469 | soybean\|11v1\|GLYMA19G38830 | soybean | 411 | 612 |
| LYD471 | soybean\|11v1\|GLYMA20G38820 | soybean | 413 | 614 |
| LYD472 | soybean\|gb168\|AW348492 | soybean | 414 | 615 |
| LYD473 | soybean\|gb168\|BE661322 | soybean | 415 | 616 |
| LYD474 | sunflower\|10v1\|CD849185 | sunflower | 416 | 617 |
| LYD475 | tomato\|09v1\|AI485596 | tomato | 417 | 618 |

TABLE 53-continued

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Cluster Name | Organism | Polyn. SEQ ID NO: | Polyp. SEQ ID NO: |
|---|---|---|---|---|
| LYD477 | tomato\|09v1\|BP884530 | tomato | 418 | 619 |
| LYD478 | tomato\|10v1\|AI483112 | tomato | 419 | 620 |
| LYD479 | tomato\|10v1\|AI484249 | tomato | 420 | 621 |
| LYD481 | tomato\|10v1\|AI771986 | tomato | 422 | 623 |
| LYD482 | tomato\|10v1\|AI777950 | tomato | 423 | 624 |
| LYD484 | tomato\|10v1\|AW929870 | tomato | 425 | 626 |
| LYD489 | tomato\|10v1\|BG131472 | tomato | 427 | 628 |
| LYD491 | tomato\|10v1\|BM061560 | tomato | 428 | 629 |
| LYD492 | tomato\|10v1\|DB714406 | tomato | 429 | 630 |
| LYD495 | wheat\|gb164\|BG604441 | wheat | 430 | 631 |
| LYD498 | b_juncea\|10v2\|E6ANDIZ01AJQJC | b_juncea | 432 | 633 |
| LYD499 | b_juncea\|10v2\|E6ANDIZ01B9PEA | b_juncea | 433 | 634 |
| LYD500 | b_juncea\|10v2\|E6ANDIZ02FZU2Y2 | b_juncea | 434 | 635 |
| LYD503 | maize\|10v1\|AI637036 | maize | 437 | 638 |
| LYD504 | medicago\|09v1\|AA660909 | *medicago* | 438 | 639 |
| LYD506 | medicago\|09v1\|BE239698 | *medicago* | 440 | 641 |
| LYD507 | sorghum\|09v1\|SB01G017330 | *sorghum* | 441 | 642 |
| LYD508 | sorghum\|09v1\|SB02G014460 | *sorghum* | 442 | 643 |
| LYD509 | sorghum\|09v1\|SB02G028300 | *sorghum* | 443 | 644 |
| LYD510 | sorghum\|09v1\|SB09G025320 | *sorghum* | 444 | 645 |
| LYD511 | soybean\|11v1\|BE660230 | soybean | 445 | 646 |
| LYD512 | soybean\|11v1\|GLYMA03G36420 | soybean | 446 | 647 |
| LYD513 | soybean\|11v1\|GLYMA03G39480 | soybean | 447 | 648 |
| LYD514 | soybean\|11v1\|GLYMA05G04990 | soybean | 448 | 649 |
| LYD515 | soybean\|11v1\|GLYMA07G36970 | soybean | 449 | 650 |
| LYD516 | soybean\|11v1\|GLYMA13G24040 | soybean | 450 | 651 |
| LYD517 | soybean\|11v1\|GLYMA15G06930 | soybean | 451 | 652 |
| LYD519 | soybean\|gb168\|AW686841 | soybean | 453 | 654 |
| LYD297 | arabidopsis\|10v1\|AT1G51440 | *arabidopsis* | 267 | 703 |
| LYD306 | arabidopsis\|10v1\|AT2G07674 | *arabidopsis* | 276 | 704 |
| LYD308 | arabidopsis\|10v1\|AT2G37478 | *arabidopsis* | 278 | 705 |
| LYD310 | arabidopsis\|10v1\|AT2G40300 | *arabidopsis* | 280 | 706 |
| LYD315 | arabidopsis\|10v1\|AT3G05390 | *arabidopsis* | 284 | 707 |
| LYD347 | b_juncea\|10v2\|BJ1SLX00219277D1 | b_juncea | 312 | 708 |
| LYD348 | b_juncea\|10v2\|BJ1SLX01241733D1 | b_juncea | 313 | 709 |
| LYD349 | b_juncea\|10v2\|E6ANDIZ01A0PVA | b_juncea | 314 | 710 |
| LYD351 | b_juncea\|10v2\|E6ANDIZ01A2WXZ | b_juncea | 315 | 711 |
| LYD352 | b_juncea\|10v2\|E6ANDIZ01A7124 | b_juncea | 316 | 712 |
| LYD353 | b_juncea\|10v2\|E6ANDIZ01AK44C | b_juncea | 317 | 713 |
| LYD354 | b_juncea\|10v2\|E6ANDIZ01ALST2 | b_juncea | 318 | 714 |
| LYD356 | b_juncea\|10v2\|E6ANDIZ01AR3Y3 | b_juncea | 320 | 715 |
| LYD357 | b_juncea\|10v2\|E6ANDIZ01AU0CH | b_juncea | 321 | 716 |
| LYD358 | b_juncea\|10v2\|E6ANDIZ01AUG5K | b_juncea | 322 | 717 |
| LYD359 | b_juncea\|10v2\|E6ANDIZ01AVIGM | b_juncea | 323 | 718 |
| LYD360 | b_juncea\|10v2\|E6ANDIZ01BHOKJ | b_juncea | 324 | 719 |
| LYD361 | b_juncea\|10v2\|E6ANDIZ01BIDFA | b_juncea | 325 | 720 |
| LYD364 | b_juncea\|10v2\|E6ANDIZ01ET44E | b_juncea | 327 | 721 |
| LYD365 | b_juncea\|10v2\|E6ANDIZ01EWUI0 | b_juncea | 328 | 722 |
| LYD366 | b_juncea\|10v2\|E6ANDIZ02FS13L | b_juncea | 329 | 723 |
| LYD367 | b_juncea\|10v2\|E6ANDIZ02GKPXS | b_juncea | 330 | 724 |
| LYD370 | barley\|10v2\|AV834829 | barley | 332 | 725 |
| LYD375 | canola\|10v1\|DY011663 | canola | 334 | 726 |
| LYD377 | canola\|10v1\|EV098360 | canola | 336 | 727 |
| LYD378 | canola\|10v1\|EV114958 | canola | 337 | 728 |
| LYD379 | canola\|10v1\|EV129887 | canola | 338 | 729 |
| LYD382 | cotton\|10v2\|AI726887 | cotton | 340 | 730 |
| LYD383 | cotton\|10v2\|BG447338 | cotton | 341 | 731 |
| LYD385 | cotton\|10v2\|DN799940 | cotton | 342 | 732 |
| LYD386 | cotton\|10v2\|DN804420 | cotton | 343 | 733 |
| LYD387 | cotton\|10v2\|DT466425 | cotton | 344 | 734 |
| LYD388 | cotton\|10v2\|EX167553 | cotton | 345 | 735 |
| LYD390 | cotton\|gb164\|AI055341 | cotton | 346 | 736 |
| LYD391 | maize\|10v1\|AA011869 | maize | 347 | 737 |
| LYD392 | maize\|10v1\|BE512624 | maize | 348 | 738 |
| LYD393 | medicago\|09v1\|AI974481 | *medicago* | 349 | 739 |
| LYD396 | medicago\|09v1\|AW256719 | *medicago* | 351 | 740 |
| LYD397 | medicago\|09v1\|AW257291 | *medicago* | 352 | 741 |
| LYD398 | medicago\|09v1\|AW329709 | *medicago* | 353 | 742 |
| LYD403 | medicago\|09v1\|AW698677 | *medicago* | 357 | 743 |
| LYD404 | medicago\|09v1\|AW736500 | *medicago* | 358 | 744 |
| LYD405 | medicago\|09v1\|AW775077 | *medicago* | 359 | 745 |
| LYD408 | medicago\|09v1\|BE324051 | *medicago* | 361 | 746 |

TABLE 53-continued

Identified polynucleotides which affect plant yield, seed yield, oil yield, oil content, biomass, growth rate, vigor, fiber yield, fiber quality abiotic stress tolerance and/or nitrogen use efficiency of a plant

| Gene Name | Cluster Name | Organism | Polyn. SEQ ID NO: | Polyp. SEQ ID NO: |
|---|---|---|---|---|
| LYD409 | medicago\|09v1\|BF521188 | medicago | 362 | 747 |
| LYD410 | medicago\|09v1\|BG452469 | medicago | 363 | 748 |
| LYD413 | medicago\|09v1\|BQ124797 | medicago | 364 | 749 |
| LYD415 | medicago\|09v1\|CX516971 | medicago | 366 | 750 |
| LYD416 | medicago\|09v1\|LLAJ388869 | medicago | 367 | 751 |
| LYD417 | medicago\|09v1\|LLAL373168 | medicago | 368 | 752 |
| LYD418 | medicago\|09v1\|LLAW688750 | medicago | 369 | 753 |
| LYD419 | medicago\|09v1\|LLAW698759 | medicago | 370 | 754 |
| LYD420 | medicago\|09v1\|LLAW776476 | medicago | 371 | 755 |
| LYD422 | medicago\|09v1\|MT454X026824 | medicago | 372 | 756 |
| LYD428 | sorghum\|09v1\|SB04G002930 | sorghum | 377 | 757 |
| LYD436 | sorghum\|09v1\|SB09G003870 | sorghum | 383 | 758 |
| LYD446 | soybean\|11v1\|GLYMA06G17910 | soybean | 392 | 759 |
| LYD449 | soybean\|11v1\|GLYMA07G10060 | soybean | 394 | 760 |
| LYD452 | soybean\|11v1\|GLYMA09G31720 | soybean | 397 | 761 |
| LYD455 | soybean\|11v1\|GLYMA11G11560 | soybean | 400 | 762 |
| LYD456 | soybean\|11v1\|GLYMA12G01770 | soybean | 401 | 763 |
| LYD462 | soybean\|11v1\|GLYMA16G04350 | soybean | 406 | 764 |
| LYD470 | soybean\|11v1\|GLYMA19G43610 | soybean | 412 | 765 |
| LYD480 | tomato\|10v1\|AI771275 | tomato | 421 | 766 |
| LYD483 | tomato\|10v1\|AW738746 | tomato | 424 | 767 |
| LYD487 | tomato\|10v1\|BG127385 | tomato | 426 | 768 |
| LYD497 | b_juncea\|10v2\|E6ANDIZ01AJCUK | b_juncea | 431 | 769 |
| LYD501 | b_juncea\|10v2\|E6ANDIZ02G70KP | b_juncea | 435 | 770 |
| LYD502 | cotton\|10v2\|DW503396 | cotton | 436 | 771 |
| LYD505 | medicago\|09v1\|AJ388789 | medicago | 439 | 772 |
| LYD518 | soybean\|11v1\|GLYMA18G48880 | soybean | 452 | 773 |
| LYD520 | soybean\|gb168\|FG994976 | soybean | 454 | 774 |
| LYD496 | arabidopsis\|10v1\|AT1G58235 | arabidopsis | 455 | — |

Table 53: Provided are the identified genes, their annotation, organism and polynucleotide and polypeptide sequence identifiers. "polynucl." = polynucleotide; "polypep." = polypeptide.

Example 13

Identification of Homologous Sequences that Increase Seed Yield, Oil Yield, Growth Rate, Oil Content, Fiber Yield, Fiber Quality, Biomass, Vigor, ABST and/or NUE of a Plant The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To identify putative orthologs of the genes affecting plant yield, oil yield, oil content, seed yield, growth rate, vigor, biomass, abiotic stress tolerance and/or nitrogen use efficiency, all sequences were aligned using the BLAST® (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

The search and identification of homologous genes involves the screening of sequence information available, for example, in public databases such as the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST® programs. There are five implementations of BLAST®, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST® algorithm calculates percent sequence identity and performs a statistical analysis of the similarity between the two sequences. The software for performing BLAST® analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/dbbrowser/protocol/prodomqry (dot) html), PIR (Hypertext Transfer Protocol://pir (dot) Georgetown (dot) edu/) or Pfam (Hypertext Transfer Protocol://World Wide Web (dot) sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Table 54, hereinbelow, lists a summary of orthologous and homologous sequences of the polynucleotide sequences and polypeptide sequences presented in Table 53 above, which were identified from the databases using the NCBI BLAST® software (e.g., using the Blastp and tBlastn algorithms) and needle (EMBOSS package) as being at least 80% homologous to the selected polynucleotides and polypeptides, and which are expected to increase plant yield, seed yield, oil yield, oil content, growth rate, fiber yield, fiber quality, biomass, vigor, ABST and/or NUE of a plant.

TABLE 54

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 775 | LYD289 arabidopsis_lyrata\|09v1\|JGIAL000025_P1 | 8385 | 456 | 97.5 | globlastp |
| 776 | LYD289 thellungiella_halophilum\|11v1\|EHJGI11009026_P1 | 8386 | 456 | 94.7 | globlastp |
| 777 | LYD289 thellungiella_parvulum\|11v1\|EPPRD006110_P1 | 8387 | 456 | 94.2 | globlastp |
| 778 | LYD289 b_rapa\|gb162\|EX015582_P1 | 8388 | 456 | 92.2 | globlastp |
| 779 | LYD289 canola\|10v1\|CD838013 | 8389 | 456 | 92.2 | globlastp |
| 780 | LYD289 canola\|11v1\|X70976_P1 | 8389 | 456 | 92.2 | globlastp |
| 781 | LYD289 canola\|10v1\|CD838346 | 8390 | 456 | 91.9 | globlastp |
| 782 | LYD289 canola\|11v1\|EE392267_P1 | 8391 | 456 | 87.3 | globlastp |
| 783 | LYD289 radish\|gb164\|EV524997 | 8392 | 456 | 85.7 | globlastp |
| 784 | LYD289 clementine\|11v1\|CV885474_P1 | 8393 | 456 | 80.4 | globlastp |
| 784 | LYD289 orange\|11v1\|CV885474_P1 | 8393 | 456 | 80.4 | globlastp |
| 785 | LYD289 citrus\|gb166\|CN181683_P1 | 8393 | 456 | 80.4 | globlastp |
| 786 | LYD290 arabidopsis_lyrata\|09v1\|JGIAL000925_P1 | 8394 | 457 | 96.8 | globlastp |
| 787 | LYD290 thellungiella_halophilum\|11v1\|EHJGI11006296_P1 | 8395 | 457 | 91.0 | globlastp |
| 788 | LYD290 canola\|11v1\|EE463735_P1 | 8396 | 457 | 89.0 | globlastp |
| 789 | LYD290 canola\|10v1\|CX281813 | 8397 | 457 | 88.6 | globlastp |
| 790 | LYD290 thellungiella_parvulum\|11v1\|EPCRP000414_P1 | 8398 | 457 | 87.8 | globlastp |
| 791 | LYD290 radish\|gb164\|EW714848 | 8399 | 457 | 87.7 | globlastp |
| 792 | LYD290 radish\|gb164\|EX764242 | 8400 | 457 | 87.7 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 793 | LYD290 radish\|gb164\|EV528912 | 8401 | 457 | 87.2 | globlastp |
| 794 | LYD290 canola\|10v1\|CD812241 | 8402 | 457 | 86.5 | globlastp |
| 795 | LYD290 canola\|11v1\|EE459182_P1 | 8402 | 457 | 86.5 | globlastp |
| 796 | LYD290 radish\|gb164\|EV535180 | 8403 | 457 | 86.3 | globlastp |
| 797 | LYD290 b_oleracea\|gb161\|AM385056_P1 | 8404 | 457 | 85.5 | globlastp |
| 798 | LYD290 b_rapa\|gb162\|BQ790947_P1 | 8404 | 457 | 85.5 | globlastp |
| 799 | LYD290 canola\|11v1\|EE423859_P1 | 8405 | 457 | 85.0 | globlastp |
| 800 | LYD290 canola\|11v1\|EV164120_P1 | 8405 | 457 | 85.0 | globlastp |
| 801 | LYD290 canola\|10v1\|EE400596 | 8405 | 457 | 85.0 | globlastp |
| 802 | LYD290 canola\|11v1\|EE400596_P1 | 8406 | 457 | 84.5 | globlastp |
| 803 | LYD290 canola\|11v1\|SRR001111.29348_T1 | 8407 | 457 | 83.1 | glotblastn |
| 804 | LYD291 arabidopsis_lyrata\|09v1\|JGIAL001113_P1 | 8408 | 458 | 94.2 | globlastp |
| 805 | LYD291 thellungiella_parvulum\|11v1\|EPCRP003305_P1 | 8409 | 458 | 89.9 | globlastp |
| 806 | LYD291 radish\|gb164\|EW714016 | 8410 | 458 | 86.1 | globlastp |
| 807 | LYD291 canola\|11v1\|EE455360_P1 | 8411 | 458 | 85.3 | globlastp |
| 808 | LYD291 canola\|10v1\|CD831215 | 8412 | 458 | 85.0 | globlastp |
| 809 | LYD291 thellungiella_halophilum\|11v1\|EHJGI11007638_P1 | 8413 | 458 | 83.5 | globlastp |
| 810 | LYD291 canola\|11v1\|EE455394_T1 | 8414 | 458 | 83.4 | glotblastn |
| 811 | LYD291 thellungiella_halophilum\|11v1\|BY809645_P1 | 8415 | 458 | 81.9 | globlastp |
| 812 | LYD291 canola\|11v1\|AY570246_P1 | 8416 | 458 | 81.1 | globlastp |
| 813 | LYD291 arabidopsis\|10v1\|AT1G60960_P1 | 8417 | 458 | 80.2 | globlastp |
| 814 | LYD292 arabidopsis_lyrata\|09v1\|JGIAL001445_T1 | 8418 | 459 | 96.6 | glotblastn |
| 815 | LYD292 thellungiella_halophilum\|11v1\|EHJGI11008582_P1 | 8419 | 459 | 86.0 | globlastp |
| 816 | LYD292 thellungiella_parvulum\|11v1\|EPCRP003439_P1 | 8420 | 459 | 84.3 | globlastp |
| 817 | LYD293 arabidopsis_lyrata\|09v1\|JGIAL001542_P1 | 8421 | 460 | 97.9 | globlastp |
| 818 | LYD293 thellungiella_halophilum\|11v1\|BY811797_P1 | 8422 | 460 | 94.0 | globlastp |
| 819 | LYD293 thellungiella_parvulum\|11v1\|BY811797_P1 | 8423 | 460 | 93.6 | globlastp |
| 820 | LYD293 canola\|10v1\|CN828845 | 8424 | 460 | 92.9 | globlastp |
| 821 | LYD293 thellungiella_parvulum\|11v1\|EPCRP016377_P1 | 8425 | 460 | 92.7 | globlastp |
| 822 | LYD293 canola\|11v1\|EE460144_P1 | 8426 | 460 | 92.5 | globlastp |
| 823 | LYD293 canola\|11v1\|CN828844XX1_P1 | 8427 | 460 | 92.5 | globlastp |
| 824 | LYD293 b_rapa\|gb162\|EE527596_P1 | 8427 | 460 | 92.5 | globlastp |
| 825 | LYD293 canola\|11v1\|EE450219_P1 | 8428 | 460 | 92.4 | globlastp |
| 826 | LYD293 canola\|10v1\|ES268763 | 8428 | 460 | 92.4 | globlastp |
| 827 | LYD293 canola\|11v1\|DY002521_P1 | 8429 | 460 | 91.6 | globlastp |
| 828 | LYD293 canola\|10v1\|DY002521 | 8430 | 460 | 91.2 | globlastp |
| 829 | LYD293 b_rapa\|gb162\|EE519430_P1 | 8431 | 460 | 91.1 | globlastp |
| 830 | LYD293 canola\|10v1\|EE423673 | 8432 | 460 | 90.7 | globlastp |
| 831 | LYD293 canola\|11v1\|EE423673_P1 | 8432 | 460 | 90.7 | globlastp |
| 832 | LYD293 radish\|gb164\|EV527277 | 8433 | 460 | 90.0 | globlastp |
| 833 | LYD293 radish\|gb164\|EV544441 | 8434 | 460 | 84.0 | globlastp |
| 834 | LYD294 arabidopsis_lyrata\|09v1\|JGIAL002839_P1 | 8435 | 461 | 86.5 | globlastp |
| 835 | LYD295 arabidopsis_lyrata\|09v1\|CRPALE007345_P1 | 8436 | 462 | 97.4 | globlastp |
| 836 | LYD295 thellungiella_halophilum\|11v1\|BY803200_P1 | 8437 | 462 | 92.9 | globlastp |
| 837 | LYD295 canola\|11v1\|DY000828_P1 | 8438 | 462 | 91.8 | globlastp |
| 838 | LYD295 thellungiella_parvulum\|11v1\|BY803200_P1 | 8439 | 462 | 91.2 | globlastp |
| 839 | LYD296 arabidopsis_lyrata\|09v1\|JGIAL003210_P1 | 8440 | 463 | 96.8 | globlastp |
| 840 | LYD296 thellungiella_halophilum\|11v1\|BI698637_P1 | 8441 | 463 | 94.3 | globlastp |
| 841 | LYD296 thellungiella_parvulum\|11v1\|BI698637_P1 | 8442 | 463 | 93.0 | globlastp |
| 842 | LYD296 canola\|11v1\|ES904420_P1 | 8443 | 463 | 91.8 | globlastp |
| 843 | LYD296 canola\|11v1\|EV195038_T1 | 8444 | 463 | 91.7 | glotblastn |
| 844 | LYD296 canola\|10v1\|CX190497 | 8445 | 463 | 82.2 | globlastp |
| 845 | LYD296 clementine\|11v1\|AU186361_P1 | 8446 | 463 | 80.2 | globlastp |
| 846 | LYD297 arabidopsis_lyrata\|09v1\|JGIAL004619_P1 | 8447 | 464 | 94.1 | globlastp |
| 847 | LYD297 thellungiella_halophilum\|11v1\|EHPRD123648_T1 | 8448 | 464 | 87.3 | glotblastn |
| 848 | LYD297 thellungiella_halophilum\|11v1\|BY826241_P1 | 8449 | 464 | 85.4 | globlastp |
| 849 | LYD297 thellungiella_parvulum\|11v1\|BY826241_P1 | 8450 | 464 | 84.5 | globlastp |
| 850 | LYD298 arabidopsis_lyrata\|09v1\|JGIAL005061_P1 | 8451 | 465 | 96.6 | globlastp |
| 851 | LYD298 thellungiella_parvulum\|11v1\|DN774820_P1 | 8452 | 465 | 89.7 | globlastp |
| 852 | LYD298 thellungiella_halophilum\|11v1\|EHJGI11005569_P1 | 8453 | 465 | 88.5 | globlastp |
| 853 | LYD298 b_oleracea\|gb1611\|DY018968_P1 | 8454 | 465 | 84.8 | globlastp |
| 854 | LYD298 canola\|11v1\|SRR019558.22273_P1 | 8455 | 465 | 83.8 | globlastp |
| 855 | LYD298 radish\|gb164\|EV569831 | 8456 | 465 | 83.6 | globlastp |
| 856 | LYD299 arabidopsis_lyrata\|09v1\|JGIAL005797_P1 | 8457 | 466 | 92.5 | globlastp |
| 857 | LYD299 thellungiella_halophilum\|11v1\|EHJGI11022086_P1 | 8458 | 466 | 89.7 | globlastp |
| 858 | LYD299 thellungiella_parvulum\|11v1\|EPCRP005928_P1 | 8459 | 466 | 87.8 | globlastp |
| 859 | LYD300 arabidopsis_lyrata\|09v1\|JGIAL005765_P1 | 8460 | 467 | 98.0 | globlastp |
| 860 | LYD300 thellungiella_parvulum\|11v1\|DN777634_P1 | 8461 | 467 | 89.9 | globlastp |
| 861 | LYD300 thellungiella_halophilum\|11v1\|DN777634_P1 | 8462 | 467 | 88.8 | globlastp |
| 862 | LYD300 radish\|gb164\|EW724622 | 8463 | 467 | 86.4 | globlastp |
| 863 | LYD300 canola\|10v1\|CD815396 | 8464 | 467 | 85.9 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 864 | LYD300 canola\|11v1\|EE420053_P1 | 8465 | 467 | 83.8 | globlastp |
| 865 | LYD300 b_rapa\|gb162\|BQ791464_P1 | 8466 | 467 | 83.5 | globlastp |
| 866 | LYD300 canola\|10v1\|CD813019 | 8467 | 467 | 83.2 | globlastp |
| 867 | LYD300 canola\|10v1\|CD816911 | 8468 | 467 | 83.2 | globlastp |
| 868 | LYD300 canola\|11v1\|CN825981_P1 | 8469 | 467 | 83.2 | globlastp |
| 869 | LYD300 radish\|gb164\|EX747587 | 8470 | 467 | 82.2 | globlastp |
| 870 | LYD301 arabidopsis_lyrata\|09v1\|JGIAL007744_P1 | 8471 | 468 | 95.1 | globlastp |
| 871 | LYD301 thellungiella_halophilum\|11v1\|BY805365_P1 | 8472 | 468 | 92.0 | globlastp |
| 872 | LYD301 thellungiella_parvulum\|11v1\|BY805365_P1 | 8473 | 468 | 90.1 | globlastp |
| 873 | LYD301 canola\|11v1\|EE543579_P1 | 8474 | 468 | 87.2 | globlastp |
| 874 | LYD302 arabidopsis_lyrata\|09v1\|JGIAL007979_P1 | 8475 | 469 | 97.9 | globlastp |
| 875 | LYD302 thellungiella_halophilum\|11v1\|BY805311_P1 | 8476 | 469 | 95.0 | globlastp |
| 876 | LYD302 thellungiella_parvulum\|11v1\|BY805311_P1 | 8477 | 469 | 94.1 | globlastp |
| 877 | LYD302 thellungiella_halophilum\|11v1\|EHJGI11028715_P1 | 8478 | 469 | 93.8 | globlastp |
| 878 | LYD302 canola\|11v1\|EE425272_P1 | 8479 | 469 | 93.3 | globlastp |
| 879 | LYD302 b_rapa\|gb162\|BQ791216_P1 | 8480 | 469 | 93.0 | globlastp |
| 880 | LYD302 canola\|11v1\|EE482659_P1 | 8481 | 469 | 93.0 | globlastp |
| 881 | LYD302 radish\|gb164\|EW714306 | 8482 | 469 | 91.6 | globlastp |
| 882 | LYD302 thellungiella_halophilum\|11v1\|BY820865_P1 | 8483 | 469 | 84.4 | globlastp |
| 883 | LYD302 arabidopsis_lyrata\|09v1\|JGIAL002264_P1 | 8484 | 469 | 82.6 | globlastp |
| 884 | LYD302 thellungiella_parvulum\|11v1\|BY820865_P1 | 8485 | 469 | 82.0 | globlastp |
| 885 | LYD302 arabidopsis_lyrata\|09v1\|TMPLAT1G21440T1_P1 | 8486 | 469 | 82.0 | globlastp |
| 885 | LYD302 arabidopsis\|10v1\|AT1G21440_P1 | 8486 | 469 | 82.0 | globlastp |
| 886 | LYD302 cacao\|10v1\|CU474081_T1 | 8487 | 469 | 81.5 | glotblastn |
| 887 | LYD302 cotton\|10v2\|DT560838_T1 | 8488 | 469 | 81.1 | glotblastn |
| 888 | LYD302 canola\|11v1\|EE556537XX1_P1 | 8489 | 469 | 81.1 | globlastp |
| 889 | LYD302 canola\|11v1\|EE454393XX1_P1 | 8490 | 469 | 80.8 | globlastp |
| 890 | LYD302 canola\|10v1\|EE554922 | 8491 | 469 | 80.6 | globlastp |
| 891 | LYD302 b_rapa\|gb162\|EE523860_T1 | 8492 | 469 | 80.5 | glotblastn |
| 892 | LYD302 radish\|gb164\|EW731644 | 8493 | 469 | 80.0 | glotblastn |
| 893 | LYD303 arabidopsis_lyrata\|09v1\|JGIAL016316_P1 | 8494 | 470 | 91.4 | globlastp |
| 894 | LYD304 arabidopsis_lyrata\|09v1\|JGIAL016586_T1 | 8495 | 471 | 91.1 | glotblastn |
| 895 | LYD305 arabidopsis\|10v1\|AT5G04800_P1 | 8496 | 472 | 98.6 | globlastp |
| 896 | LYD305 arabidopsis\|10v1\|AT2G04390_P1 | 8497 | 472 | 97.2 | globlastp |
| 897 | LYD305 arabidopsis_lyrata\|09v1\|JGIAL020130_P1 | 8498 | 472 | 95.7 | globlastp |
| 898 | LYD305 thellungiella_parvulum\|11v1\|BY818903_P1 | 8499 | 472 | 93.6 | globlastp |
| 899 | LYD305 thellungiella_parvulum\|11v1\|EPPRD115633_P1 | 8499 | 472 | 93.6 | globlastp |
| 900 | LYD305 canola\|11v1\|EE542539_P1 | 8500 | 472 | 92.9 | globlastp |
| 901 | LYD305 arabidopsis_lyrata\|09v1\|JGIAL009483_P1 | 8501 | 472 | 92.9 | globlastp |
| 902 | LYD305 b_rapa\|gb162\|BQ791494_P1 | 8500 | 472 | 92.9 | globlastp |
| 903 | LYD305 canola\|10v1\|CD818148 | 8500 | 472 | 92.9 | globlastp |
| 904 | LYD305 canola\|10v1\|DW997476 | 8500 | 472 | 92.9 | globlastp |
| 905 | LYD305 canola\|11v1\|DW997476_P1 | 8500 | 472 | 92.9 | globlastp |
| 906 | LYD305 canola\|10v1\|H74364 | 8500 | 472 | 92.9 | globlastp |
| 907 | LYD305 canola\|11v1\|DY005944_P1 | 8500 | 472 | 92.9 | globlastp |
| 908 | LYD305 b_juncea\|10v2\|E6ANDIZ01AKDJV_P1 | 8502 | 472 | 92.1 | globlastp |
| 909 | LYD305 b_oleracea\|gb161\|AM395123_P1 | 8503 | 472 | 92.1 | globlastp |
| 910 | LYD305 canola\|10v1\|CD829722 | 8504 | 472 | 92.1 | globlastp |
| 911 | LYD305 b_juncea\|10v2\|E6ANDIZ01A3UPM_P1 | 8505 | 472 | 91.4 | globlastp |
| 912 | LYD305 b_oleracea\|gb161\|DY025855_P1 | 8506 | 472 | 91.4 | globlastp |
| 913 | LYD305 b_rapa\|gb162\|L33499_P1 | 8507 | 472 | 91.4 | globlastp |
| 914 | LYD305 canola\|10v1\|BQ704882 | 8507 | 472 | 91.4 | globlastp |
| 915 | LYD305 canola\|11v1\|CN735924_P1 | 8507 | 472 | 91.4 | globlastp |
| 916 | LYD305 canola\|10v1\|DY002163 | 8506 | 472 | 91.4 | globlastp |
| 917 | LYD305 cleome_gynandra\|10v1\|SRR015532S0002452_P1 | 8508 | 472 | 91.4 | globlastp |
| 918 | LYD305 cleome_gynandra\|10v1\|SRR015532S0003534_P1 | 8509 | 472 | 91.4 | globlastp |
| 919 | LYD305 cleome_spinosa\|10v1\|SRR015531S0000304_P1 | 8510 | 472 | 91.4 | globlastp |
| 920 | LYD305 radish\|gb164\|EV538469 | 8511 | 472 | 91.4 | globlastp |
| 921 | LYD305 canola\|11v1\|CN730447_P1 | 8506 | 472 | 91.4 | globlastp |
| 922 | LYD305 thellungiella_halophilum\|11v1\|BY818903_P1 | 8512 | 472 | 90.7 | globlastp |
| 923 | LYD305 thellungiella_halophilum\|11v1\|DN773465_P1 | 8512 | 472 | 90.7 | globlastp |
| 924 | LYD305 b_juncea\|10v2\|E6ANDIZ01BM05C_P1 | 8513 | 472 | 90.7 | globlastp |
| 925 | LYD305 cleome_spinosa\|10v1\|GR934344_P1 | 8514 | 472 | 90.7 | globlastp |
| 926 | LYD305 cleome_spinosa\|10v1\|SRR015531S0032977_P1 | 8515 | 472 | 90.7 | globlastp |
| 927 | LYD305 radish\|gb164\|EW723495 | 8516 | 472 | 90.7 | globlastp |
| 928 | LYD305 thellungiella\|gb167\|DN773465 | 8512 | 472 | 90.7 | globlastp |
| 929 | LYD305 thellungiella_parvulum\|11v1\|DN773465_P1 | 8517 | 472 | 90.0 | globlastp |
| 930 | LYD305 b_juncea\|10v2\|E6ANDIZ01B49UE_P1 | 8518 | 472 | 90.0 | globlastp |
| 931 | LYD305 b_oleracea\|gb161\|DY026579_P1 | 8518 | 472 | 90.0 | globlastp |
| 932 | LYD305 b_rapa\|gb162\|BQ790954_P1 | 8518 | 472 | 90.0 | globlastp |
| 933 | LYD305 b_rapa\|gb162\|CX266502_P1 | 8518 | 472 | 90.0 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 934 | LYD305 canola\|10v1\|BQ704890 | 8518 | 472 | 90.0 | globlastp |
| 935 | LYD305 canola\|11v1\|CN732900_P1 | 8518 | 472 | 90.0 | globlastp |
| 936 | LYD305 canola\|10v1\|CD811690 | 8518 | 472 | 90.0 | globlastp |
| 937 | LYD305 canola\|10v1\|CD833606 | 8518 | 472 | 90.0 | globlastp |
| 938 | LYD305 canola\|11v1\|CN725771_P1 | 8518 | 472 | 90.0 | globlastp |
| 939 | LYD305 canola\|10v1\|CD838146 | 8518 | 472 | 90.0 | globlastp |
| 940 | LYD305 canola\|11v1\|EV013283_P1 | 8518 | 472 | 90.0 | globlastp |
| 941 | LYD305 radish\|gb164\|EV547744 | 8519 | 472 | 90.0 | globlastp |
| 942 | LYD305 radish\|gb164\|EX757400 | 8519 | 472 | 90.0 | globlastp |
| 943 | LYD305 arabidopsis\|10v1\|AT3G10610_P1 | 8520 | 472 | 89.4 | globlastp |
| 944 | LYD305 canola\|11v1\|CN731537_P1 | 8521 | 472 | 89.3 | globlastp |
| 945 | LYD305 thellungiella_parvulum\|11v1\|EPCRP026669_P1 | 8522 | 472 | 88.7 | globlastp |
| 946 | LYD305 arabidopsis_lyrata\|09v1\|JGIAL020299_P1 | 8523 | 472 | 88.7 | globlastp |
| 947 | LYD305 b_juncea\|10v2\|E6ANDIZ01A825A_P1 | 8524 | 472 | 88.6 | globlastp |
| 948 | LYD305 b_juncea\|10v2\|E6ANDIZ01AWTB3_P1 | 8525 | 472 | 88.6 | globlastp |
| 949 | LYD305 b_juncea\|10v2\|E6ANDIZ01B1MYC_P1 | 8526 | 472 | 88.6 | globlastp |
| 950 | LYD305 b_rapa\|gb162\|CV432393_P1 | 8527 | 472 | 88.6 | globlastp |
| 951 | LYD305 canola\|10v1\|CN731537 | 8526 | 472 | 88.6 | globlastp |
| 952 | LYD305 canola\|10v1\|CX195384 | 8528 | 472 | 88.6 | globlastp |
| 953 | LYD305 radish\|gb164\|EW723870 | 8529 | 472 | 88.6 | globlastp |
| 954 | LYD305 radish\|gb164\|FD541521 | 8529 | 472 | 88.6 | globlastp |
| 955 | LYD305 canola\|11v1\|H07655_P1 | 8530 | 472 | 87.9 | globlastp |
| 956 | LYD305 clementine\|11v1\|BQ623498_P1 | 8531 | 472 | 87.9 | globlastp |
| 957 | LYD305 b_rapa\|gb162\|CV544775_P1 | 8532 | 472 | 87.9 | globlastp |
| 958 | LYD305 canola\|10v1\|H07655 | 8530 | 472 | 87.9 | globlastp |
| 959 | LYD305 canola\|11v1\|CN830662_P1 | 8530 | 472 | 87.9 | globlastp |
| 960 | LYD305 citrus\|gb166\|BQ623498_P1 | 8531 | 472 | 87.9 | globlastp |
| 961 | LYD305 eucalyptus\|11v2\|CT980130_P1 | 8533 | 472 | 87.9 | globlastp |
| 962 | LYD305 eucalyptus\|gb166\|CT980130 | 8533 | 472 | 87.9 | globlastp |
| 963 | LYD305 radish\|gb164\|EV537169 | 8534 | 472 | 87.9 | globlastp |
| 964 | LYD305 radish\|gb164\|EW725140 | 8535 | 472 | 87.9 | globlastp |
| 965 | LYD305 radish\|gb164\|EX905460 | 8536 | 472 | 87.9 | globlastp |
| 966 | LYD305 cucurbita\|11v1\|SRR091276X101995_P1 | 8537 | 472 | 87.3 | globlastp |
| 967 | LYD305 cucumber\|09v1\|CF542153_P1 | 8538 | 472 | 87.3 | globlastp |
| 968 | LYD305 momordica\|10v1\|SRR071315S0010678_P1 | 8539 | 472 | 87.3 | globlastp |
| 969 | LYD305 canola\|11v1\|ES959302_P1 | 8540 | 472 | 87.1 | globlastp |
| 970 | LYD305 orange\|11v1\|BQ623498_P1 | 8541 | 472 | 87.1 | globlastp |
| 971 | LYD305 b_oleracea\|gb161\|DY028158_P1 | 8542 | 472 | 87.1 | globlastp |
| 972 | LYD305 watermelon\|11v1\|CK758693_P1 | 8543 | 472 | 86.6 | globlastp |
| 973 | LYD305 melon\|10v1\|DV634694_P1 | 8543 | 472 | 86.6 | globlastp |
| 974 | LYD305 thellungiella_halophilum\|11v1\|EHJGI11023897_P1 | 8544 | 472 | 86.5 | globlastp |
| 975 | LYD305 radish\|gb164\|EV528035 | 8545 | 472 | 86.4 | glotblastn |
| 976 | LYD305 radish\|gb164\|EX898193 | 8546 | 472 | 86.4 | globlastp |
| 977 | LYD305 b_juncea\|10v2\|E6ANDIZ02FYL81_T1 | 8547 | 472 | 85.7 | glotblastn |
| 978 | LYD305 nasturtium\|10v1\|SRR032558S0001828 | 8548 | 472 | 85.2 | globlastp |
| 979 | LYD305 nasturtium\|10v1\|SRR032558S0006197 | 8549 | 472 | 85.2 | globlastp |
| 980 | LYD305 nasturtium\|10v1\|SRR032558S0019880 | 8550 | 472 | 85.2 | globlastp |
| 981 | LYD305 nasturtium\|10v1\|SRR032558S0037901 | 8548 | 472 | 85.2 | globlastp |
| 982 | LYD305 eucalyptus\|11v2\|SRR001658X13518_P1 | 8551 | 472 | 85.1 | globlastp |
| 983 | LYD305 b_juncea\|10v2\|E6ANDIZ02IJUBZ_P1 | 8552 | 472 | 85.0 | globlastp |
| 984 | LYD305 cucurbita\|11v1\|SRR091276X106216_P1 | 8553 | 472 | 84.5 | globlastp |
| 985 | LYD305 poplar\|10v1\|AI161459_P1 | 8554 | 472 | 84.4 | globlastp |
| 986 | LYD305 flax\|11v1\|JG019933_P1 | 8555 | 472 | 83.7 | globlastp |
| 987 | LYD305 flax\|11v1\|JG081511_P1 | 8555 | 472 | 83.7 | globlastp |
| 988 | LYD305 canola\|11v1\|SRR019558.10631_P1 | 8556 | 472 | 83.6 | globlastp |
| 989 | LYD305 tamarix\|gb166\|CN605585 | 8557 | 472 | 83.6 | globlastp |
| 990 | LYD305 humulus\|11v1\|ES437765_P1 | 8558 | 472 | 83.3 | globlastp |
| 991 | LYD305 humulus\|11v1\|ES654856_P1 | 8558 | 472 | 83.3 | globlastp |
| 992 | LYD305 scabiosa\|11v1\|SRR063723X102091_P1 | 8559 | 472 | 83.3 | globlastp |
| 993 | LYD305 apple\|gb171\|CN444753 | 8560 | 472 | 82.9 | globlastp |
| 994 | LYD305 b_juncea\|10v2\|BJ1SLX00095161D1_P1 | 8561 | 472 | 82.9 | globlastp |
| 995 | LYD305 chestnut\|gb170\|SRR006295S0017520_P1 | 8562 | 472 | 82.8 | globlastp |
| 996 | LYD305 cannabis\|12v1\|JK496756_P1 | 8563 | 472 | 82.6 | globlastp |
| 997 | LYD305 euphorbia\|11v1\|BP959159_P1 | 8564 | 472 | 82.6 | globlastp |
| 998 | LYD305 scabiosa\|11v1\|SRR063723X109162_P1 | 8565 | 472 | 82.6 | globlastp |
| 999 | LYD305 cirsium\|11v1\|SRR349641.107790_P1 | 8566 | 472 | 82.5 | globlastp |
| 1000 | LYD305 iceplant\|gb164\|BE034284_P1 | 8567 | 472 | 82.4 | globlastp |
| 1001 | LYD305 iceplant\|gb164\|BE037266_P1 | 8568 | 472 | 82.4 | globlastp |
| 1002 | LYD305 thellungiella_halophilum\|11v1\|EHJGI11016878_P1 | 8569 | 472 | 82.3 | globlastp |
| 1003 | LYD305 aquilegia\|10v2\|JGIAC012114_P1 | 8570 | 472 | 82.3 | globlastp |
| 1004 | LYD305 soybean\|11v1\|GLYMA02G36070 | 8571 | 472 | 82.3 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name  cluster name | Polyp. SEQ ID NO: | Hom to SEQ ID NO: | % glob. iden. | Algor. |
|---|---|---|---|---|---|
| 1005 | LYD305 fagopyrum\|11v1\|SRR063689X110608_P1 | 8572 | 472 | 82.1 | globlastp |
| 1006 | LYD305 fagopyrum\|11v1\|SRR063703X101913_P1 | 8572 | 472 | 82.1 | globlastp |
| 1007 | LYD305 apple\|11v1\|CN443845_P1 | 8573 | 472 | 82.1 | globlastp |
| 1008 | LYD305 apple\|gb171\|CN900285 | 8573 | 472 | 82.1 | globlastp |
| 1009 | LYD305 beech\|gb170\|SRR006293S0024486_P1 | 8574 | 472 | 82.1 | globlastp |
| 1010 | LYD305 potato\|10v1\|BF459686_P1 | 8575 | 472 | 82.1 | globlastp |
| 1011 | LYD305 soybean\|11v1\|GLYMA10G08910 | 8576 | 472 | 82.1 | globlastp |
| 1012 | LYD305 strawberry\|11v1\|CO380606 | 8577 | 472 | 82.1 | globlastp |
| 1013 | LYD305 acacia\|10v1\|FS584770_P1 | 8578 | 472 | 81.8 | globlastp |
| 1014 | LYD305 lotus\|09v11\|LLAI967330_P1 | 8579 | 472 | 81.8 | globlastp |
| 1015 | LYD305 papaya\|gb165\|AM903848_P1 | 8580 | 472 | 81.8 | globlastp |
| 1016 | LYD305 poplar\|10v1\|AI162887_P1 | 8581 | 472 | 81.8 | globlastp |
| 1017 | LYD305 primula\|11v1\|SRR098679X100982_P1 | 8582 | 472 | 81.7 | globlastp |
| 1018 | LYD305 cacao\|10v1\|CU490530_P1 | 8583 | 472 | 81.7 | globlastp |
| 1019 | LYD305 flax\|11v1\|JG021551_P1 | 8584 | 472 | 81.6 | globlastp |
| 1020 | LYD305 cowpea\|gb166\|FC458752_P1 | 8585 | 472 | 81.6 | globlastp |
| 1021 | LYD305 cowpea\|gb166\|FC461186_P1 | 8586 | 472 | 81.6 | globlastp |
| 1022 | LYD305 cowpea\|gb166\|FG807845_P1 | 8585 | 472 | 81.6 | globlastp |
| 1023 | LYD305 cyamopsis\|10v1\|EG978086_P1 | 8587 | 472 | 81.6 | globlastp |
| 1024 | LYD305 nuphar\|gb166\|CD474501_T1 | 8588 | 472 | 81.4 | glotblastn |
| 1025 | LYD305 oil_palm\|gb166\|EL691751_T1 | 8589 | 472 | 81.4 | glotblastn |
| 1026 | LYD305 flax\|11v1\|JG025425_P1 | 8590 | 472 | 81.4 | globlastp |
| 1027 | LYD305 flax\|11v1\|JG103120_P1 | 8591 | 472 | 81.4 | globlastp |
| 1028 | LYD305 tomato\|11v1\|BG130634_P1 | 8592 | 472 | 81.4 | globlastp |
| 1029 | LYD305 watermelon\|11v1\|AM718374_P1 | 8593 | 472 | 81.4 | globlastp |
| 1030 | LYD305 watermelon\|11v1\|VMEL07812901901316_P1 | 8593 | 472 | 81.4 | globlastp |
| 1031 | LYD305 cowpea\|gb166\|FC456716_P1 | 8594 | 472 | 81.4 | globlastp |
| 1032 | LYD305 petunia\|gb171\|CV293320_P1 | 8592 | 472 | 81.4 | globlastp |
| 1033 | LYD305 solanum_phureja\|09v1\|SPHBG130634 | 8595 | 472 | 81.4 | globlastp |
| 1034 | LYD305 tomato\|09v1\|BG130634 | 8592 | 472 | 81.4 | globlastp |
| 1035 | LYD305 silene\|11v1\|GH293990_P1 | 8596 | 472 | 81.2 | globlastp |
| 1036 | LYD305 hevea\|10v1\|EC601661_P1 | 8597 | 472 | 81.2 | globlastp |
| 1037 | LYD305 lotus\|09v1\|LLBG662465_P1 | 8598 | 472 | 81.2 | globlastp |
| 1038 | LYD305 sunflower\|10v1\|CD852668 | 8599 | 472 | 81.2 | globlastp |
| 1039 | LYD305 phyla\|11v2\|SRR099035X102085_P1 | 8600 | 472 | 81.1 | globlastp |
| 1040 | LYD305 platanus\|11v1\|SRR096786X100931_P1 | 8601 | 472 | 81.1 | globlastp |
| 1041 | LYD305 beet\|gb162\|BF011095_P1 | 8602 | 472 | 81.1 | globlastp |
| 1042 | LYD305 cassava\|09v1\|DV452482_P1 | 8603 | 472 | 81.1 | globlastp |
| 1043 | LYD305 safflower\|gb162\|EL407962 | 8604 | 472 | 81.1 | globlastp |
| 1044 | LYD305 sunflower\|10v1\|CD850854 | 8605 | 472 | 81.1 | globlastp |
| 1045 | LYD305 catharanthus\|11v1\|SRR098691X102581_P1 | 8606 | 472 | 81.0 | globlastp |
| 1046 | LYD305 tabernaemontana\|11v1\|SRR098689X122851_P1 | 8607 | 472 | 81.0 | globlastp |
| 1047 | LYD305 catharanthus\|gb166\|FD420801 | 8606 | 472 | 81.0 | globlastp |
| 1048 | LYD305 cotton\|10v2\|BF269908_P1 | 8608 | 472 | 81.0 | globlastp |
| 1049 | LYD305 oak\|10v1\|DB996387_P1 | 8609 | 472 | 81.0 | globlastp |
| 1050 | LYD305 oak\|10v1\|DB997114_P1 | 8609 | 472 | 81.0 | globlastp |
| 1051 | LYD305 oak\|10v1\|DN950767_P1 | 8610 | 472 | 81.0 | globlastp |
| 1052 | LYD305 flax\|11v1\|JG082139_P1 | 8611 | 472 | 80.9 | globlastp |
| 1053 | LYD305 flax\|09v1\|CV478169 | 8611 | 472 | 80.9 | globlastp |
| 1054 | LYD305 flax\|11v1\|CV478169_P1 | 8611 | 472 | 80.9 | globlastp |
| 1055 | LYD305 platanus\|11v1\|SRR096786X100640_P1 | 8612 | 472 | 80.8 | globlastp |
| 1056 | LYD305 nicotiana_benthamiana\|gb162\|CN741402_P1 | 8613 | 472 | 80.8 | globlastp |
| 1057 | LYD305 senecio\|gb170\|DY658264 | 8614 | 472 | 80.8 | globlastp |
| 1058 | LYD305 tobacco\|gb162\|CV016993 | 8613 | 472 | 80.8 | globlastp |
| 1059 | LYD305 apple\|11v1\|CN900464_P1 | 8615 | 472 | 80.7 | globlastp |
| 1060 | LYD305 cucurbita\|11v1\|SRR091276X121946_P1 | 8616 | 472 | 80.7 | globlastp |
| 1061 | LYD305 tomato\|11v1\|X83421_P1 | 8617 | 472 | 80.7 | globlastp |
| 1062 | LYD305 tripterygium\|11v1\|SRR098677X105099_P1 | 8618 | 472 | 80.7 | globlastp |
| 1063 | LYD305 apple\|11v1\|CN488998_P1 | 8615 | 472 | 80.7 | globlastp |
| 1064 | LYD305 apple\|gb171\|CN490466 | 8615 | 472 | 80.7 | globlastp |
| 1065 | LYD305 eggplant\|10v1\|FS003192_P1 | 8619 | 472 | 80.7 | globlastp |
| 1066 | LYD305 eggplant\|10v1\|FS027213_P1 | 8620 | 472 | 80.7 | globlastp |
| 1067 | LYD305 peanut\|10v1\|EE125258_P1 | 8621 | 472 | 80.7 | globlastp |
| 1068 | LYD305 peanut\|10v1\|EE126185_P1 | 8621 | 472 | 80.7 | globlastp |
| 1069 | LYD305 petunia\|gb171\|DW177127_P1 | 8622 | 472 | 80.7 | globlastp |
| 1070 | LYD305 pigeonpea\|10v1\|GW352882_P1 | 8623 | 472 | 80.7 | globlastp |
| 1071 | LYD305 potato\|10v1\|BG351052_P1 | 8620 | 472 | 80.7 | globlastp |
| 1072 | LYD305 solanum_phureja\|09v1\|SPHX83421 | 8620 | 472 | 80.7 | globlastp |
| 1073 | LYD305 strawberry\|11v1\|EX657748 | 8624 | 472 | 80.7 | globlastp |
| 1074 | LYD305 tobacco\|gb162\|CV017499 | 8625 | 472 | 80.7 | globlastp |
| 1075 | LYD305 tobacco\|gb162\|DV158979 | 8626 | 472 | 80.7 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1076 | LYD305 tomato\|09v1\|X83421 | 8617 | 472 | 80.7 | globlastp |
| 1077 | LYD305 zostera\|10v1\|SRR057351S0003834 | 8627 | 472 | 80.7 | globlastp |
| 1078 | LYD305 euphorbia\|11v1\|DV131745_T1 | 8628 | 472 | 80.7 | glotblastn |
| 1079 | LYD305 spurge\|gb161\|DV131745 | 8628 | 472 | 80.7 | glotblastn |
| 1080 | LYD305 chelidonium\|11v1\|SRR084752X102599_P1 | 8629 | 472 | 80.6 | globlastp |
| 1081 | LYD305 silene\|11v1\|SRR096785X108850_P1 | 8630 | 472 | 80.6 | globlastp |
| 1082 | LYD305 silene\|11v1\|SRR096785X111949_P1 | 8631 | 472 | 80.6 | globlastp |
| 1083 | LYD305 cassava\|09v1\|CK644179_P1 | 8632 | 472 | 80.6 | globlastp |
| 1084 | LYD305 flaveria\|11v1\|SRR149244.160986_T1 | 8633 | 472 | 80.4 | glotblastn |
| 1085 | LYD305 amsonia\|11v1\|SRR098688X100701_P1 | 8634 | 472 | 80.4 | globlastp |
| 1086 | LYD305 primula\|11v1\|FS228389XX2_P1 | 8635 | 472 | 80.4 | globlastp |
| 1087 | LYD305 acacia\|10v1\|FS588648_P1 | 8636 | 472 | 80.4 | globlastp |
| 1088 | LYD305 lettuce\|10v1\|DW080793_P1 | 8637 | 472 | 80.4 | globlastp |
| 1089 | LYD305 prunus\|10v1\|CB819021 | 8638 | 472 | 80.4 | globlastp |
| 1090 | LYD305 cacao\|10v1\|CA796358_P1 | 8639 | 472 | 80.3 | globlastp |
| 1091 | LYD305 cotton\|10v2\|AI728552_P1 | 8640 | 472 | 80.3 | globlastp |
| 1092 | LYD305 cotton\|10v2\|BF270777_P1 | 8641 | 472 | 80.3 | globlastp |
| 1093 | LYD305 dandelion\|10v1\|DR399279_P1 | 8642 | 472 | 80.3 | globlastp |
| 1094 | LYD305 heritiera\|10v1\|SRR005794S0004691_P1 | 8643 | 472 | 80.3 | globlastp |
| 1095 | LYD305 jatropha\|09v1\|FM887263_T1 | 8644 | 472 | 80.3 | glotblastn |
| 1096 | LYD305 oil_palm\|gb166\|EL687331_T1 | 8645 | 472 | 80.1 | glotblastn |
| 1097 | LYD305 soybean\|11v1\|GLYMA20G02170 | 8646 | 472 | 80.1 | globlastp |
| 1098 | LYD305 fagopyrum\|11v1\|GO496321_P1 | 8647 | 472 | 80.0 | globlastp |
| 1099 | LYD305 fagopyrum\|11v1\|SRR063703X120141_P1 | 8648 | 472 | 80.0 | globlastp |
| 1100 | LYD305 flaveria\|11v1\|SRR149232.355422_T1 | 8649 | 472 | 80.0 | glotblastn |
| 1101 | LYD305 castorbean\|09v1\|T14820 | 8650 | 472 | 80.0 | globlastp |
| 1102 | LYD305 castorbean\|11v1\|T14820_P1 | 8650 | 472 | 80.0 | globlastp |
| 1103 | LYD305 cryptomeria\|gb166\|BP174480_T1 | 8651 | 472 | 80.0 | glotblastn |
| 1104 | LYD305 cucumber\|09v1\|AM718374_P1 | 8652 | 472 | 80.0 | globlastp |
| 1105 | LYD305 grape\|11v1\|GSVIVT01034653001_P1 | 8653 | 472 | 80.0 | globlastp |
| 1106 | LYD305 grape\|gb160\|BQ796478 | 8653 | 472 | 80.0 | globlastp |
| 1107 | LYD305 peanut\|10v1\|CX018157_P1 | 8654 | 472 | 80.0 | globlastp |
| 1108 | LYD306 arabidopsis_lyrata\|09v1\|JGIAL011613_T1 | 8655 | 473 | 100.0 | glotblastn |
| 1109 | LYD306 castorbean\|11v1\|RCCRP060025_P1 | 8656 | 473 | 91.6 | globlastp |
| 1110 | LYD306 castorbean\|11v1\|SRR020785.39278_P1 | 8656 | 473 | 91.6 | globlastp |
| 1111 | LYD306 castorbean\|09v1\|SRR020785S0039278 | 8657 | 473 | 91.6 | glotblastn |
| 1112 | LYD306 castorbean\|11v1\|EG656390_T1 | 8658 | 473 | 91.6 | glotblastn |
| 1113 | LYD306 rice\|gb170\|BI800272 | 8659 | 473 | 91.6 | glotblastn |
| 1114 | LYD306 rice\|gb170\|OS12G33922 | 8660 | 473 | 91.6 | glotblastn |
| 1115 | LYD306 rice\|gb170\|OS12G33924 | 8659 | 473 | 91.6 | glotblastn |
| 1116 | LYD306 watermelon\|11v1\|CLCRP052486_P1 | 8661 | 473 | 90.8 | globlastp |
| 1117 | LYD306 watermelon\|11v1\|VMEL10882125443088_P1 | 8661 | 473 | 90.8 | globlastp |
| 1118 | LYD306 cacao\|10v1\|CU479046_T1 | 8662 | 473 | 90.8 | glotblastn |
| 1119 | LYD306 medicago\|09v1\|CO0511977_T1 | 8663 | 473 | 90.8 | glotblastn |
| 1120 | LYD306 sorghum\|11v1\|GFXZ85978X1_T1 | 8664 | 473 | 89.9 | glotblastn |
| 1121 | LYD306 grape\|11v1\|DV224008_T1 | 8665 | 473 | 89.9 | glotblastn |
| 1122 | LYD306 grape\|gb160\|CB835105 | 8665 | 473 | 89.9 | glotblastn |
| 1123 | LYD306 grape\|11v1\|CD013707_P1 | 8666 | 473 | 89.9 | globlastp |
| 1124 | LYD306 grape\|11v1\|VVCRP224195_P1 | 8666 | 473 | 89.9 | globlastp |
| 1125 | LYD306 sorghum\|11v1\|NC_008360_G5_CDS_P1 | 8667 | 473 | 89.9 | globlastp |
| 1126 | LYD306 cannabis\|12v1\|MDCRP002851_P1 | 8668 | 473 | 89.1 | globlastp |
| 1127 | LYD306 lotus\|09v1\|CRPLJ038659_P1 | 8669 | 473 | 89.1 | globlastp |
| 1128 | LYD306 cannabis\|12v1\|SOLX00067463_T1 | 8670 | 473 | 89.1 | glotblastn |
| 1129 | LYD306 foxtail_millet\|11v3\|PHY7SI020747M_T1 | 8664 | 473 | 89.1 | glotblastn |
| 1130 | LYD306 brachypodium\|09v1\|SRR031798S0215740_T1 | 8664 | 473 | 89.1 | glotblastn |
| 1131 | LYD306 cucumber\|09v1\|BGI454G0029123_T1 | 8671 | 473 | 89.1 | glotblastn |
| 1132 | LYD306 apple\|11v1\|CN860112_T1 | 8672 | 473 | 87.4 | glotblastn |
| 1133 | LYD306 tomato\|11v1\|SRR015435S0107530_T1 | 8673 | 473 | 87.4 | glotblastn |
| 1134 | LYD306 lotus\|09v1\|CRPLJ038587_P1 | 8674 | 473 | 82.8 | globlastp |
| 1135 | LYD307 arabidopsis_lyrata\|09v1\|JGIAL012270_P1 | 8675 | 474 | 95.3 | globlastp |
| 1136 | LYD307 thellungiella_parvulum\|11v1\|DN776555_P1 | 8676 | 474 | 86.7 | globlastp |
| 1137 | LYD307 arabidopsis_lyrata\|09v1\|JGIAL022914_P1 | 8677 | 474 | 86.7 | globlastp |
| 1138 | LYD307 thellungiella_halophilum\|11v1\|DN776555_P1 | 8678 | 474 | 83.8 | globlastp |
| 1139 | LYD307 canola\|11v1\|EE555154_P1 | 8679 | 474 | 81.1 | globlastp |
| 1140 | LYD308 arabidopsis_lyrata\|09v1\|JGIAL014924_P1 | 8680 | 475 | 92.8 | globlastp |
| 1141 | LYD309 arabidopsis_lyrata\|09v1\|JGIAL015272_P1 | 8681 | 476 | 87.8 | globlastp |
| 1142 | LYD311 arabidopsis\|10v1\|AT2G40590_P1 | 8682 | 478 | 97.7 | globlastp |
| 1143 | LYD311 arabidopsis_lyrata\|09v1\|JGIAL015350_P1 | 8683 | 478 | 96.2 | globlastp |
| 1144 | LYD311 arabidopsis_lyrata\|09v1\|JGIAL015342_P1 | 8684 | 478 | 95.5 | globlastp |
| 1145 | LYD311 thellungiella_halophilum\|11v1\|BY806508_P1 | 8685 | 478 | 94.0 | globlastp |
| 1146 | LYD311 arabidopsis_lyrata\|09v1\|JGIAL018903_P1 | 8686 | 478 | 94.0 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1147 | LYD311 arabidopsis\|10v1\|AT3G56340_P1 | 8687 | 478 | 94.0 | globlastp |
| 1148 | LYD311 radish\|gb164\|EV536628 | 8688 | 478 | 94.0 | globlastp |
| 1149 | LYD311 radish\|gb164\|EW716557 | 8689 | 478 | 94.0 | globlastp |
| 1150 | LYD311 thellungiella\|gb167\|BY806508 | 8685 | 478 | 94.0 | globlastp |
| 1151 | LYD311 canola\|11v1\|SRR341920.129494_P1 | 8690 | 478 | 93.2 | globlastp |
| 1152 | LYD311 thellungiella_halophilum\|11v1\|BY802887_P1 | 8691 | 478 | 93.2 | globlastp |
| 1153 | LYD311 b_juncea\|10v2\|E6ANDIZ01A606W_P1 | 8692 | 478 | 93.2 | globlastp |
| 1154 | LYD311 b_juncea\|10v2\|E6ANDIZ01E3H51_P1 | 8690 | 478 | 93.2 | globlastp |
| 1155 | LYD311 b_oleracea\|gb161\|DY027147_P1 | 8690 | 478 | 93.2 | globlastp |
| 1156 | LYD311 b_oleracea\|gb161\|DY029981_P1 | 8690 | 478 | 93.2 | globlastp |
| 1157 | LYD311 b_rapa\|gb162\|CV433223_P1 | 8693 | 478 | 93.2 | globlastp |
| 1158 | LYD311 b_rapa\|gb162\|CX270079_P1 | 8690 | 478 | 93.2 | globlastp |
| 1159 | LYD311 canola\|10v1\|CN732251 | 8693 | 478 | 93.2 | globlastp |
| 1160 | LYD311 canola\|11v1\|CN732251_P1 | 8693 | 478 | 93.2 | globlastp |
| 1161 | LYD311 canola\|10v1\|CX188367 | 8690 | 478 | 93.2 | globlastp |
| 1162 | LYD311 canola\|11v1\|CN731810_P 1 | 8690 | 478 | 93.2 | globlastp |
| 1163 | LYD311 radish\|gb164\|EV539488 | 8694 | 478 | 93.2 | globlastp |
| 1164 | LYD311 thellungiella\|gb167\|BY802887 | 8691 | 478 | 93.2 | globlastp |
| 1165 | LYD311 canola\|11v1\|CN737290_P1 | 8690 | 478 | 93.2 | globlastp |
| 1166 | LYD311 canola\|11v1\|SRR023612.8557_P1 | 8695 | 478 | 92.5 | globlastp |
| 1167 | LYD311 b_juncea\|10v2\|E6ANDIZ01A5DG9_P1 | 8696 | 478 | 92.5 | globlastp |
| 1168 | LYD311 b_juncea\|10v2\|E6ANDIZ01AUBWP_P1 | 8696 | 478 | 92.5 | globlastp |
| 1169 | LYD311 b_juncea\|10v2\|E6ANDIZ01BIKHO_P1 | 8695 | 478 | 92.5 | globlastp |
| 1170 | LYD311 b_juncea\|10v2\|E6ANDIZ01BRZS9_P1 | 8696 | 478 | 92.5 | globlastp |
| 1171 | LYD311 b_juncea\|10v2\|E6ANDIZ01BX20L_P1 | 8697 | 478 | 92.5 | globlastp |
| 1172 | LYD311 b_oleracea\|gb161\|AM061215_P1 | 8698 | 478 | 92.5 | globlastp |
| 1173 | LYD311 b_rapa\|gb162\|CX271994_P1 | 8695 | 478 | 92.5 | globlastp |
| 1174 | LYD311 b_rapa\|gb162\|L33657_P1 | 8695 | 478 | 92.5 | globlastp |
| 1175 | LYD311 canola\|10v1\|CD812488 | 8698 | 478 | 92.5 | globlastp |
| 1176 | LYD311 canola\|11v1\|CN726208_P1 | 8698 | 478 | 92.5 | globlastp |
| 1177 | LYD311 canola\|11v1\|CN731199_P1 | 8695 | 478 | 92.5 | globlastp |
| 1178 | LYD311 canola\|10v1\|CD820909 | 8695 | 478 | 92.5 | globlastp |
| 1179 | LYD311 canola\|11v1\|CN732218_P1 | 8695 | 478 | 92.5 | globlastp |
| 1180 | LYD311 canola\|10v1\|CD830244 | 8699 | 478 | 92.5 | globlastp |
| 1181 | LYD311 canola\|11v1\|CN726370_P1 | 8699 | 478 | 92.5 | globlastp |
| 1182 | LYD311 radish\|gb164\|EV528350 | 8700 | 478 | 92.5 | globlastp |
| 1183 | LYD311 radish\|gb164\|EW734878 | 8701 | 478 | 92.5 | globlastp |
| 1184 | LYD311 radish\|gb164\|EX749032 | 8701 | 478 | 92.5 | globlastp |
| 1185 | LYD311 radish\|gb164\|EX898202 | 8701 | 478 | 92.5 | globlastp |
| 1186 | LYD311 canola\|11v1\|CN730564_P1 | 8702 | 478 | 91.7 | globlastp |
| 1187 | LYD311 canola\|11v1\|SRR019556.44515_P1 | 8702 | 478 | 91.7 | globlastp |
| 1188 | LYD311 b_juncea\|10v2\|E6ANDIZ01A3IFX_P1 | 8702 | 478 | 91.7 | globlastp |
| 1189 | LYD311 b_juncea\|10v2\|E6ANDIZ01A6ZUM_P1 | 8703 | 478 | 91.7 | globlastp |
| 1190 | LYD311 b_juncea\|10v2\|E6ANDIZ01AG1VJ_P1 | 8704 | 478 | 91.7 | globlastp |
| 1191 | LYD311 b_juncea\|10v2\|E6ANDIZ01AIISG_P1 | 8705 | 478 | 91.7 | globlastp |
| 1192 | LYD311 b_oleracea\|gb161\|DY025829_P1 | 8702 | 478 | 91.7 | globlastp |
| 1193 | LYD311 b_rapa\|gb162\|CV433354_P1 | 8704 | 478 | 91.7 | globlastp |
| 1194 | LYD311 b_rapa\|gb162\|CX265932_P1 | 8702 | 478 | 91.7 | globlastp |
| 1195 | LYD311 canola\|10v1\|CD811936 | 8702 | 478 | 91.7 | globlastp |
| 1196 | LYD311 canola\|11v1\|CN729043_P1 | 8702 | 478 | 91.7 | globlastp |
| 1197 | LYD311 canola\|10v1\|CD811948 | 8702 | 478 | 91.7 | globlastp |
| 1198 | LYD311 radish\|gb164\|EV525015 | 8706 | 478 | 91.7 | globlastp |
| 1199 | LYD311 radish\|gb164\|EW714728 | 8706 | 478 | 91.7 | globlastp |
| 1200 | LYD311 canola\|11v1\|EG019901_P1 | 8707 | 478 | 91.0 | globlastp |
| 1201 | LYD311 b_juncea\|10v2\|E6ANDIZ01BH2OA_P1 | 8708 | 478 | 91.0 | globlastp |
| 1202 | LYD311 b_rapa\|gb162\|CA991848_P1 | 8709 | 478 | 91.0 | globlastp |
| 1203 | LYD311 b_rapa\|gb162\|DY009030_P1 | 8709 | 478 | 91.0 | globlastp |
| 1204 | LYD311 canola\|10v1\|CX195195 | 8710 | 478 | 91.0 | globlastp |
| 1205 | LYD311 canola\|11v1\|EE425769_P1 | 8710 | 478 | 91.0 | globlastp |
| 1206 | LYD311 canola\|10v1\|CD818937 | 8711 | 478 | 91.0 | glotblastn |
| 1207 | LYD311 b_juncea\|10v2\|E6ANDIZ01A18QW_P1 | 8712 | 478 | 90.2 | globlastp |
| 1208 | LYD311 thellungiella_parvulum\|11v1\|BY802887_T1 | 8713 | 478 | 88.0 | glotblastn |
| 1209 | LYD311 cleome_spinosa\|10v1\|GR932062_P1 | 8714 | 478 | 86.5 | globlastp |
| 1210 | LYD311 cleome_spinosa\|10v1\|SRR015531S0248483_P1 | 8715 | 478 | 86.5 | globlastp |
| 1211 | LYD311 canola\|11v1\|EV108619_T1 | 8716 | 478 | 85.0 | glotblastn |
| 1212 | LYD311 peanut\|10v1\|CX018156_P1 | 8717 | 478 | 82.7 | globlastp |
| 1213 | LYD311 zostera\|10v1\|AM767183 | 8718 | 478 | 82.7 | globlastp |
| 1214 | LYD311 euonymus\|11v1\|SRR070038X107762_P1 | 8719 | 478 | 82.0 | globlastp |
| 1215 | LYD311 beech\|gb170\|AM062777_P1 | 8720 | 478 | 82.0 | globlastp |
| 1216 | LYD311 eschscholzia\|10v1\|CD480696 | 8721 | 478 | 82.0 | globlastp |
| 1217 | LYD311 peanut\|10v1\|CX018188_P1 | 8722 | 478 | 82.0 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1218 | LYD311 chelidonium\|11v1\|SRR084752X102478_P1 | 8723 | 478 | 81.6 | globlastp |
| 1219 | LYD311 cannabis\|12v1\|SOLX00031773_P1 | 8724 | 478 | 81.5 | globlastp |
| 1220 | LYD311 humulus\|11v1\|EX519376_P1 | 8724 | 478 | 81.5 | globlastp |
| 1221 | LYD311 eschscholzia\|10v1\|CD478920 | 8725 | 478 | 81.5 | globlastp |
| 1222 | LYD311 cucurbita\|11v1\|SRR091276X104400_P1 | 8726 | 478 | 81.3 | globlastp |
| 1223 | LYD311 peanut\|10v1\|EE126238_P1 | 8727 | 478 | 81.3 | globlastp |
| 1224 | LYD311 cucurbita\|11v1\|SRR091276X107646_P1 | 8728 | 478 | 81.2 | globlastp |
| 1225 | LYD311 trigonella\|11v1\|SRR066194X104836_P1 | 8729 | 478 | 81.2 | globlastp |
| 1226 | LYD311 watermelon\|11v1\|AM742925_T1 | 8730 | 478 | 81.2 | glotblastn |
| 1227 | LYD311 amborella\|gb166\|CK756581_P1 | 8731 | 478 | 81.2 | globlastp |
| 1228 | LYD311 apple\|11v1\|CN491811_P1 | 8732 | 478 | 81.2 | globlastp |
| 1229 | LYD311 apple\|gb171\|CN494732 | 8732 | 478 | 81.2 | globlastp |
| 1230 | LYD311 beet\|gb162\|BE590289_P1 | 8733 | 478 | 81.2 | globlastp |
| 1231 | LYD311 cucumber\|09v1\|DN910106_T1 | 8730 | 478 | 81.2 | glotblastn |
| 1232 | LYD311 medicago\|09v1\|LLAJ388694_P1 | 8729 | 478 | 81.2 | globlastp |
| 1233 | LYD311 melon\|10v1\|AM742925_T1 | 8730 | 478 | 81.2 | glotblastn |
| 1234 | LYD311 peanut\|10v1\|EE126532_P1 | 8734 | 478 | 81.2 | globlastp |
| 1235 | LYD311 peanut\|10v1\|ES713518_P1 | 8735 | 478 | 81.2 | globlastp |
| 1236 | LYD311 pigeonpea\|10v1\|SRR054580S0066602_T1 | 8736 | 478 | 81.2 | glotblastn |
| 1237 | LYD311 soybean\|11v1\|GLYMA04G39940 | 8737 | 478 | 81.2 | globlastp |
| 1238 | LYD311 silene\|11v1\|SRR096785X29266_P1 | 8738 | 478 | 81.0 | globlastp |
| 1239 | LYD311 humulus\|11v1\|SRR098683X100497_P1 | 8739 | 478 | 80.7 | globlastp |
| 1240 | LYD311 cacao\|10v1\|CU486111_T1 | 8740 | 478 | 80.6 | glotblastn |
| 1241 | LYD311 cucurbita\|11v1\|SRR091276X129541_P1 | 8741 | 478 | 80.5 | globlastp |
| 1242 | LYD311 apple\|gb171\|CN491811 | 8742 | 478 | 80.5 | globlastp |
| 1243 | LYD311 bean\|gb167\|CA897290_P1 | 8743 | 478 | 80.5 | globlastp |
| 1244 | LYD311 cyamopsis\|10v1\|EG981137_P1 | 8744 | 478 | 80.5 | globlastp |
| 1245 | LYD311 grape\|11v1\|GSVIVT01024576001_P1 | 8745 | 478 | 80.5 | globlastp |
| 1246 | LYD311 grape\|gb160\|BQ793461 | 8745 | 478 | 80.5 | globlastp |
| 1247 | LYD311 liriodendron\|gb166\|CK765898_P1 | 8746 | 478 | 80.5 | globlastp |
| 1248 | LYD311 momordica\|10v1\|SRR071315S0002878_P1 | 8747 | 478 | 80.5 | globlastp |
| 1249 | LYD311 pea\|09v1\|FG528852 | 8748 | 478 | 80.5 | globlastp |
| 1250 | LYD311 soybean\|11v1\|GLYMA06G14950 | 8749 | 478 | 80.5 | globlastp |
| 1251 | LYD311 bean\|gb167\|CA897292_T1 | 8750 | 478 | 80.5 | glotblastn |
| 1252 | LYD311 chickpea\|09v2\|DY475420_T1 | 8751 | 478 | 80.5 | glotblastn |
| 1253 | LYD311 chickpea\|09v2\|GR392264_T1 | 8752 | 478 | 80.5 | glotblastn |
| 1254 | LYD311 lotus\|09v1\|BU494262_T1 | 8753 | 478 | 80.5 | glotblastn |
| 1255 | LYD311 lotus\|09v1\|CN824997_T1 | 8753 | 478 | 80.5 | glotblastn |
| 1256 | LYD311 pigeonpea\|10v1\|GW359736_T1 | 8736 | 478 | 80.5 | glotblastn |
| 1257 | LYD311 prunus\|10v1\|BU044809 | 8754 | 478 | 80.5 | glotblastn |
| 1258 | LYD311 soybean\|11v1\|GLYMA14G38950 | 8755 | 478 | 80.5 | glotblastn |
| 1259 | LYD311 euonymus\|11v1\|SRR070038X101903_P1 | 8756 | 478 | 80.1 | globlastp |
| 1260 | LYD311 apple\|gb171\|CN493089 | 8757 | 478 | 80.1 | globlastp |
| 1261 | LYD311 prunus\|10v1\|CB819305 | 8758 | 478 | 80.1 | globlastp |
| 1262 | LYD311 humulus\|11v1\|ES654982_P1 | 8759 | 478 | 80.0 | globlastp |
| 1263 | LYD311 zostera\|10v1\|AM766161 | 8760 | 478 | 80.0 | globlastp |
| 1264 | LYD312 arabidopsis_lyrata\|09v1\|JGIAL015619_P1 | 8761 | 479 | 98.3 | globlastp |
| 1265 | LYD312 thellungiella_halophilum\|11v1\|BI698673_P1 | 8762 | 479 | 94.0 | globlastp |
| 1266 | LYD312 thellungiella\|gb167\|BI698673 | 8762 | 479 | 94.0 | globlastp |
| 1267 | LYD312 thellungiella_parvulum\|11v1\|BI698673_P1 | 8763 | 479 | 91.4 | globlastp |
| 1268 | LYD312 radish\|gb164\|EV545662 | 8764 | 479 | 89.1 | globlastp |
| 1269 | LYD312 thellungiella_halophilum\|11v1\|EHPRD129481_T1 | — | 479 | 87.9 | glotblastn |
| 1270 | LYD312 canola\|10v1\|EE558412 | 8765 | 479 | 86.0 | globlastp |
| 1271 | LYD312 canola\|11v1\|EE558412_P1 | 8766 | 479 | 85.6 | globlastp |
| 1272 | LYD312 b_oleracea\|gb161\|EH417202_P1 | 8767 | 479 | 83.8 | globlastp |
| 1273 | LYD312 b_rapa\|gb162\|DN192304_P1 | 8768 | 479 | 80.9 | globlastp |
| 1274 | LYD313 arabidopsis_lyrata\|09v1\|JGIAL008813_P1 | 8769 | 480 | 98.8 | globlastp |
| 1275 | LYD313 thellungiella_parvulum\|11v1\|EPPRD042582_P1 | 8770 | 480 | 92.7 | globlastp |
| 1276 | LYD313 thellungiella_halophilum\|11v1\|EHJGI11002654_P1 | 8771 | 480 | 92.1 | globlastp |
| 1277 | LYD313 canola\|10v1\|CX194066 | 8772 | 480 | 88.5 | globlastp |
| 1278 | LYD313 canola\|11v1\|EV143607_P1 | 8772 | 480 | 88.5 | globlastp |
| 1279 | LYD313 canola\|11v1\|GR450448_P1 | 8773 | 480 | 88.5 | globlastp |
| 1280 | LYD313 canola\|10v1\|CX191719 | 8774 | 480 | 87.9 | globlastp |
| 1281 | LYD313 canola\|11v1\|GR450809XX1_P1 | 8774 | 480 | 87.9 | globlastp |
| 1282 | LYD313 b_juncea\|10v2\|E6ANDIZ01A8H1F_P1 | 8775 | 480 | 86.7 | globlastp |
| 1283 | LYD313 canola\|10v1\|EL588716 | 8776 | 480 | 86.7 | globlastp |
| 1284 | LYD313 radish\|gb164\|EV526908 | 8777 | 480 | 86.7 | globlastp |
| 1285 | LYD313 canola\|10v1\|CX188803 | 8778 | 480 | 86.1 | globlastp |
| 1286 | LYD313 canola\|11v1\|GR452560_P1 | 8778 | 480 | 86.1 | globlastp |
| 1287 | LYD313 canola\|11v1\|GR450902_P1 | 8779 | 480 | 85.5 | globlastp |
| 1288 | LYD313 radish\|gb164\|EX895333 | 8780 | 480 | 84.2 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1289 | LYD315 arabidopsis_lyrata\|09v1\|JGIAL008912_P1 | 8781 | 481 | 96.5 | globlastp |
| 1290 | LYD315 thellungiella_halophilum\|11v1\|EHJGI11004453_P1 | 8782 | 481 | 94.0 | globlastp |
| 1291 | LYD315 thellungiella_halophilum\|11v1\|EHPRD121542_P1 | 8782 | 481 | 94.0 | globlastp |
| 1292 | LYD315 thellungiella_parvulum\|11v1\|EPCRP011584_P1 | 8783 | 481 | 92.9 | globlastp |
| 1293 | LYD315 thellungiella_parvulum\|11v1\|EPCRP009311_T1 | 8784 | 481 | 92.9 | glotblastn |
| 1294 | LYD316 arabidopsis_lyrata\|09v1\|JGIAL009299_T1 | 8785 | 482 | 96.3 | glotblastn |
| 1295 | LYD316 thellungiella_parvulum\|11v1\|EPCRP009492_P1 | 8786 | 482 | 88.8 | globlastp |
| 1296 | LYD316 thellungiella_halophilum\|11v1\|EHJGI11003515_P1 | 8787 | 482 | 88.3 | globlastp |
| 1297 | LYD316 canola\|11v1\|CD818422_T1 | 8788 | 482 | 86.2 | glotblastn |
| 1298 | LYD318 arabidopsis_lyrata\|09v1\|JGIAL009619_P1 | 8789 | 483 | 97.0 | globlastp |
| 1299 | LYD318 thellungiella_parvulum\|11v1\|DN776389_P1 | 8790 | 483 | 92.4 | globlastp |
| 1300 | LYD318 thellungiella_halophilum\|11v1\|DN776389_P1 | 8791 | 483 | 92.0 | globlastp |
| 1301 | LYD318 radish\|gb164\|EX754223 | 8792 | 483 | 92.0 | globlastp |
| 1302 | LYD318 canola\|11v1\|EE445253_P1 | 8793 | 483 | 90.5 | globlastp |
| 1303 | LYD318 canola\|10v1\|CD836668 | 8794 | 483 | 90.3 | globlastp |
| 1304 | LYD318 canola\|11v1\|EE400369_P1 | 8795 | 483 | 89.8 | globlastp |
| 1305 | LYD319 arabidopsis_lyrata\|09v1\|JGIAL009870_P1 | 8796 | 484 | 93.6 | globlastp |
| 1306 | LYD319 thellungiella_halophilum\|11v1\|EHCRP026123_P1 | 8797 | 484 | 88.0 | globlastp |
| 1307 | LYD319 thellungiella_parvulum\|11v1\|EPPRD057899_T1 | 8798 | 484 | 86.5 | glotblastn |
| 1308 | LYD319 thellungiella_parvulum\|11v1\|EPCRP012042_P1 | 8799 | 484 | 85.8 | globlastp |
| 1309 | LYD319 canola\|11v1\|EV018380_T1 | 8800 | 484 | 85.6 | glotblastn |
| 1310 | LYD319 arabidopsis_lyrata\|09v1\|JGIAL004932_P1 | 8801 | 484 | 80.6 | globlastp |
| 1311 | LYD319 arabidopsis\|10v1\|AT1G54115_P1 | 8802 | 484 | 80.0 | globlastp |
| 1312 | LYD320 thellungiella_parvulum\|11v1\|EPPRD057993_T1 | — | 485 | 92.8 | glotblastn |
| 1313 | LYD320 arabidopsis_lyrata\|09v1\|BQ834507_P1 | 8803 | 485 | 92.3 | globlastp |
| 1314 | LYD320 thellungiella_halophilum\|11v1\|EHPRD122621_T1 | 8804 | 485 | 91.0 | glotblastn |
| 1315 | LYD320 radish\|gb164\|EW722876 | 8805 | 485 | 88.7 | globlastp |
| 1316 | LYD320 thellungiella_parvulum\|11v1\|DN775388_P1 | 8806 | 485 | 88.6 | globlastp |
| 1317 | LYD320 thellungiella_halophilum\|11v1\|DN775388_P1 | 8807 | 485 | 88.2 | globlastp |
| 1318 | LYD320 thellungiella\|gb167\|DN775388 | 8807 | 485 | 88.2 | globlastp |
| 1319 | LYD320 b_rapa\|gb162\|DN962192_P1 | 8808 | 485 | 87.3 | globlastp |
| 1320 | LYD320 canola\|10v1\|EG021058 | 8809 | 485 | 87.3 | globlastp |
| 1321 | LYD320 canola\|11v1\|EG021058_P1 | 8809 | 485 | 87.3 | globlastp |
| 1322 | LYD320 radish\|gb164\|EX756845 | 8810 | 485 | 86.0 | globlastp |
| 1323 | LYD320 b_oleracea\|gb161\|EH414797_P1 | 8811 | 485 | 85.5 | globlastp |
| 1324 | LYD320 canola\|11v1\|EG020125_P1 | 8812 | 485 | 85.1 | globlastp |
| 1325 | LYD320 b_rapa\|gb162\|DN962315_P1 | 8813 | 485 | 84.2 | globlastp |
| 1326 | LYD320 canola\|10v1\|CD818499 | 8813 | 485 | 84.2 | globlastp |
| 1327 | LYD320 canola\|11v1\|SRR341920.175161_P1 | 8814 | 485 | 83.2 | globlastp |
| 1328 | LYD321 arabidopsis_lyrata\|09v1\|JGIAL010419_P1 | 8815 | 486 | 97.9 | globlastp |
| 1329 | LYD321 thellungiella_halophilum\|11v1\|BY810059_P1 | 8816 | 486 | 92.1 | globlastp |
| 1330 | LYD321 canola\|11v1\|EE471093_P1 | 8817 | 486 | 90.5 | globlastp |
| 1331 | LYD321 canola\|10v1\|CD836798 | 8818 | 486 | 90.4 | globlastp |
| 1332 | LYD321 canola\|11v1\|EV061853_P1 | 8819 | 486 | 90.2 | globlastp |
| 1333 | LYD321 canola\|11v1\|GR458826_P1 | 8820 | 486 | 87.7 | globlastp |
| 1334 | LYD321 thellungiella_parvulum\|11v1\|BY810059_P1 | 8821 | 486 | 85.7 | globlastp |
| 1335 | LYD322 arabidopsis_lyrata\|09v1\|JGIAL010711_P1 | 8822 | 487 | 98.6 | globlastp |
| 1336 | LYD322 thellungiella_halophilum\|11v1\|BY805839_P1 | 8823 | 487 | 93.6 | globlastp |
| 1337 | LYD322 b_rapa\|gb162\|EX022374_P1 | 8824 | 487 | 93.1 | globlastp |
| 1338 | LYD322 canola\|10v1\|CX192130 | 8825 | 487 | 93.1 | globlastp |
| 1339 | LYD322 thellungiella_parvulum\|11v1\|BY805839_P1 | 8826 | 487 | 92.7 | globlastp |
| 1340 | LYD322 canola\|11v1\|EV020616_P1 | 8827 | 487 | 92.2 | globlastp |
| 1341 | LYD322 canola\|11v1\|EG020093_P1 | 8828 | 487 | 91.9 | globlastp |
| 1342 | LYD322 b_rapa\|gb162\|EX026297_P1 | 8829 | 487 | 91.7 | globlastp |
| 1343 | LYD322 radish\|gb164\|EW731194 | 8830 | 487 | 91.7 | globlastp |
| 1344 | LYD322 radish\|gb164\|EV528233 | 8831 | 487 | 91.5 | globlastp |
| 1345 | LYD322 thellungiella_parvulum\|11v1\|BY834583_P1 | 8832 | 487 | 84.8 | globlastp |
| 1346 | LYD322 thellungiella_halophilum\|11v1\|BY834583_P1 | 8833 | 487 | 84.4 | globlastp |
| 1347 | LYD322 radish\|gb164\|EV537648 | 8834 | 487 | 84.1 | globlastp |
| 1348 | LYD322 arabidopsis\|10v1\|AT1G51630_P1 | 8835 | 487 | 83.9 | globlastp |
| 1349 | LYD322 arabidopsis_lyrata\|09v1\|JGIAL004638_P1 | 8836 | 487 | 83.7 | globlastp |
| 1350 | LYD322 canola\|11v1\|EE464409_P1 | 8837 | 487 | 82.7 | globlastp |
| 1351 | LYD322 canola\|11v1\|EE483839_P1 | 8838 | 487 | 82.7 | globlastp |
| 1352 | LYD322 b_rapa\|gb162\|EE518248_P1 | 8838 | 487 | 82.7 | globlastp |
| 1353 | LYD322 canola\|11v1\|EE443966_P1 | 8839 | 487 | 81.6 | globlastp |
| 1354 | LYD322 canola\|11v1\|EV047576_P1 | 8840 | 487 | 80.6 | globlastp |
| 1355 | LYD323 arabidopsis_lyrata\|09v1\|JGIAL017444_P1 | 8841 | 488 | 97.2 | globlastp |
| 1356 | LYD323 thellungiella_halophilum\|11v1\|EHJGI11027388_P1 | 8842 | 488 | 89.9 | globlastp |
| 1357 | LYD323 thellungiella_halophilum\|11v1\|EHPRD121474_T1 | 8843 | 488 | 87.4 | glotblastn |
| 1358 | LYD323 canola\|10v1\|EE456524 | 8844 | 488 | 84.3 | globlastp |
| 1359 | LYD323 canola\|11v1\|EE456524_P1 | 8845 | 488 | 83.3 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1360 | LYD323 radish\|gb164\|EV566583 | 8846 | 488 | 83.3 | globlastp |
| 1361 | LYD323 thellungiella_parvulum\|11v1\|EPCRP018363_P1 | 8847 | 488 | 82.7 | globlastp |
| 1362 | LYD324 arabidopsis_lyrata\|09v1\|JGIAL017910_P1 | 8848 | 489 | 88.3 | globlastp |
| 1363 | LYD324 thellungiella_halophilum\|11v1\|BY823220_P1 | 8849 | 489 | 82.3 | globlastp |
| 1364 | LYD324 thellungiella_parvulum\|11v1\|BY823220_P1 | 8850 | 489 | 81.3 | globlastp |
| 1365 | LYD324 canola\|10v1\|CB686132 | 8851 | 489 | 80.2 | globlastp |
| 1366 | LYD324 radish\|gb164\|EV543990 | 8852 | 489 | 80.1 | globlastp |
| 1367 | LYD325 arabidopsis_lyrata\|09v1\|JGIAL018094_P1 | 8853 | 490 | 94.2 | globlastp |
| 1368 | LYD325 thellungiella_parvulum\|11v1\|EPCRP019885_P1 | 8854 | 490 | 85.1 | globlastp |
| 1369 | LYD325 thellungiella_halophilum\|11v1\|EHJGI11027168_P1 | 8855 | 490 | 84.4 | globlastp |
| 1370 | LYD325 canola\|10v1\|EG019603 | 8856 | 490 | 81.3 | globlastp |
| 1371 | LYD325 canola\|11v1\|EG019603_P1 | 8856 | 490 | 81.3 | globlastp |
| 1372 | LYD325 canola\|11v1\|EE471941_P1 | 8857 | 490 | 80.8 | globlastp |
| 1373 | LYD326 arabidopsis_lyrata\|09v1\|JGIAL018109_T1 | 8858 | 491 | 83.0 | glotblastn |
| 1374 | LYD327 arabidopsis_lyrata\|09v1\|JGIAL018400_P1 | 8859 | 492 | 97.3 | globlastp |
| 1375 | LYD327 thellungiella halophilum\|11v1\|DN773826_P1 | 8860 | 492 | 92.2 | globlastp |
| 1376 | LYD327 canola\|11v1\|AJ581745_P1 | 8861 | 492 | 91.9 | globlastp |
| 1377 | LYD327 thellungiella_parvulum\|11v1\|DN773826_P1 | 8862 | 492 | 91.3 | globlastp |
| 1378 | LYD327 canola\|10v1\|AJ581745 | 8863 | 492 | 90.9 | globlastp |
| 1379 | LYD327 canola\|11v1\|SRR019558.10076_P1 | 8864 | 492 | 82.8 | globlastp |
| 1380 | LYD327 canola\|11v1\|DW998382_P1 | 8865 | 492 | 81.0 | globlastp |
| 1381 | LYD328 arabidopsis_lyrata\|09v1\|TMPLAT3G59210T1_P1 | 8866 | 493 | 90.1 | globlastp |
| 1382 | LYD329 arabidopsis_lyrata\|09v1\|JGIAL019576_P1 | 8867 | 494 | 98.4 | globlastp |
| 1383 | LYD329 thellungiella_halophilum\|11v1\|BY818407_P1 | 8868 | 494 | 95.6 | globlastp |
| 1384 | LYD329 thellungiella_parvulum\|11v1\|BY818407_P1 | 8869 | 494 | 93.8 | globlastp |
| 1385 | LYD329 canola\|11v1\|ES904608_P1 | 8870 | 494 | 90.0 | globlastp |
| 1386 | LYD329 arabidopsis_lyrata\|09v1\|JGIAL016139_P1 | 8871 | 494 | 90.0 | globlastp |
| 1387 | LYD329 arabidopsis\|10v1\|AT2G47160_P1 | 8872 | 494 | 90.0 | globlastp |
| 1388 | LYD329 thellungiella halophilum\|11v1\|BY801672_P1 | 8873 | 494 | 89.8 | globlastp |
| 1389 | LYD329 canola\|11v1\|GFXGU827656X1_P1 | 8874 | 494 | 89.7 | globlastp |
| 1390 | LYD329 thellungiella_parvulum\|11v1\|BY801672_P1 | 8875 | 494 | 89.6 | globlastp |
| 1391 | LYD329 canola\|11v1\|ES902758_P1 | 8876 | 494 | 89.4 | globlastp |
| 1392 | LYD329 canola\|10v1\|ES902758 | 8877 | 494 | 89.0 | glotblastn |
| 1393 | LYD329 canola\|11v1\|EV072122_P1 | 8878 | 494 | 88.6 | globlastp |
| 1394 | LYD329 canola\|11v1\|GFXGU827652X1_P1 | 8879 | 494 | 88.3 | globlastp |
| 1395 | LYD329 clementine\|11v1\|DR911319_P1 | 8880 | 494 | 82.9 | globlastp |
| 1396 | LYD329 orange\|11v1\|DR911319_P1 | 8880 | 494 | 82.9 | globlastp |
| 1397 | LYD329 poplar\|10v1\|BU817339_P1 | 8881 | 494 | 82.9 | globlastp |
| 1398 | LYD329 poplar\|10v1\|DB884373_P1 | 8882 | 494 | 82.9 | globlastp |
| 1399 | LYD329 cacao\|10v1\|CU571714_P1 | 8883 | 494 | 82.8 | globlastp |
| 1400 | LYD329 cassava\|09v1\|JGICASSAVA36078VALIDM1_P1 | 8884 | 494 | 81.8 | globlastp |
| 1401 | LYD329 euphorbia\|11v1\|DV137045_P1 | 8885 | 494 | 81.5 | globlastp |
| 1402 | LYD329 canola\|11v1\|EV156689_P1 | 8886 | 494 | 81.0 | globlastp |
| 1403 | LYD329 apple\|11v1\|CN860745_P1 | 8887 | 494 | 80.9 | globlastp |
| 1404 | LYD329 castorbean\|11v1\|XM_002515178_P1 | 8888 | 494 | 80.8 | globlastp |
| 1405 | LYD329 prunus\|10v1\|CN860745 | 8889 | 494 | 80.6 | globlastp |
| 1406 | LYD329 watermelon\|11v1\|CK700793_P1 | 8890 | 494 | 80.5 | globlastp |
| 1407 | LYD329 castorbean\|09v1\|XM002515178 | 8891 | 494 | 80.5 | globlastp |
| 1408 | LYD329 monkeyflower\|10v1\|GO952257_T1 | 8892 | 494 | 80.5 | glotblastn |
| 1409 | LYD329 strawberry\|11v1\|SRR034857S0001709 | 8893 | 494 | 80.4 | glotblastn |
| 1410 | LYD329 cucumber\|09v1\|CK700793_P1 | 8894 | 494 | 80.4 | globlastp |
| 1411 | LYD329 medicago\|09v1\|AW684781_P1 | 8895 | 494 | 80.3 | globlastp |
| 1412 | LYD329 grape\|11v1\|GSVIVT01028186001_P1 | 8896 | 494 | 80.2 | globlastp |
| 1413 | LYD329 eucalyptus\|11v2\|SRR001658X9834_T1 | 8897 | 494 | 80.1 | glotblastn |
| 1414 | LYD329 lotus\|09v1\|AI967861_P1 | 8898 | 494 | 80.1 | globlastp |
| 1415 | LYD329 soybean\|11v1\|GLYMA19G40720 | 8899 | 494 | 80.0 | globlastp |
| 1416 | LYD330 arabidopsis_lyrata\|09v1\|JGIAL032548_P1 | 8900 | 495 | 93.9 | globlastp |
| 1417 | LYD330 thellungiella_parvulum\|11v1\|DN778413_P1 | 8901 | 495 | 83.4 | globlastp |
| 1418 | LYD330 thellungiella_halophilum\|11v1\|DN778413_T1 | 8902 | 495 | 82.8 | glotblastn |
| 1419 | LYD331 arabidopsis_lyrata\|09v1\|JGIAL026449_P1 | 8903 | 496 | 92.1 | globlastp |
| 1420 | LYD332 arabidopsis_lyrata\|09v1\|JGIAL024476_P1 | 8904 | 497 | 92.2 | globlastp |
| 1421 | LYD332 thellungiella_parvulum\|11v1\|BY816573_P1 | 8905 | 497 | 83.7 | globlastp |
| 1422 | LYD332 thellungiella_halophilum\|11v1\|BY816573_P1 | 8906 | 497 | 82.7 | globlastp |
| 1423 | LYD334 arabidopsis_lyrata\|09v1\|GFXEU352111X1_P1 | 8907 | 498 | 94.4 | globlastp |
| 1424 | LYD334 thellungiella_halophilum\|11v1\|EHJGI11023772_P1 | 8908 | 498 | 86.5 | globlastp |
| 1425 | LYD334 thellungiella_parvulum\|11v1\|EPCRP024261_P1 | 8909 | 498 | 81.5 | globlastp |
| 1426 | LYD334 thellungiella_parvulum\|11v1\|EPPRD116222_T1 | 8910 | 498 | 80.4 | glotblastn |
| 1427 | LYD335 canola\|11v1\|EE503131_P1 | 8911 | 499 | 96.1 | globlastp |
| 1428 | LYD335 thellungiella_parvulum\|11v1\|DN774603_P1 | 8912 | 499 | 95.9 | globlastp |
| 1429 | LYD335 thellungiella_halophilum\|11v1\|DN774603_P1 | 8913 | 499 | 95.4 | globlastp |
| 1430 | LYD335 arabidopsis_lyrata\|09v1\|JGIAL020061_P1 | 8914 | 499 | 88.7 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1431 | LYD335 orange\|11v1\|CF417945_T1 | 8915 | 499 | 83.8 | glotblastn |
| 1432 | LYD335 oak\|10v1\|CU640782_P1 | 8916 | 499 | 83.8 | globlastp |
| 1433 | LYD335 clementine\|11v1\|CF417945_P1 | 8917 | 499 | 83.7 | globlastp |
| 1434 | LYD335 tabernaemontana\|11v1\|SRR098689X100225_P1 | 8918 | 499 | 83.4 | globlastp |
| 1435 | LYD335 poplar\|10v1\|BI070640_T1 | 8919 | 499 | 83.2 | glotblastn |
| 1436 | LYD335 amsonia\|11v1\|SRR098688X102258_P1 | 8920 | 499 | 83.2 | globlastp |
| 1437 | LYD335 poplar\|10v1\|BU820176_T1 | 8921 | 499 | 83.1 | glotblastn |
| 1438 | LYD335 grape\|11v1\|GSVIVT01033621001_P1 | 8922 | 499 | 83.0 | globlastp |
| 1439 | LYD335 prunus\|10v1\|BU040034 | 8923 | 499 | 83.0 | globlastp |
| 1440 | LYD335 vinca\|11v1\|SRR098690X100714_P1 | 8924 | 499 | 82.5 | globlastp |
| 1441 | LYD335 castorbean\|09v1\|EG658117 | 8925 | 499 | 82.5 | glotblastn |
| 1442 | LYD335 castorbean\|11v1\|EG658117_T1 | 8925 | 499 | 82.5 | glotblastn |
| 1443 | LYD335 strawberry\|11v1\|DY666929 | 8926 | 499 | 82.4 | glotblastn |
| 1444 | LYD335 soybean\|11v1\|GLYMA03G28410 | 8927 | 499 | 82.3 | globlastp |
| 1445 | LYD335 medicago\|09v1\|AW688937_T1 | 8928 | 499 | 82.3 | glotblastn |
| 1446 | LYD335 watermelon\|11v1\|DQ641082_P1 | 8929 | 499 | 82.2 | globlastp |
| 1447 | LYD335 silene\|11v1\|SRR096785X10217_T1 | 8930 | 499 | 82.1 | glotblastn |
| 1448 | LYD335 soybean\|11v1\|GLYMA19G31120 | 8931 | 499 | 81.9 | globlastp |
| 1449 | LYD335 pepper\|gb171\|CA517915_T1 | 8932 | 499 | 81.6 | glotblastn |
| 1450 | LYD335 plantago\|11v1\|SRR066374X103519_T1 | 8933 | 499 | 81.5 | glotblastn |
| 1451 | LYD335 tomato\|11v1\|AI484128_P1 | 8934 | 499 | 81.3 | globlastp |
| 1452 | LYD335 tomato\|09v1\|AI484128 | 8934 | 499 | 81.3 | globlastp |
| 1453 | LYD335 arnica\|11v1\|SRR099034X102086_T1 | 8935 | 499 | 81.2 | glotblastn |
| 1454 | LYD335 monkeyflower\|10v1\|DV210601_T1 | 8936 | 499 | 80.5 | globlastp |
| 1455 | LYD335 triphysaria\|10v1\|EY005578 | 8937 | 499 | 80.5 | globlastp |
| 1456 | LYD335 thellungiella_parvulum\|11v1\|EPCRP016605_P1 | 8938 | 499 | 80.4 | globlastp |
| 1457 | LYD335 eucalyptus\|11v2\|CD669629_T1 | 8939 | 499 | 80.4 | glotblastn |
| 1458 | LYD335 cotton\|10v2\|CO080269_T1 | 8940 | 499 | 80.3 | glotblastn |
| 1459 | LYD335 arabidopsis_lyrata\|09v1\|JGIAL015419_P1 | 8941 | 499 | 80.1 | globlastp |
| 1460 | LYD335 arabidopsis\|10v1\|AT2G41220_P1 | 8942 | 499 | 80.1 | globlastp |
| 1461 | LYD337 arabidopsis_lyrata\|09v1\|JGIAL020872_T1 | 8943 | 500 | 100.0 | glotblastn |
| 1462 | LYD337 canola\|10v1\|CD812320 | 8944 | 500 | 81.3 | glotblastn |
| 1463 | LYD337 canola\|10v1\|EE456730 | 8945 | 500 | 81.3 | glotblastn |
| 1464 | LYD337 canola\|11v1\|GR444708_P1 | 8946 | 500 | 81.2 | globlastp |
| 1465 | LYD337 canola\|11v1\|EE456730_P1 | 8947 | 500 | 81.2 | globlastp |
| 1466 | LYD338 arabidopsis_lyrata\|09v1\|JGIAL020944_P1 | 8948 | 501 | 92.8 | globlastp |
| 1467 | LYD338 thellungiella_halophilum\|11v1\|EHJGI11025024_T1 | 8949 | 501 | 83.1 | glotblastn |
| 1468 | LYD338 thellungiella_parvulum\|11v1\|EPCRP023864_T1 | 8950 | 501 | 81.6 | glotblastn |
| 1469 | LYD339 arabidopsis_lyrata\|09v1\|JGIAL021040_P1 | 8951 | 502 | 96.3 | globlastp |
| 1470 | LYD339 thellungiella_halophilum\|11v1\|EHJGI11024390_P1 | 8952 | 502 | 90.1 | globlastp |
| 1471 | LYD339 thellungiella_parvulum\|11v1\|EPCRP023818_P1 | 8953 | 502 | 88.8 | globlastp |
| 1472 | LYD339 canola\|11v1\|EG021151_P1 | 8954 | 502 | 86.8 | globlastp |
| 1473 | LYD339 canola\|11v1\|ES955868_P1 | 8955 | 502 | 80.4 | globlastp |
| 1474 | LYD340 thellungiella_parvulum\|11v1\|BY800922_T1 | 8956 | 503 | 91.6 | glotblastn |
| 1475 | LYD340 thellungiella_halophilum\|11v1\|BY800922_T1 | 8957 | 503 | 90.7 | glotblastn |
| 1476 | LYD341 arabidopsis_lyrata\|09v1\|JGIAL027246_P1 | 8958 | 504 | 98.6 | globlastp |
| 1477 | LYD341 thellungiella_halophilum\|11v1\|BM986054_P1 | 8959 | 504 | 92.1 | globlastp |
| 1478 | LYD341 thellungiella\|gb167\|BM986054 | 8959 | 504 | 92.1 | globlastp |
| 1479 | LYD341 thellungiella_parvulum\|11v1\|BM986054_P1 | 8960 | 504 | 91.2 | globlastp |
| 1480 | LYD341 canola\|10v1\|CN827835 | 8961 | 504 | 90.6 | globlastp |
| 1481 | LYD341 b_juncea\|10v2\|E6ANDIZ01AILV9_P1 | 8962 | 504 | 90.4 | globlastp |
| 1482 | LYD341 canola\|10v1\|CN735913 | 8963 | 504 | 90.3 | globlastp |
| 1483 | LYD341 canola\|11v1\|CN735913_P1 | 8963 | 504 | 90.3 | globlastp |
| 1484 | LYD341 canola\|11v1\|EE453491_P1 | 8964 | 504 | 90.1 | globlastp |
| 1485 | LYD341 canola\|11v1\|CN827835_T1 | 8965 | 504 | 88.4 | glotblastn |
| 1486 | LYD341 radish\|gb164\|EV525495 | 8966 | 504 | 86.9 | globlastp |
| 1487 | LYD341 b_oleracea\|gb161\|DY014967_P1 | 8967 | 504 | 86.8 | globlastp |
| 1488 | LYD341 b_rapa\|gb162\|DN960891_P1 | 8968 | 504 | 86.8 | globlastp |
| 1489 | LYD341 canola\|11v1\|GR441130_T1 | 8969 | 504 | 86.5 | glotblastn |
| 1490 | LYD341 cleome_spinosa\|10v1\|GR934200_P1 | 8970 | 504 | 83.5 | globlastp |
| 1491 | LYD341 aristolochia\|10v1\|SRR039082S0119986_P1 | 8971 | 504 | 80.9 | globlastp |
| 1492 | LYD341 cleome_gynandra\|10v1\|SRR015532S0003861_P1 | 8972 | 504 | 80.7 | globlastp |
| 1493 | LYD342 arabidopsis_lyrata\|09v1\|JGIAL028474_P1 | 8973 | 505 | 95.8 | globlastp |
| 1494 | LYD342 thellungiella_parvulum\|11v1\|DN778963_P1 | 8974 | 505 | 87.9 | globlastp |
| 1495 | LYD342 thellungiella_halophilum\|11v1\|DN778963_P1 | 8975 | 505 | 86.8 | globlastp |
| 1496 | LYD342 canola\|11v1\|CN734443_P1 | 8976 | 505 | 86.4 | globlastp |
| 1497 | LYD342 radish\|gb164\|EV538664 | 8977 | 505 | 85.0 | globlastp |
| 1498 | LYD342 canola\|11v1\|EE557045_P1 | 8978 | 505 | 82.4 | globlastp |
| 1499 | LYD343 arabidopsis_lyrata\|09v1\|JGIAL028218_P1 | 8979 | 506 | 98.3 | globlastp |
| 1500 | LYD343 thellungiella_parvulum\|11v1\|EPCRP007025_P1 | 8980 | 506 | 92.5 | globlastp |
| 1501 | LYD343 thellungiella_halophilum\|11v1\|EHJGI11022965_P1 | 8981 | 506 | 91.6 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1502 | LYD343 canola|11v1|CN736114_P1 | 8982 | 506 | 90.5 | globlastp |
| 1503 | LYD343 b_rapa|gb162|EE520737_P1 | 8983 | 506 | 89.9 | globlastp |
| 1504 | LYD343 radish|gb164|EV568634 | 8984 | 506 | 88.3 | globlastp |
| 1505 | LYD344 arabidopsis_lyrata|09v1|JGIAL031165_P1 | 8985 | 507 | 97.4 | globlastp |
| 1506 | LYD344 thellungiella_halophilum|11v1|DN776083_P1 | 8986 | 507 | 95.1 | globlastp |
| 1507 | LYD344 thellungiella_parvulum|11v1|DN776083_P1 | 8987 | 507 | 94.7 | globlastp |
| 1508 | LYD344 canola|10v1|CD835164 | 8988 | 507 | 89.6 | glotblastn |
| 1509 | LYD344 b_rapa|gb162|CO749294_P1 | 8989 | 507 | 89.6 | globlastp |
| 1510 | LYD344 cleome_gynandra|10v1|SRR015532S0001256_P1 | 8990 | 507 | 88.2 | globlastp |
| 1511 | LYD344 cleome_spinosa|10v1|SRR015531S0002622_P1 | 8991 | 507 | 88.0 | globlastp |
| 1512 | LYD344 radish|gb164|EV528944 | 8992 | 507 | 84.7 | globlastp |
| 1513 | LYD344 thellungiella_parvulum|11v1|EPCRP023987_P1 | 8993 | 507 | 82.3 | globlastp |
| 1514 | LYD344 cacao|10v1|CF973757_P1 | 8994 | 507 | 82.1 | globlastp |
| 1515 | LYD344 canola|11v1|EE558093_P1 | 8995 | 507 | 81.8 | globlastp |
| 1516 | LYD344 cotton|10v2|ES821556_P1 | 8996 | 507 | 81.7 | globlastp |
| 1517 | LYD344 thellungiella_halophilum|11v1|EHJGI11024175_P1 | 8997 | 507 | 81.6 | globlastp |
| 1518 | LYD344 arabidopsis|10v1|AT5G09930_P1 | 8998 | 507 | 81.5 | globlastp |
| 1519 | LYD344 arabidopsis_lyrata|09v1|JGIAL020673_P1 | 8999 | 507 | 81.4 | globlastp |
| 1520 | LYD344 poplar|10v1|BI072525_P1 | 9000 | 507 | 81.2 | globlastp |
| 1521 | LYD344 cotton|10v2|AI731817_P1 | 9001 | 507 | 81.0 | globlastp |
| 1522 | LYD344 cassava|09v1|CK647751_P1 | 9002 | 507 | 80.9 | globlastp |
| 1523 | LYD344 euphorbia|11v1|DV151536_P1 | 9003 | 507 | 80.3 | globlastp |
| 1524 | LYD346 b_rapa|gb162|CV545144_P1 | 508 | 508 | 100.0 | globlastp |
| 1525 | LYD346 canola|11v1|AI352722_P1 | 9004 | 508 | 82.7 | globlastp |
| 1526 | LYD346 b_oleracea|gb161|EH416019_P1 | 9005 | 508 | 82.2 | globlastp |
| 1527 | LYD347 b_oleracea|gb161|DY030010_P1 | 9006 | 509 | 96.9 | globlastp |
| 1527 | LYD382 b_oleracea|gb161|DY030010_P1 | 9006 | 730 | 82.5 | globlastp |
| 1528 | LYD347 arabidopsis|10v1|AT5G14780_P1 | 9007 | 509 | 91.7 | globlastp |
| 1528 | LYD382 arabidopsis|10v1|AT5G14780_P1 | 9007 | 730 | 83.9 | globlastp |
| 1529 | LYD347 cleome_gynandra|10v1|SRR015532S0000104_P1 | 9008 | 509 | 87.6 | globlastp |
| 1529 | LYD382 cleome_gynandra|10v1|SRR015532S0000104_P1 | 9008 | 730 | 80.2 | globlastp |
| 1530 | LYD347 nasturtium|10v1|SRR032558S0026092 | 9009 | 509 | 86.2 | globlastp |
| 1530 | LYD382 nasturtium|10v1|SRR032558S0026092 | 9009 | 730 | 84.8 | globlastp |
| 1531 | LYD347 papaya|gb165|AM903607_P1 | 9010 | 509 | 84.0 | globlastp |
| 1531 | LYD382 papaya|gb165|AM903607_P1 | 9010 | 730 | 85.3 | globlastp |
| 1532 | LYD347 olea|11v1|SRR014463.14440_P1 | 9011 | 509 | 83.9 | globlastp |
| 1532 | LYD382 olea|11v1|SRR014463.14440_P1 | 9011 | 730 | 88.8 | globlastp |
| 1533 | LYD347 momordica|10v1|SRR071315S0001060_P1 | 9012 | 509 | 83.9 | globlastp |
| 1533 | LYD382 momordica|10v1|SRR071315S0001060_P1 | 9012 | 730 | 87.5 | globlastp |
| 1534 | LYD347 tobacco|gb162|EB426275 | 9013 | 509 | 83.9 | globlastp |
| 1534 | LYD382 tobacco|gb162|EB426275 | 9013 | 730 | 86.8 | globlastp |
| 1535 | LYD347 fraxinus|11v1|SRR058827.101326_T1 | 9014 | 509 | 83.4 | glotblastn |
| 1535 | LYD382 fraxinus|11v1|SRR058827.101326_P1 | 9014 | 730 | 80.6 | globlastp |
| 1536 | LYD347 platanus|11v1|SRR096786X11198_P1 | 9015 | 509 | 83.4 | globlastp |
| 1536 | LYD382 platanus|11v1|SRR096786X11198_P1 | 9015 | 730 | 87.8 | globlastp |
| 1537 | LYD347 vinca|11v1|SRR098690X108264_P1 | 9016 | 509 | 83.4 | globlastp |
| 1537 | LYD382 vinca|11v1|SRR098690X108264_P1 | 9016 | 730 | 85.9 | globlastp |
| 1538 | LYD347 watermelon|11v1|AA660126_P1 | 9017 | 509 | 83.4 | globlastp |
| 1538 | LYD382 watermelon|11v1|AA660126_P1 | 9017 | 730 | 86.7 | globlastp |
| 1539 | LYD347 melon|10v1|DV634169_P1 | 9018 | 509 | 83.4 | globlastp |
| 1539 | LYD382 melon|10v1|DV634169_P1 | 9018 | 730 | 86.2 | globlastp |
| 1540 | LYD347 eucalyptus|11v2|CD669597_P1 | 9019 | 509 | 83.3 | globlastp |
| 1540 | LYD382 eucalyptus|11v2|CD669597_P1 | 9019 | 730 | 86.1 | globlastp |
| 1541 | LYD347 tomato|11v1|BG129067_P1 | 9020 | 509 | 83.3 | globlastp |
| 1541 | LYD382 tomato|11v1|BG129067_P1 | 9020 | 730 | 86.4 | globlastp |
| 1542 | LYD347 vinca|11v1|SRR098690X100564_P1 | 9021 | 509 | 83.3 | globlastp |
| 1542 | LYD382 vinca|11v1|SRR098690X100564_P1 | 9021 | 730 | 85.6 | globlastp |
| 1543 | LYD347 citrus|gb166|BQ624436_P1 | 9022 | 509 | 83.2 | globlastp |
| 1543 | LYD382 citrus|gb166|BQ624436_P1 | 9022 | 730 | 88.1 | globlastp |
| 1544 | LYD347 orange|11v1|BQ624436_T1 | 9023 | 509 | 83.2 | glotblastn |
| 1544 | LYD382 orange|11v1|BQ624436_T1 | 9023 | 730 | 87.8 | glotblastn |
| 1545 | LYD347 pepper|gb171|BM062178_P1 | 9024 | 509 | 83.0 | globlastp |
| 1545 | LYD382 pepper|gb171|BM062178_P1 | 9024 | 730 | 86.1 | globlastp |
| 1546 | LYD347 clementine|11v1|BQ624436_P1 | 9025 | 509 | 82.9 | globlastp |
| 1546 | LYD382 clementine|11v1|BQ624436_P1 | 9025 | 730 | 87.5 | globlastp |
| 1547 | LYD347 cucumber|09v1|AA660126_P1 | 9026 | 509 | 82.9 | globlastp |
| 1547 | LYD382 cucumber|09v1|AA660126_P1 | 9026 | 730 | 85.9 | globlastp |
| 1548 | LYD347 ipomoea_nil|10v1|BJ553348_P1 | 9027 | 509 | 82.8 | globlastp |
| 1548 | LYD382 ipomoea_nil|10v1|BJ553348_P 1 | 9027 | 730 | 86.6 | globlastp |
| 1549 | LYD347 potato|10v1|BF153260_P1 | 9028 | 509 | 82.8 | globlastp |
| 1549 | LYD382 potato|10v1|BF153260_P1 | 9028 | 730 | 85.9 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1550 | LYD347 tomato\|09v1\|BG129067 | 9029 | 509 | 82.8 | globlastp |
| 1550 | LYD382 tomato\|09v1\|BG129067 | 9029 | 730 | 85.9 | globlastp |
| 1551 | LYD347 ambrosia\|11v1\|SRR346935.111324_T1 | 9030 | 509 | 82.8 | glotblastn |
| 1551 | LYD382 ambrosia\|11v1\|SRR346935.111324_T1 | 9030 | 730 | 85.1 | glotblastn |
| 1552 | LYD347 ambrosia\|11v1\|SRR346935.125745_T1 | 9031 | 509 | 82.8 | glotblastn |
| 1552 | LYD382 ambrosia\|11v1\|SRR346935.125745_T1 | 9031 | 730 | 85.1 | glotblastn |
| 1553 | LYD347 ambrosia\|11v1\|GW917809_P1 | 9032 | 509 | 82.6 | globlastp |
| 1553 | LYD382 ambrosia\|11v1\|GW917809_P1 | 9032 | 730 | 85.6 | globlastp |
| 1554 | LYD347 grape\|11v1\|GSVIVT01032479001_P1 | 9033 | 509 | 82.6 | globlastp |
| 1554 | LYD382 grape\|11v1\|GSVIVT01032479001_P1 | 9033 | 730 | 88.5 | globlastp |
| 1555 | LYD347 grape\|gb160\|BM438023 | 9033 | 509 | 82.6 | globlastp |
| 1555 | LYD382 grape\|gb160\|BM438023 | 9033 | 730 | 88.5 | globlastp |
| 1556 | LYD347 ambrosia\|11v1\|SRR346943.106591_P1 | 9034 | 509 | 82.5 | globlastp |
| 1556 | LYD382 ambrosia\|11v1\|SRR346943.106591_P1 | 9034 | 730 | 85.6 | globlastp |
| 1557 | LYD347 fagopyrum\|11v1\|SRR063689X10645_P1 | 9035 | 509 | 82.5 | globlastp |
| 1557 | LYD382 fagopyrum\|11v1\|SRR063689X10645_P1 | 9035 | 730 | 85.3 | globlastp |
| 1558 | LYD347 flax\|11v1\|EU828966_P1 | 9036 | 509 | 82.5 | globlastp |
| 1558 | LYD382 flax\|11v1\|EU828966_P1 | 9036 | 730 | 83.8 | globlastp |
| 1559 | LYD347 poplar\|10v1\|BI122017_P1 | 9037 | 509 | 82.5 | globlastp |
| 1559 | LYD382 poplar\|10v1\|BI122017_P1 | 9037 | 730 | 84.8 | globlastp |
| 1560 | LYD347 sunflower\|10v1\|CX944970 | 9038 | 509 | 82.5 | globlastp |
| 1560 | LYD382 sunflower\|10v1\|CX944970 | 9038 | 730 | 85.1 | globlastp |
| 1561 | LYD347 tripterygium\|11v1\|SRR098677X105560_P1 | 9039 | 509 | 82.4 | globlastp |
| 1561 | LYD382 tripterygium\|11v1\|SRR098677X105560_P1 | 9039 | 730 | 86.0 | globlastp |
| 1562 | LYD347 cassava\|09v1\|BM260108_P1 | 9040 | 509 | 82.4 | globlastp |
| 1562 | LYD382 cassava\|09v1\|BM260108_P1 | 9040 | 730 | 86.2 | globlastp |
| 1563 | LYD347 apple\|gb171\|CN491175 | 9041 | 509 | 82.4 | globlastp |
| 1563 | LYD382 apple\|gb171\|CN491175 | 9041 | 730 | 85.5 | globlastp |
| 1564 | LYD347 cirsium\|11v1\|SRR346952.1057863_P1 | 9042 | 509 | 82.3 | globlastp |
| 1564 | LYD382 cirsium\|11v1\|SRR346952.1057863_P1 | 9042 | 730 | 85.6 | globlastp |
| 1565 | LYD347 cucurbita\|11v1\|SRR091276X101026_P1 | 9043 | 509 | 82.3 | globlastp |
| 1565 | LYD382 cucurbita\|11v1\|SRR091276X101026_P1 | 9043 | 730 | 85.9 | globlastp |
| 1566 | LYD347 primula\|11v1\|SRR098679X101712_P1 | 9044 | 509 | 82.3 | globlastp |
| 1566 | LYD382 primula\|11v1\|SRR098679X101712_P1 | 9044 | 730 | 87.2 | globlastp |
| 1567 | LYD347 flaveria\|11v1\|SRR149232.127567_T1 | 9045 | 509 | 82.3 | glotblastn |
| 1567 | LYD382 flaveria\|11v1\|SRR149232.127567_T1 | 9045 | 730 | 86.1 | glotblastn |
| 1568 | LYD347 arnica\|11v1\|SRR099034X100307_P1 | 9046 | 509 | 82.2 | globlastp |
| 1568 | LYD382 arnica\|11v1\|SRR099034X100307_P1 | 9046 | 730 | 86.4 | globlastp |
| 1569 | LYD347 cacao\|10v1\|CA798573_P1 | 9047 | 509 | 82.2 | globlastp |
| 1569 | LYD382 cacao\|10v1\|CA798573_P1 | 9047 | 730 | 96.1 | globlastp |
| 1570 | LYD347 castorbean\|09v1\|EE260103 | 9048 | 509 | 82.2 | globlastp |
| 1570 | LYD382 castorbean\|09v1\|EE260103 | 9048 | 730 | 88.2 | globlastp |
| 1571 | LYD347 castorbean\|11v1\|GE632314_P1 | 9048 | 509 | 82.2 | globlastp |
| 1571 | LYD382 castorbean\|11v1\|GE632314_P1 | 9048 | 730 | 88.2 | globlastp |
| 1572 | LYD347 solanum_phureja\|09v1\|SPHBG129067 | 9049 | 509 | 82.2 | globlastp |
| 1572 | LYD382 solanum_phureja\|09v1\|SPHBG129067 | 9049 | 730 | 85.3 | globlastp |
| 1573 | LYD347 monkeyflower\|10v1\|DV209035_P1 | 9050 | 509 | 82.1 | globlastp |
| 1573 | LYD382 monkeyflower\|10v1\|DV209035_P1 | 9050 | 730 | 85.2 | globlastp |
| 1574 | LYD347 humulus\|11v1\|ES652349_T1 | 9051 | 509 | 82.0 | glotblastn |
| 1574 | LYD382 humulus\|11v1\|ES652349_T1 | 9051 | 730 | 87.2 | glotblastn |
| 1575 | LYD347 amsonia\|11v1\|SRR098688X105321_P1 | 9052 | 509 | 82.0 | globlastp |
| 1575 | LYD382 amsonia\|11v1\|SRR098688X105321_P1 | 9052 | 730 | 86.6 | globlastp |
| 1576 | LYD347 cirsium\|11v1\|SRR346952.100859XX2_P1 | 9053 | 509 | 82.0 | globlastp |
| 1576 | LYD382 cirsium\|11v1\|SRR346952.100859XX2_P1 | 9053 | 730 | 85.1 | globlastp |
| 1577 | LYD347 ginger\|gb164\|DY350675_P1 | 9054 | 509 | 82.0 | globlastp |
| 1577 | LYD382 ginger\|gb164\|DY350675_P1 | 9054 | 730 | 83.6 | globlastp |
| 1578 | LYD347 flax\|11v1\|CV478318_P1 | 9055 | 509 | 81.9 | globlastp |
| 1578 | LYD382 flax\|11v1\|CV478318_P1 | 9055 | 730 | 83.2 | globlastp |
| 1579 | LYD347 cassava\|09v1\|DB922389_P1 | 9056 | 509 | 81.9 | globlastp |
| 1579 | LYD382 cassava\|09v1\|DB922389_P1 | 9056 | 730 | 83.6 | globlastp |
| 1580 | LYD347 triphysaria\|10v1\|EY134477 | 9057 | 509 | 81.8 | globlastp |
| 1580 | LYD382 triphysaria\|10v1\|EY134477 | 9057 | 730 | 86.7 | globlastp |
| 1581 | LYD347 aquilegia\|10v2\|DR913682_P1 | 9058 | 509 | 81.8 | globlastp |
| 1581 | LYD382 aquilegia\|10v2\|DR913682_P1 | 9058 | 730 | 86.2 | globlastp |
| 1582 | LYD347 primula\|11v1\|SRR098679X125363_T1 | 9059 | 509 | 81.7 | glotblastn |
| 1582 | LYD382 primula\|11v1\|SRR098679X125363_T1 | 9059 | 730 | 86.7 | glotblastn |
| 1583 | LYD347 flaveria\|11v1\|SRR149229.106951_P1 | 9060 | 509 | 81.7 | globlastp |
| 1583 | LYD382 flaveria\|11v1\|SRR149229.106951_P1 | 9060 | 730 | 85.1 | globlastp |
| 1584 | LYD347 apple\|11v1\|CN496368_P1 | 9061 | 509 | 81.6 | globlastp |
| 1584 | LYD382 apple\|11v1\|CN496368_P1 | 9061 | 730 | 85.2 | globlastp |
| 1585 | LYD347 apple\|gb171\|CN496368 | 9061 | 509 | 81.6 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1585 | LYD382 apple\|gb171\|CN496368 | 9061 | 730 | 85.2 | globlastp |
| 1586 | LYD347 valeriana\|11v1\|SRR099039X105731_P1 | 9062 | 509 | 81.5 | globlastp |
| 1586 | LYD382 valeriana\|11v1\|SRR099039X105731_P1 | 9062 | 730 | 84.6 | globlastp |
| 1587 | LYD347 fagopyrum\|11v1\|SRR063689X181932_T1 | 9063 | 509 | 81.5 | glotblastn |
| 1587 | LYD382 fagopyrum\|11v1\|SRR063689X181932_T1 | 9063 | 730 | 84.3 | glotblastn |
| 1588 | LYD347 cirsium\|11v1\|SRR346952.654383_T1 | 9064 | 509 | 81.5 | glotblastn |
| 1588 | LYD382 cirsium\|11v1\|SRR346952.654383_T1 | 9064 | 730 | 85.1 | glotblastn |
| 1589 | LYD347 euonymus\|11v1\|SRR070038X106454_P1 | 9065 | 509 | 81.4 | globlastp |
| 1589 | LYD382 euonymus\|11v1\|SRR070038X106454_P1 | 9065 | 730 | 84.7 | globlastp |
| 1590 | LYD347 coffea\|10v1\|DV685773_P1 | 9066 | 509 | 81.3 | globlastp |
| 1590 | LYD382 coffea\|10v1\|DV685773_P1 | 9066 | 539 | 88.3 | globlastp |
| 1591 | LYD347 cirsium\|11v1\|SRR346952.1001087_P1 | 9067 | 509 | 81.2 | globlastp |
| 1591 | LYD382 cirsium\|11v1\|SRR346952.1001087_P1 | 9067 | 730 | 85.3 | globlastp |
| 1592 | LYD347 euphorbia\|11v1\|SRR098678X111141_P1 | 9068 | 509 | 81.2 | globlastp |
| 1592 | LYD382 euphorbia\|11v1\|SRR098678X111141_P1 | 9068 | 730 | 84.5 | globlastp |
| 1593 | LYD347 flaveria\|11v1\|SRR149229.119399_T1 | 9069 | 509 | 81.2 | glotblastn |
| 1593 | LYD382 flaveria\|11v1\|SRR149229.119399_T1 | 9069 | 730 | 84.8 | glotblastn |
| 1594 | LYD347 flaveria\|11v1\|SRR149232.147624_T1 | 9070 | 509 | 81.2 | glotblastn |
| 1594 | LYD382 flaveria\|11v1\|SRR149232.147624_T1 | 9070 | 730 | 85.6 | glotblastn |
| 1595 | LYD347 thalictrum\|11v1\|SRR096787X104425_P1 | 9071 | 509 | 81.2 | globlastp |
| 1595 | LYD382 thalictrum\|11v1\|SRR096787X104425_P1 | 9071 | 730 | 86.4 | globlastp |
| 1596 | LYD347 tragopogon\|10v1\|SRR020205S0001095 | 9072 | 509 | 81.2 | globlastp |
| 1596 | LYD382 tragopogon\|10v1\|SRR020205S0001095 | 9072 | 730 | 83.9 | globlastp |
| 1597 | LYD347 strawberry\|11v1\|CX309713 | 9073 | 509 | 81.2 | globlastp |
| 1597 | LYD382 strawberry\|11v1\|CX309713 | 9073 | 730 | 82.2 | globlastp |
| 1598 | LYD347 chelidonium\|11v1\|SRR084752X107866_P1 | 9074 | 509 | 81.0 | globlastp |
| 1598 | LYD382 chelidonium\|11v1\|SRR084752X107866_P1 | 9074 | 730 | 83.6 | globlastp |
| 1599 | LYD347 eucalyptus\|11v2\|CD669010_P1 | 9075 | 509 | 81.0 | globlastp |
| 1599 | LYD382 eucalyptus\|11v2\|CD669010_P1 | 9075 | 730 | 86.1 | globlastp |
| 1600 | LYD347 flaveria\|11v1\|SRR149229.204863_T1 | 9076 | 509 | 80.9 | glotblastn |
| 1600 | LYD382 flaveria\|11v1\|SRR149229.204863_T1 | 9076 | 730 | 85.6 | glotblastn |
| 1601 | LYD347 amorphophallus\|11v2\|SRR089351X100835_P1 | 9077 | 509 | 80.9 | globlastp |
| 1601 | LYD382 amorphophallus\|11v2\|SRR089351X100835_P1 | 9077 | 730 | 84.6 | globlastp |
| 1602 | LYD347 amorphophallus\|11v2\|SRR089351X101509_P1 | 9077 | 509 | 80.9 | globlastp |
| 1602 | LYD382 amorphophallus\|11v2\|SRR089351X101509_P1 | 9077 | 730 | 84.6 | globlastp |
| 1603 | LYD347 artemisia\|10v1\|EY073413_P1 | 9078 | 509 | 80.9 | globlastp |
| 1603 | LYD382 artemisia\|10v1\|EY073413_P1 | 9078 | 730 | 82.4 | globlastp |
| 1604 | LYD347 prunus\|10v1\|BU040535 | 9079 | 509 | 80.8 | globlastp |
| 1604 | LYD382 prunus\|10v1\|BU040535 | 9079 | 730 | 84.4 | globlastp |
| 1605 | LYD347 maize\|10v1\|AI396543_P1 | 9080 | 509 | 80.7 | globlastp |
| 1605 | LYD382 maize\|10v1\|AI396543_P1 | 9080 | 730 | 82.2 | globlastp |
| 1606 | LYD347 brachypodium\|09v1\|DV469678_P1 | 9081 | 509 | 80.7 | globlastp |
| 1606 | LYD382 brachypodium\|09v1\|DV469678_P1 | 9081 | 730 | 82.5 | globlastp |
| 1607 | LYD347 dandelion\|10v1\|DR399741_P1 | 9082 | 509 | 80.7 | globlastp |
| 1607 | LYD382 dandelion\|10v1\|DR399741_P1 | 9082 | 730 | 82.4 | globlastp |
| 1608 | LYD347 cynara\|gb167\|GE583628_T1 | 9083 | 509 | 80.7 | glotblastn |
| 1608 | LYD382 cynara\|gb167\|GE583628_P1 | 9083 | 730 | 81.5 | globlastp |
| 1609 | LYD347 eucalyptus\|11v2\|ES591288_P1 | 9084 | 509 | 80.5 | globlastp |
| 1609 | LYD382 eucalyptus\|11v2\|ES591288_P1 | 9084 | 730 | 85.1 | globlastp |
| 1610 | LYD347 banana\|10v1\|ES432636_T1 | 9085 | 509 | 80.5 | glotblastn |
| 1610 | LYD382 banana\|10v1\|ES432636_T1 | 9085 | 730 | 84.1 | glotblastn |
| 1611 | LYD347 foxtail_millet\|11v3\|EC612516_P1 | 9086 | 509 | 80.4 | globlastp |
| 1611 | LYD382 foxtail_millet\|11v3\|EC612516_P1 | 9086 | 730 | 82.5 | globlastp |
| 1612 | LYD347 sorghum\|09v1\|SB10G016920 | 9087 | 509 | 80.4 | globlastp |
| 1612 | LYD382 sorghum\|09v1\|SB10G016920 | 9087 | 730 | 82.5 | globlastp |
| 1613 | LYD347 sugarcane\|10v1\|BQ532057 | 9088 | 509 | 80.4 | globlastp |
| 1613 | LYD382 sugarcane\|10v1\|BQ532057 | 9088 | 730 | 82.2 | globlastp |
| 1614 | LYD347 lettuce\|10v1\|DW050040_P1 | 9089 | 509 | 80.4 | globlastp |
| 1614 | LYD382 lettuce\|10v1\|DW050040_P1 | 9089 | 730 | 83.7 | globlastp |
| 1615 | LYD347 kiwi\|gb166\|FG403468_P1 | 9090 | 509 | 80.3 | globlastp |
| 1615 | LYD382 kiwi\|gb166\|FG403468_P1 | 9090 | 730 | 86.5 | globlastp |
| 1616 | LYD347 phalaenopsis\|11v1\|CB034755_T1 | 9091 | 509 | 80.3 | glotblastn |
| 1616 | LYD382 phalaenopsis\|11v1\|CB034755_T1 | 9091 | 730 | 83.6 | glotblastn |
| 1617 | LYD347 oat\|11v1\|GO589524_P1 | 9092 | 509 | 80.2 | globlastp |
| 1617 | LYD382 oat\|11v1\|GO589524_P1 | 9092 | 730 | 80.9 | globlastp |
| 1618 | LYD347 millet\|10v1\|EVO454PM004772_P1 | 9093 | 509 | 80.2 | globlastp |
| 1618 | LYD382 millet\|10v1\|EVO454PM004772_P1 | 9093 | 730 | 82.7 | globlastp |
| 1619 | LYD347 orobanche\|10v1\|SRR023189S0016104_P1 | 9094 | 509 | 80.1 | globlastp |
| 1619 | LYD382 orobanche\|10v1\|SRR023189S0016104_P1 | 9094 | 730 | 84.5 | globlastp |
| 1620 | LYD351 arabidopsis\|10v1\|AT1G31800_P1 | 9095 | 512 | 93.5 | globlastp |
| 1621 | LYD353 thellungiella_halophilum\|11v1\|EHJGI11024072_P1 | 9096 | 514 | 89.3 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name  cluster name | Polyp. SEQ ID NO: | Hom to SEQ ID NO: | % glob. iden. | Algor. |
|---|---|---|---|---|---|
| 1622 | LYD353 thellungiella_parvulum\|11v1\|EPCRP023947_P1 | 9097 | 514 | 88.9 | globlastp |
| 1623 | LYD353 arabidopsis_lyrata\|09v1\|JGIAL020765_P1 | 9098 | 514 | 84.9 | globlastp |
| 1624 | LYD353 arabidopsis\|10v1\|AT5G10770_P1 | 9099 | 514 | 84.7 | globlastp |
| 1625 | LYD355 canola\|11v1\|CN736451_P1 | 9100 | 516 | 97.2 | globlastp |
| 1626 | LYD355 b_oleracea\|gb161\|AM394007_P1 | 9101 | 516 | 96.6 | globlastp |
| 1627 | LYD355 b_rapa\|gb162\|CO749256_P1 | 9102 | 516 | 96.3 | globlastp |
| 1628 | LYD355 canola\|11v1\|EE476105_P1 | 9102 | 516 | 96.3 | globlastp |
| 1629 | LYD355 radish\|gb164\|EV524473 | 9103 | 516 | 96.3 | globlastp |
| 1630 | LYD355 thellungiella_halophilum\|11v1\|BY808349_P1 | 9104 | 516 | 92.3 | globlastp |
| 1631 | LYD355 thellungiella_parvulum\|11v1\|BY808349_P1 | 9105 | 516 | 92.0 | globlastp |
| 1632 | LYD355 arabidopsis\|10v1\|AT4G11960_P1 | 9106 | 516 | 89.1 | globlastp |
| 1633 | LYD355 canola\|11v1\|EV099323_P1 | 9107 | 516 | 88.5 | globlastp |
| 1634 | LYD355 arabidopsis_lyrata\|09v1\|JGIAL023225_P1 | 9108 | 516 | 88.5 | globlastp |
| 1635 | LYD355 cleome_spinosa\|10v1\|GR934825_P1 | 9109 | 516 | 86.7 | globlastp |
| 1636 | LYD355 cleome_spinosa\|10v1\|GR934831_P1 | 9110 | 516 | 86.4 | globlastp |
| 1637 | LYD355 cleome_gynandra\|10v1\|SRR015532S0000822_P1 | 9111 | 516 | 85.5 | globlastp |
| 1638 | LYD355 cleome_gynandra\|10v1\|SRR015532S0007703_P1 | 9112 | 516 | 85.5 | globlastp |
| 1639 | LYD355 thellungiella_parvulum\|11v1\|BQ060370_P1 | 9113 | 516 | 83.6 | globlastp |
| 1640 | LYD355 b_juncea\|10v2\|E6ANDIZ01B6EYB_P1 | 9114 | 516 | 82.7 | globlastp |
| 1641 | LYD355 b_rapa\|gb162\|DN962684_P1 | 9115 | 516 | 82.0 | globlastp |
| 1642 | LYD355 canola\|11v1\|DY023875_P1 | 9116 | 516 | 81.7 | globlastp |
| 1643 | LYD355 thellungiella_halophilum\|11v1\|BQ060370_P1 | 9117 | 516 | 81.6 | globlastp |
| 1644 | LYD355 canola\|10v1\|EV187672 | 9118 | 516 | 81.4 | globlastp |
| 1645 | LYD355 canola\|10v1\|EI07712 | 9119 | 516 | 81.4 | globlastp |
| 1646 | LYD355 canola\|11v1\|EE536208_P1 | 9119 | 516 | 81.4 | globlastp |
| 1647 | LYD355 b_rapa\|gb162\|BG543462_P1 | 9119 | 516 | 81.4 | globlastp |
| 1648 | LYD355 radish\|gb164\|EV531280 | 9120 | 516 | 81.3 | globlastp |
| 1649 | LYD355 canola\|10v1\|EG021185 | 9121 | 516 | 81.1 | globlastp |
| 1650 | LYD355 b_oleracea\|gb161\|DY026614_P1 | 9122 | 516 | 81.1 | globlastp |
| 1651 | LYD355 b_juncea\|10v2\|E6ANDIZ01BE1PA_P1 | 9123 | 516 | 81.1 | globlastp |
| 1652 | LYD355 arabidopsis\|10v1\|AT4G22890_P1 | 9124 | 516 | 80.9 | globlastp |
| 1653 | LYD355 radish\|gb164\|EV525287 | 9125 | 516 | 80.9 | globlastp |
| 1654 | LYD355 canola\|11v1\|EE445039_P1 | 9126 | 516 | 80.7 | globlastp |
| 1655 | LYD355 arabidopsis_lyrata\|09v1\|JGIAL025823_P1 | 9127 | 516 | 80.7 | globlastp |
| 1656 | LYD357 canola\|11v1\|EV171423_P1 | 9128 | 518 | 87.0 | globlastp |
| 1657 | LYD357 canola\|11v1\|SRR019559.7968_P1 | 9129 | 518 | 82.8 | globlastp |
| 1658 | LYD357 canola\|11v1\|EV189571_T1 | 9130 | 518 | 82.5 | glotblastn |
| 1659 | LYD358 canola\|11v1\|EE421539_P1 | 9131 | 519 | 98.5 | globlastp |
| 1660 | LYD358 canola\|10v1\|CD833137 | 9132 | 519 | 98.0 | globlastp |
| 1661 | LYD358 cacao\|10v1\|CU497386_T1 | 9133 | 519 | 84.3 | glotblastn |
| 1662 | LYD358 vinca\|11v1\|SRR098690X117469_T1 | 9134 | 519 | 83.4 | glotblastn |
| 1663 | LYD358 euonymus\|11v1\|SRR070038X158390_P1 | 9135 | 519 | 82.8 | globlastp |
| 1664 | LYD358 soybean\|11v1\|GLYMA02G37700_T1 | 9136 | 519 | 82.6 | glotblastn |
| 1665 | LYD358 pigeonpea\|10v1\|GW348451_P1 | 9137 | 519 | 82.4 | globlastp |
| 1666 | LYD358 tripterygium\|11v1\|SRR098677X128870_P1 | 9138 | 519 | 81.9 | globlastp |
| 1667 | LYD358 soybean\|11v1\|GLYMA14G35990 | 9139 | 519 | 81.9 | globlastp |
| 1668 | LYD358 switchgrass\|gb167\|FE615243_P1 | 9140 | 519 | 80.6 | globlastp |
| 1669 | LYD358 foxtail_millet\|11v3\|PHY7SI029820M_P1 | 9141 | 519 | 80.5 | globlastp |
| 1670 | LYD358 brachypodium\|09v1\|DV474127_P1 | 9142 | 519 | 80.1 | globlastp |
| 1671 | LYD358 millet\|10v1\|EVO454PM001120_P1 | 9143 | 519 | 80.1 | globlastp |
| 1672 | LYD359 flaveria\|11v1\|SRR149229.106616_P1 | 9144 | 520 | 81.1 | globlastp |
| 1673 | LYD359 flaveria\|11v1\|SRR149232.101689_T1 | 9145 | 520 | 80.6 | glotblastn |
| 1674 | LYD360 fraxinus\|11v1\|SRR058827.105177_T1 | 9146 | 521 | 84.2 | glotblastn |
| 1675 | LYD361 b_rapa\|gb162\|CX265816_P1 | 9147 | 522 | 99.5 | globlastp |
| 1676 | LYD361 radish\|gb164\|EV527913 | 9148 | 522 | 99.3 | globlastp |
| 1677 | LYD361 canola\|10v1\|H74744 | 9149 | 522 | 99.3 | globlastp |
| 1678 | LYD361 canola\|11v1\|CN736161_P1 | 9149 | 522 | 99.3 | globlastp |
| 1679 | LYD361 thellungiella_parvulum\|11v1\|BY812098_P1 | 9150 | 522 | 97.0 | globlastp |
| 1680 | LYD361 thellungiella_halophilum\|11v1\|BY812098_P1 | 9151 | 522 | 94.9 | globlastp |
| 1681 | LYD361 arabidopsis\|10v1\|AT1G43190_P1 | 9152 | 522 | 94.9 | globlastp |
| 1682 | LYD361 arabidopsis_lyrata\|09v1\|JGIAL003860_T1 | 9153 | 522 | 94.2 | glotblastn |
| 1683 | LYD361 cotton\|10v2\|BM359742_P1 | 9154 | 522 | 87.2 | globlastp |
| 1684 | LYD361 castorbean\|11v1\|EG661912_T1 | 9155 | 522 | 86.3 | glotblastn |
| 1685 | LYD361 cacao\|10v1\|CU500347_P1 | 9156 | 522 | 86.3 | globlastp |
| 1686 | LYD361 cassava\|09v1\|DV452263_P1 | 9157 | 522 | 85.6 | globlastp |
| 1687 | LYD361 poplar\|10v1\|BI130401_P1 | 9158 | 522 | 85.6 | globlastp |
| 1688 | LYD361 catharanthus\|11v1\|SRR098691X127119_T1 | 9159 | 522 | 85.4 | glotblastn |
| 1689 | LYD361 eucalyptus\|11v2\|SRR001659X120392_P1 | 9160 | 522 | 84.0 | globlastp |
| 1690 | LYD361 euphorbia\|11v1\|SRR098678X100013_P1 | 9161 | 522 | 84.0 | globlastp |
| 1691 | LYD361 peanut\|10v1\|ES712655_P1 | 9162 | 522 | 84.0 | globlastp |
| 1692 | LYD361 poplar\|10v1\|BI132286_P1 | 9163 | 522 | 83.8 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1693 | LYD361 citrus\|gb166\|CF828428_P1 | 9164 | 522 | 83.6 | globlastp |
| 1694 | LYD361 clementine\|11v1\|CF828428_P1 | 9165 | 522 | 83.6 | globlastp |
| 1695 | LYD361 orange\|11v1\|CF828428_P1 | 9164 | 522 | 83.6 | globlastp |
| 1696 | LYD361 peanut\|10v1\|ES703657_P1 | 9166 | 522 | 83.6 | globlastp |
| 1697 | LYD361 pigeonpea\|10v1\|SRR054580S0002896_P1 | 9167 | 522 | 83.2 | globlastp |
| 1698 | LYD361 soybean\|11v1\|GLYMA16G27970_P1 | 9168 | 522 | 83.2 | globlastp |
| 1699 | LYD361 euonymus\|11v1\|SRR070038X183598_P1 | 9169 | 522 | 83.0 | globlastp |
| 1700 | LYD361 prunus\|10v1\|CN863451_P1 | 9170 | 522 | 82.9 | globlastp |
| 1701 | LYD361 cassava\|09v1\|DB924424_P1 | 9171 | 522 | 82.8 | globlastp |
| 1702 | LYD361 soybean\|11v1\|GLYMA02G08870_P1 | 9172 | 522 | 82.7 | globlastp |
| 1703 | LYD361 euonymus\|11v1\|SRR070038X232447_P1 | 9173 | 522 | 82.6 | globlastp |
| 1704 | LYD361 castorbean\|09v1\|EG661912 | 9174 | 522 | 82.6 | globlastp |
| 1705 | LYD361 medicago\|09v1\|AW697167_T1 | 9175 | 522 | 82.5 | glotblastn |
| 1706 | LYD361 soybean\|11v1\|GLYMA20G30820_P1 | 9176 | 522 | 82.4 | globlastp |
| 1707 | LYD361 strawberry\|11v1\|CO380909_P1 | 9177 | 522 | 82.0 | globlastp |
| 1708 | LYD361 oak\|10v1\|FP050105_P1 | 9178 | 522 | 81.9 | globlastp |
| 1709 | LYD361 pigeonpea\|10v1\|SRR054580S0001419_P1 | 9179 | 522 | 81.8 | globlastp |
| 1710 | LYD361 trigonella\|11v1\|SRR066194X118927_P1 | 9180 | 522 | 81.8 | globlastp |
| 1711 | LYD361 eucalyptus\|11v2\|CD668707_P1 | 9181 | 522 | 81.6 | globlastp |
| 1712 | LYD361 soybean\|11v1\|GLYMA10G36770_P1 | 9182 | 522 | 81.3 | globlastp |
| 1713 | LYD361 cannabis\|12v1\|JK494197_P1 | 9183 | 522 | 81.0 | globlastp |
| 1714 | LYD361 lotus\|09v1\|BW597660_P1 | 9184 | 522 | 81.0 | globlastp |
| 1715 | LYD361 tomato\|11v1\|AA840712_P1 | 9185 | 522 | 81.0 | globlastp |
| 1716 | LYD361 solanum_phureja\|09v1\|SPHBG125314_P1 | 9186 | 522 | 80.7 | globlastp |
| 1717 | LYD362 b_oleracea\|gb161\|AM058722_P1 | 523 | 523 | 100.0 | globlastp |
| 1718 | LYD362 b_rapa\|gb162\|CX270841_P1 | 523 | 523 | 100.0 | globlastp |
| 1719 | LYD362 canola\|10v1\|CD818750 | 523 | 523 | 100.0 | globlastp |
| 1720 | LYD362 canola\|11v1\|CN735773_P1 | 523 | 523 | 100.0 | globlastp |
| 1721 | LYD362 canola\|10v1\|CD818786 | 9187 | 523 | 99.1 | globlastp |
| 1722 | LYD362 canola\|11v1\|DT469142XX1_P1 | 9188 | 523 | 99.1 | globlastp |
| 1723 | LYD362 b_juncea\|10v2\|E6ANDIZ01ARDSX_P1 | 9189 | 523 | 96.4 | globlastp |
| 1724 | LYD362 radish\|gb164\|EV565231 | 9190 | 523 | 94.5 | globlastp |
| 1725 | LYD362 radish\|gb164\|EW722889 | 9191 | 523 | 94.5 | globlastp |
| 1726 | LYD362 radish\|gb164\|EY949609 | 9192 | 523 | 93.6 | globlastp |
| 1727 | LYD362 arabidopsis\|10v1\|AT2G30410_P1 | 9193 | 523 | 92.9 | globlastp |
| 1728 | LYD362 radish\|gb164\|EY909380 | 9194 | 523 | 92.7 | globlastp |
| 1729 | LYD362 thellungiella_halophilum\|11v1\|BM985651_P1 | 9195 | 523 | 89.4 | globlastp |
| 1730 | LYD362 thellungiella\|gb167\|BM985651 | 9196 | 523 | 89.4 | globlastp |
| 1731 | LYD362 arabidopsis_lyrata\|09v1\|JGIAL014106_P1 | 9197 | 523 | 86.7 | globlastp |
| 1732 | LYD362 arabidopsis_lyrata\|09v1\|JGIAL031573_P1 | 9197 | 523 | 86.7 | globlastp |
| 1733 | LYD362 cleome_spinosa\|10v1\|GR931717_P1 | 9198 | 523 | 84.1 | globlastp |
| 1734 | LYD362 b_juncea\|10v2\|BJ1SLX00084544D1_P1 | 9199 | 523 | 82.7 | globlastp |
| 1735 | LYD362 cleome_spinosa\|10v1\|GR933996_P1 | 9200 | 523 | 81.4 | globlastp |
| 1736 | LYD364 canola\|11v1\|EE559498_P1 | 9201 | 524 | 97.2 | globlastp |
| 1737 | LYD364 arabidopsis\|10v1\|AT2G39450_P1 | 9202 | 524 | 95.2 | globlastp |
| 1738 | LYD364 arabidopsis_lyrata\|09v1\|JGIAL032027_P1 | 9203 | 524 | 94.7 | globlastp |
| 1739 | LYD364 arabidopsis_lyrata\|09v1\|JGIAL015195_P1 | 9204 | 524 | 93.9 | globlastp |
| 1740 | LYD364 castorbean\|09v1\|XM002533618 | 9205 | 524 | 84.3 | globlastp |
| 1741 | LYD364 castorbean\|11v1\|XM002533618_P1 | 9205 | 524 | 84.3 | globlastp |
| 1742 | LYD364 papaya\|gb165\|EX260866_P1 | 9206 | 524 | 84.0 | globlastp |
| 1743 | LYD364 prunus\|10v1\|CN879479 | 9207 | 524 | 83.5 | globlastp |
| 1744 | LYD364 nasturtium\|10v1\|SRR032558S0022337 | 9208 | 524 | 83.1 | globlastp |
| 1745 | LYD364 humulus\|11v1\|GD251458_P1 | 9209 | 524 | 83.0 | globlastp |
| 1746 | LYD364 cassava\|09v1\|DB926040_P1 | 9210 | 524 | 82.7 | globlastp |
| 1747 | LYD364 soybean\|11v1\|GLYMA02G10580 | 9211 | 524 | 81.8 | globlastp |
| 1748 | LYD364 soybean\|11v1\|GLYMA18G52280 | 9212 | 524 | 81.8 | globlastp |
| 1749 | LYD364 pigeonpea\|10v1\|SRR054580S0008451_P1 | 9213 | 524 | 81.6 | globlastp |
| 1750 | LYD364 eucalyptus\|11v2\|CU397180_P1 | 9214 | 524 | 81.6 | globlastp |
| 1751 | LYD364 poplar\|10v1\|BU817178_P1 | 9215 | 524 | 81.5 | globlastp |
| 1752 | LYD364 cowpea\|gb166\|FF383719_P1 | 9216 | 524 | 81.3 | globlastp |
| 1753 | LYD364 medicago\|09v1\|BG449878_P1 | 9217 | 524 | 81.3 | globlastp |
| 1754 | LYD364 poplar\|10v1\|BI138818_P1 | 9218 | 524 | 81.0 | globlastp |
| 1755 | LYD364 cannabis\|12v1\|SOLX00036108_P1 | 9219 | 524 | 80.9 | globlastp |
| 1756 | LYD364 bean\|gb167\|CA899124_P1 | 9220 | 524 | 80.6 | globlastp |
| 1757 | LYD364 spurge\|gb161\|DV146410 | 9221 | 524 | 80.3 | globlastp |
| 1758 | LYD364 tomato\|09v1\|AW031194 | 9222 | 524 | 80.1 | globlastp |
| 1759 | LYD367 euphorbia\|11v1\|DV138613XX2_P1 | 9223 | 527 | 88.8 | globlastp |
| 1760 | LYD367 castorbean\|11v1\|RCCRP026082_P1 | 9224 | 527 | 88.4 | globlastp |
| 1761 | LYD367 castorbean\|09v1\|GE633160 | 9224 | 527 | 88.4 | globlastp |
| 1762 | LYD367 prunus\|10v1\|BU574102 | 9225 | 527 | 87.3 | globlastp |
| 1763 | LYD367 strawberry\|11v1\|DY666902 | 9226 | 527 | 87.3 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1764 | LYD367 apple\|11v1\|CN491058_P 1 | 9227 | 527 | 86.9 | globlastp |
| 1765 | LYD367 apple\|gb171\|CN490020 | 9228 | 527 | 86.7 | globlastp |
| 1766 | LYD367 apple\|11v1\|CN490020_P1 | 9229 | 527 | 85.4 | globlastp |
| 1767 | LYD367 euonymus\|11v1\|SRR070038X1110_P1 | 9230 | 527 | 85.4 | globlastp |
| 1768 | LYD367 grape\|11v1\|GSVIVT01032872001_P1 | 9231 | 527 | 85.3 | globlastp |
| 1769 | LYD367 apple\|11v1\|CN544831_P1 | 9232 | 527 | 84.4 | globlastp |
| 1770 | LYD367 strawberry\|11v1\|DV438123 | 9233 | 527 | 84.4 | globlastp |
| 1771 | LYD367 soybean\|11v1\|GLYMA02G38500 | 9234 | 527 | 83.4 | globlastp |
| 1772 | LYD367 cowpea\|gb166\|FC458770_P1 | 9235 | 527 | 83.4 | globlastp |
| 1773 | LYD367 soybean\|11v1\|GLYMA14G36580 | 9236 | 527 | 83.4 | globlastp |
| 1774 | LYD367 clementine\|11v1\|CB293725_P1 | 9237 | 527 | 82.5 | globlastp |
| 1775 | LYD367 orange\|11v1\|CB293725_P1 | 9237 | 527 | 82.5 | globlastp |
| 1776 | LYD367 soybean\|11v1\|GLYMA04G40290 | 9238 | 527 | 82.1 | globlastp |
| 1777 | LYD367 castorbean\|11v1\|XM_002520858_P1 | 9239 | 527 | 81.2 | globlastp |
| 1778 | LYD367 artemisia\|10v1\|EY098387_P1 | 9240 | 527 | 80.5 | globlastp |
| 1779 | LYD368 b_rapa\|gb162\|CV432839_P1 | 9241 | 528 | 97.9 | globlastp |
| 1780 | LYD368 canola\|10v1\|EE412828 | 9242 | 528 | 97.9 | globlastp |
| 1781 | LYD368 canola\|11v1\|DY024249_P1 | 9241 | 528 | 97.9 | globlastp |
| 1782 | LYD368 b_oleracea\|gb161\|EH419690_P1 | 9243 | 528 | 96.9 | globlastp |
| 1783 | LYD368 canola\|10v1\|DY024249 | 9243 | 528 | 96.9 | globlastp |
| 1784 | LYD368 thellungiella_parvulum\|11v1\|EPCRP012252_T1 | 9244 | 528 | 87.5 | glotblastn |
| 1785 | LYD368 b_juncea\|10v2\|E6ANDIZ01AHGDF_P1 | 9245 | 528 | 84.4 | globlastp |
| 1786 | LYD368 b_rapa\|gb162\|CV545051_P1 | 9246 | 528 | 84.4 | globlastp |
| 1787 | LYD368 canola\|10v1\|H07527 | 9246 | 528 | 84.4 | globlastp |
| 1788 | LYD368 b_juncea\|10v2\|E6ANDIZ01BH57J_P1 | 9247 | 528 | 83.3 | globlastp |
| 1789 | LYD368 radish\|gb164\|EV525681 | 9248 | 528 | 83.3 | globlastp |
| 1790 | LYD368 radish\|gb164\|EV528102 | 9249 | 528 | 83.3 | globlastp |
| 1791 | LYD368 canola\|11v1\|DW997927_P1 | 9250 | 528 | 82.3 | globlastp |
| 1792 | LYD368 thellungiella_halophilum\|11v1\|EHJGI11002707_T1 | 9251 | 528 | 81.3 | glotblastn |
| 1793 | LYD368 arabidopsis_lyrata\|09v1\|CRPALE003204_P1 | 9252 | 528 | 81.2 | globlastp |
| 1794 | LYD368 canola\|10v1\|EV092534 | 9253 | 528 | 81.2 | globlastp |
| 1795 | LYD368 canola\|11v1\|EV092534_P1 | 9253 | 528 | 81.2 | globlastp |
| 1796 | LYD368 b_juncea\|10v2\|E6ANDIZ01DLRGJ_P1 | 9254 | 528 | 80.2 | globlastp |
| 1797 | LYD370 wheat\|10v2\|CO348607 | 9255 | 529 | 94.8 | globlastp |
| 1798 | LYD370 wheat\|10v2\|CA621682 | 9256 | 529 | 94.0 | globlastp |
| 1799 | LYD370 brachypodium\|09v1\|GT768373_P1 | 9257 | 529 | 86.0 | globlastp |
| 1800 | LYD370 cenchrus\|gb166\|EB653682_P1 | 9258 | 529 | 82.3 | globlastp |
| 1801 | LYD370 foxtail_millet\|10v2\|EC612415 | 9259 | 529 | 81.6 | globlastp |
| 1802 | LYD370 foxtail_millet\|11v3\|EC612415_P1 | 9259 | 529 | 81.6 | globlastp |
| 1803 | LYD370 rice\|gb170\|OS02G30210 | 9260 | 529 | 81.0 | glotblastn |
| 1804 | LYD370 switchgrass\|gb167\|FE605702 | 9261 | 529 | 80.8 | globlastp |
| 1805 | LYD370 millet\|10v1\|EVO454PM006085_P1 | 9262 | 529 | 80.5 | globlastp |
| 1806 | LYD370 sorghum\|11v1\|SB04G020510_P1 | 9263 | 529 | 80.5 | globlastp |
| 1806 | LYD370 sorghum\|09v1\|SB04G020510 | 9264 | 529 | 80.3 | glotblastn |
| 1807 | LYD371 oat\|11v1\|GO587393_P1 | 9265 | 530 | 87.1 | globlastp |
| 1808 | LYD371 oat\|10v2\|GO587393 | 9266 | 530 | 87.1 | glotblastn |
| 1809 | LYD371 wheat\|10v2\|BE591640 | 9267 | 530 | 86.3 | globlastp |
| 1810 | LYD371 brachypodium\|09v1\|GT785931_P1 | 9268 | 530 | 82.0 | globlastp |
| 1811 | LYD372 canola\|11v1\|SRR329661.194576_T1 | 9269 | 531 | 98.1 | glotblastn |
| 1812 | LYD372 thellungiella_halophilum\|11v1\|DN775351_P1 | 9270 | 531 | 94.7 | globlastp |
| 1813 | LYD372 thellungiella_parvulum\|11v1\|DN775351_P1 | 9271 | 531 | 93.8 | globlastp |
| 1814 | LYD372 canola\|11v1\|EV191509_T1 | 9272 | 531 | 92.8 | glotblastn |
| 1815 | LYD372 arabidopsis_lyrata\|09v1\|JGIAL031176_P1 | 9273 | 531 | 91.7 | globlastp |
| 1816 | LYD372 canola\|11v1\|ES975082_T1 | 9274 | 531 | 91.4 | glotblastn |
| 1817 | LYD372 arabidopsis\|10v1\|AT5G64940_P1 | 9275 | 531 | 91.3 | globlastp |
| 1818 | LYD372 canola\|11v1\|CN735553_T1 | 9276 | 531 | 88.6 | glotblastn |
| 1819 | LYD372 cleome_spinosa\|10v1\|SRR015531S0000116_P1 | 9277 | 531 | 84.2 | globlastp |
| 1820 | LYD375 b_rapa\|gb162\|EX135722_P1 | 9278 | 532 | 97.7 | globlastp |
| 1821 | LYD375 canola\|10v1\|CN727702 | 9279 | 532 | 97.3 | globlastp |
| 1822 | LYD375 thellungiella_parvulum\|11v1\|BY802168_P1 | 9280 | 532 | 93.7 | globlastp |
| 1823 | LYD375 b_juncea\|10v2\|E6ANDIZ01AJVXG_P1 | 9281 | 532 | 93.7 | globlastp |
| 1824 | LYD375 radish\|gb164\|EW714450 | 9282 | 532 | 93.7 | globlastp |
| 1825 | LYD375 arabidopsis\|10v1\|AT5G26220_P1 | 9283 | 532 | 90.0 | globlastp |
| 1826 | LYD375 thellungiella_halophilum\|11v1\|BY802168_P1 | 9284 | 532 | 89.7 | globlastp |
| 1827 | LYD375 arabidopsis_lyrata\|09v1\|JGIAL022363_P1 | 9285 | 532 | 88.2 | globlastp |
| 1828 | LYD375 radish\|gb164\|FD960741 | 9286 | 532 | 85.0 | glotblastn |
| 1829 | LYD376 thellungiella_parvulum\|11v1\|EPCRP014458_P1 | 9287 | 533 | 83.2 | globlastp |
| 1830 | LYD376 thellungiella_halophilum\|11v1\|EHJGI11009619_P1 | 9288 | 533 | 82.6 | globlastp |
| 1831 | LYD376 arabidopsis\|10v1\|AT2G46340_P1 | 9289 | 533 | 82.6 | globlastp |
| 1832 | LYD376 arabidopsis_lyrata\|09v1\|JGIAL016038_P1 | 9290 | 533 | 81.6 | globlastp |
| 1833 | LYD377 canola\|11v1\|EV098297_P1 | 9291 | 534 | 84.9 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1834 | LYD379 b_rapa\|gb162\|CX271630_P1 | 9292 | 536 | 99.6 | globlastp |
| 1835 | LYD379 radish\|gb164\|EV544172 | 9293 | 536 | 97.1 | globlastp |
| 1836 | LYD379 b_juncea\|10v2\|E6ANDIZ01AMKB5_P1 | 9294 | 536 | 96.3 | globlastp |
| 1837 | LYD379 thellungiella_halophilum\|11v1\|EHJGI11024159_P1 | 9295 | 536 | 94.7 | globlastp |
| 1838 | LYD379 thellungiella_halophilum\|11v1\|EHJGI11025592_T1 | 9296 | 536 | 94.7 | glotblastn |
| 1839 | LYD379 b_juncea\|10v2\|E6ANDIZ01CHCMG_P1 | 9297 | 536 | 93.0 | globlastp |
| 1840 | LYD379 canola\|10v1\|CD822865 | 9298 | 536 | 92.2 | globlastp |
| 1841 | LYD379 canola\|11v1\|EG020911_P1 | 9298 | 536 | 92.2 | globlastp |
| 1842 | LYD379 radish\|gb164\|EV526885 | 9299 | 536 | 92.2 | globlastp |
| 1843 | LYD379 thellungiella_parvulum\|11v1\|EPCRP026832_T1 | 9300 | 536 | 91.0 | glotblastn |
| 1844 | LYD379 thellungiella_parvulum\|11v1\|EPCRP024302_P1 | 9301 | 536 | 90.9 | globlastp |
| 1845 | LYD379 arabidopsis_lyrata\|09v1\|JGIAL019940_P1 | 9302 | 536 | 88.7 | globlastp |
| 1846 | LYD379 arabidopsis\|10v1\|AT5G03170_P1 | 9303 | 536 | 88.7 | globlastp |
| 1847 | LYD379 b_rapa\|gb162\|EX016587_P1 | 9304 | 536 | 85.4 | globlastp |
| 1848 | LYD379 b_juncea\|10v2\|E6ANDIZ01BL8GX_P1 | 9305 | 536 | 81.5 | globlastp |
| 1849 | LYD380 cotton\|10v2\|SRR032367S0710599_T1 | 9306 | 537 | 92.7 | glotblastn |
| 1850 | LYD386 cotton\|10v2\|BF278870_P1 | 9307 | 542 | 97.3 | globlastp |
| 1851 | LYD387 cacao\|10v1\|CU513902_P1 | 9308 | 543 | 90.8 | globlastp |
| 1852 | LYD387 clementine\|11v1\|DN799412_P1 | 9309 | 543 | 81.7 | globlastp |
| 1853 | LYD387 orange\|11v1\|DN799412_P1 | 9310 | 543 | 80.3 | globlastp |
| 1854 | LYD387 oak\|10v1\|FN698737_T1 | 9311 | 543 | 80.0 | glotblastn |
| 1855 | LYD391 foxtail_millet\|11v3\|PHY7SI001924M_P1 | 9312 | 546 | 87.8 | globlastp |
| 1856 | LYD391 foxtail_millet\|10v2\|FXTRMSLX00201082D1 | 9313 | 546 | 87.7 | globlastp |
| 1857 | LYD391 rice\|gb170\|OS01G51920 | 9314 | 546 | 84.1 | globlastp |
| 1858 | LYD391 brachypodium\|09v1\|GT764491_P1 | 9315 | 546 | 82.9 | globlastp |
| 1859 | LYD391 oat\|10v2\|GR325627 | 9316 | 546 | 82.7 | glotblastn |
| 1860 | LYD391 oat\|10v2\|GR321475 | 9317 | 546 | 81.9 | globlastp |
| 1861 | LYD391 wheat\|10v2\|BE498760 | 9318 | 546 | 81.6 | globlastp |
| 1862 | LYD391 wheat\|10v2\|BE418714 | 9319 | 546 | 80.6 | globlastp |
| 1863 | LYD392 sugarcane\|10v1\|BQ529848 | 9320 | 547 | 92.6 | globlastp |
| 1864 | LYD392 sorghum\|09v1\|SB02G028940 | 9321 | 547 | 92.4 | globlastp |
| 1865 | LYD392 sorghum\|11v1\|SB02G028940_P1 | 9321 | 547 | 92.4 | globlastp |
| 1866 | LYD392 maize\|10v1\|AW215973_P1 | 9322 | 547 | 91.0 | globlastp |
| 1867 | LYD393 trigonella\|11v1\|SRR066194X125018_P1 | 9323 | 548 | 82.6 | globlastp |
| 1868 | LYD393 trigonella\|11v1\|SRR066194X111381_T1 | 9324 | 548 | 82.5 | glotblastn |
| 1869 | LYD393 trigonella\|11v1\|SRR066194X100657_P1 | 9325 | 548 | 82.2 | globlastp |
| 1870 | LYD393 medicago\|09v1\|AW684192_P1 | 9326 | 548 | 82.2 | globlastp |
| 1871 | LYD393 trigonella\|11v1\|SRR066194X179446_P1 | 9327 | 548 | 82.1 | globlastp |
| 1872 | LYD393 trigonella\|11v1\|SRR066194X120068_P1 | 9328 | 548 | 81.7 | globlastp |
| 1873 | LYD393 trigonella\|11v1\|SRR066194X108217_T1 | 9329 | 548 | 81.3 | glotblastn |
| 1874 | LYD395 cowpea\|gb166\|FF388146_T1 | 9330 | 549 | 87.4 | glotblastn |
| 1875 | LYD395 soybean\|11v1\|GLYMA07G32980 | 9331 | 549 | 86.8 | glotblastn |
| 1876 | LYD395 soybean\|11v1\|GLYMA02G15520 | 9332 | 549 | 86.1 | glotblastn |
| 1877 | LYD395 pigeonpea\|10v1\|SRR054580S0035790_T1 | 9333 | 549 | 85.5 | glotblastn |
| 1878 | LYD395 bean\|gb167\|CA910344_T1 | 9334 | 549 | 84.9 | glotblastn |
| 1879 | LYD395 lotus\|09v1\|LLBW596306_T1 | 9335 | 549 | 84.3 | glotblastn |
| 1880 | LYD396 soybean\|11v1\|GLYMA15G06460 | 9336 | 550 | 84.6 | globlastp |
| 1881 | LYD396 cowpea\|gb166\|FF386126_P1 | 9337 | 550 | 82.9 | globlastp |
| 1882 | LYD396 peanut\|10v1\|ES717343_P1 | 9338 | 550 | 81.7 | globlastp |
| 1883 | LYD396 cassava\|09v1\|DV456223_P1 | 9339 | 550 | 80.0 | globlastp |
| 1884 | LYD396 oak\|10v1\|SRR006307S0005274_P1 | 9340 | 550 | 80.0 | globlastp |
| 1885 | LYD397 trigonella\|11v1\|SRR066194X126544_P1 | 9341 | 551 | 94.1 | globlastp |
| 1886 | LYD397 peanut\|10v1\|ES718930_P1 | 9342 | 551 | 87.0 | globlastp |
| 1887 | LYD397 bean\|gb167\|CB540509_P1 | 9343 | 551 | 85.5 | globlastp |
| 1888 | LYD397 soybean\|11v1\|GLYMA09G30670 | 9344 | 551 | 85.0 | globlastp |
| 1889 | LYD397 soybean\|11v1\|GLYMA07G11600 | 9345 | 551 | 84.4 | globlastp |
| 1890 | LYD397 cowpea\|gb166\|FF539245_P1 | 9346 | 551 | 83.8 | globlastp |
| 1891 | LYD399 cowpea\|gb166\|FF387908_P1 | 9347 | 553 | 90.0 | globlastp |
| 1892 | LYD399 grape\|gb160\|CB914867 | 9348 | 553 | 88.8 | globlastp |
| 1893 | LYD399 soybean\|11v1\|GLYMA15G07890 | 9349 | 553 | 87.6 | globlastp |
| 1894 | LYD399 euphorbia\|11v1\|DV135472_P1 | 9350 | 553 | 87.3 | globlastp |
| 1895 | LYD399 grape\|11v1\|GSVIVT01002021001_P1 | 9351 | 553 | 87.3 | globlastp |
| 1896 | LYD399 bean\|gb167\|FE705939_T1 | 9352 | 553 | 87.3 | glotblastn |
| 1897 | LYD399 lotus\|09v1\|BP074755_P1 | 9353 | 553 | 86.9 | globlastp |
| 1898 | LYD399 soybean\|11v1\|GLYMA13G24930 | 9354 | 553 | 86.1 | globlastp |
| 1899 | LYD399 trigonella\|11v1\|SRR066194X332395_T1 | 9355 | 553 | 86.1 | glotblastn |
| 1900 | LYD399 papaya\|gb165\|EX256723_P1 | 9356 | 553 | 85.7 | globlastp |
| 1901 | LYD399 soybean\|11v1\|GLYMA07G31510 | 9357 | 553 | 85.7 | globlastp |
| 1902 | LYD399 castorbean\|11v1\|EE255123_P1 | 9358 | 553 | 85.7 | glotblastn |
| 1903 | LYD399 cowpea\|gb166\|FF387808_P1 | 9359 | 553 | 85.3 | globlastp |
| 1904 | LYD399 heritiera\|10v1\|SRR005795S0016182_T1 | 9360 | 553 | 85.3 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1905 | LYD399 cassava\|09v1\|CK642897_P1 | 9361 | 553 | 84.9 | globlastp |
| 1906 | LYD399 castorbean\|11v1\|EE260645_P1 | 9362 | 553 | 84.5 | globlastp |
| 1907 | LYD399 castorbean\|09v1\|EE260645 | 9362 | 553 | 84.5 | globlastp |
| 1908 | LYD399 chestnut\|gb170\|SRR006297S0030011_P1 | 9363 | 553 | 84.5 | globlastp |
| 1909 | LYD399 nasturtium\|10v1\|SRR032558S0141877 | 9364 | 553 | 84.5 | globlastp |
| 1910 | LYD399 soybean\|11v1\|GLYMA13G31450 | 9365 | 553 | 84.5 | globlastp |
| 1911 | LYD399 medicago\|09v1\|BE240651_P1 | 9366 | 553 | 84.1 | globlastp |
| 1912 | LYD399 peanut\|10v1\|ES719692_P1 | 9367 | 553 | 84.1 | globlastp |
| 1913 | LYD399 poplar\|10v1\|BU823784_P1 | 9368 | 553 | 84.1 | globlastp |
| 1914 | LYD399 clementine\|11v1\|CK701105_P1 | 9369 | 553 | 83.7 | globlastp |
| 1915 | LYD399 orange\|11v1\|CK701105_P1 | 9370 | 553 | 83.7 | globlastp |
| 1916 | LYD399 citrus\|gb166\|CK701105_P1 | 9370 | 553 | 83.7 | globlastp |
| 1917 | LYD399 valeriana\|11v1\|SRR099039X130276_T1 | 9371 | 553 | 83.3 | glotblastn |
| 1918 | LYD399 euonymus\|11v1\|SRR070038X178680_P1 | 9372 | 553 | 82.9 | globlastp |
| 1919 | LYD399 silene\|11v1\|GH294151XX1_P1 | 9373 | 553 | 82.9 | globlastp |
| 1920 | LYD399 cotton\|10v2\|CO495256_P1 | 9374 | 553 | 82.9 | globlastp |
| 1921 | LYD399 strawberry\|11v1\|GW402854 | 9375 | 553 | 82.9 | globlastp |
| 1922 | LYD399 euonymus\|11v1\|SRR070038X175660_P1 | 9376 | 553 | 82.5 | globlastp |
| 1923 | LYD399 cotton\|10v2\|DT047262_P1 | 9377 | 553 | 82.5 | globlastp |
| 1924 | LYD399 prunus\|10v1\|CN918732 | 9378 | 553 | 82.5 | globlastp |
| 1925 | LYD399 pigeonpea\|10v1\|SRR054580S0032474_T1 | 9379 | 553 | 82.5 | glotblastn |
| 1926 | LYD399 cucumber\|09v1\|AM718551_P1 | 9380 | 553 | 82.1 | globlastp |
| 1927 | LYD399 watermelon\|11v1\|AM718551_P1 | 9381 | 553 | 81.7 | globlastp |
| 1928 | LYD399 melon\|10v1\|AM718551_P1 | 9381 | 553 | 81.7 | globlastp |
| 1929 | LYD399 poplar\|10v1\|BU877356_P1 | 9382 | 553 | 81.7 | globlastp |
| 1930 | LYD399 apple\|11v1\|CN495494_P1 | 9383 | 553 | 81.3 | globlastp |
| 1931 | LYD399 solanum_phureja\|09v1\|SPHAI777435 | 9384 | 553 | 80.9 | globlastp |
| 1932 | LYD399 eucalyptus\|11v2\|SRR001659X187899_P1 | 9385 | 553 | 80.5 | globlastp |
| 1933 | LYD399 monkeyflower\|10v1\|CV520980_P1 | 9386 | 553 | 80.5 | globlastp |
| 1934 | LYD399 tomato\|09v1\|AI777435 | 9387 | 553 | 80.5 | globlastp |
| 1935 | LYD399 silene\|11v1\|SRR096785X108973_T1 | 9388 | 553 | 80.5 | glotblastn |
| 1936 | LYD399 cacao\|10v1\|CU469886_T1 | 9389 | 553 | 80.5 | glotblastn |
| 1937 | LYD399 nasturtium\|10v1\|SRR032558S0071113 | 9390 | 553 | 80.5 | glotblastn |
| 1938 | LYD399 orobanche\|10v1\|SRR023189S0079506_T1 | 9391 | 553 | 80.2 | glotblastn |
| 1939 | LYD399 coffea\|10v1\|DV675552_P1 | 9392 | 553 | 80.1 | globlastp |
| 1940 | LYD399 triphysaria\|10v1\|EY184391 | 9393 | 553 | 80.1 | globlastp |
| 1941 | LYD399 pineapple\|10v1\|CO731834_T1 | 9394 | 553 | 80.1 | glotblastn |
| 1942 | LYD401 trigonella\|11v1\|SRR066194X116571_P1 | 9395 | 554 | 93.7 | globlastp |
| 1943 | LYD401 pigeonpea\|10v1\|SRR054580S0000550_T1 | 9396 | 554 | 88.3 | glotblastn |
| 1944 | LYD401 soybean\|11v1\|GLYMA12G03620 | 9397 | 554 | 87.2 | globlastp |
| 1945 | LYD401 soybean\|11v1\|GLYMA11G11470 | 9398 | 554 | 87.0 | globlastp |
| 1946 | LYD401 bean\|gb167\|CA908778_P1 | 9399 | 554 | 86.8 | globlastp |
| 1947 | LYD401 clementine\|11v1\|CB291203_P1 | 9400 | 554 | 81.8 | globlastp |
| 1948 | LYD401 orange\|11v1\|CB291203_P1 | 9401 | 554 | 81.8 | globlastp |
| 1949 | LYD401 citrus\|gb166\|CB291203_P1 | 9402 | 554 | 81.8 | globlastp |
| 1950 | LYD401 cassava\|09v1\|JGICASSAVA3500M1_P1 | 9403 | 554 | 81.1 | globlastp |
| 1951 | LYD401 cacao\|10v1\|CA795197_P1 | 9404 | 554 | 81.0 | globlastp |
| 1952 | LYD401 soybean\|11v1\|GLYMA06G00610 | 9405 | 554 | 81.0 | globlastp |
| 1953 | LYD401 poplar\|10v1\|CF236165_P1 | 9406 | 554 | 80.4 | globlastp |
| 1954 | LYD401 grape\|11v1\|GSVIVT01009943001_P1 | 9407 | 554 | 80.0 | globlastp |
| 1955 | LYD401 grape\|gb160\|CF373318 | 9408 | 554 | 80.0 | globlastp |
| 1956 | LYD402 soybean\|11v1\|GLYMA16G03490 | 9409 | 555 | 91.7 | globlastp |
| 1957 | LYD402 pigeonpea\|10v1\|SRR054580S0013470_P1 | 9410 | 555 | 90.8 | globlastp |
| 1958 | LYD402 soybean\|11v1\|GLYMA09G00990 | 9411 | 555 | 90.8 | globlastp |
| 1959 | LYD402 soybean\|11v1\|GLYMA15G11840 | 9412 | 555 | 90.5 | globlastp |
| 1960 | LYD402 trigonella\|11v1\|SRR066195X303860_T1 | 9413 | 555 | 89.5 | glotblastn |
| 1961 | LYD402 cowpea\|gb166\|FF400752_P1 | 9414 | 555 | 88.2 | globlastp |
| 1962 | LYD402 pigeonpea\|10v1\|SRR054580S0001612_P1 | 9415 | 555 | 88.2 | globlastp |
| 1963 | LYD402 clover\|gb162\|BB906633_P1 | 9416 | 555 | 88.0 | globlastp |
| 1964 | LYD402 peanut\|10v1\|CD037669_P1 | 9417 | 555 | 85.6 | globlastp |
| 1965 | LYD402 bean\|gb167\|CA910295_P1 | 9418 | 555 | 83.8 | globlastp |
| 1966 | LYD404 trigonella\|11v1\|SRR066194X117614_P1 | 9419 | 557 | 93.9 | globlastp |
| 1967 | LYD404 clover\|gb162\|BB903862_P1 | 9420 | 557 | 88.8 | globlastp |
| 1968 | LYD404 pigeonpea\|10v1\|SRR054580S0004281_T1 | 9421 | 557 | 80.2 | glotblastn |
| 1969 | LYD410 trigonella\|11v1\|SRR066194X12105_P1 | 9422 | 562 | 90.0 | globlastp |
| 1970 | LYD410 lotus\|09v1\|CRPLJ028057_P1 | 9423 | 562 | 81.4 | globlastp |
| 1971 | LYD410 soybean\|11v1\|GLYMA17G03600 | 9424 | 562 | 80.5 | globlastp |
| 1972 | LYD413 soybean\|11v1\|GLYMA11G19070 | 9425 | 563 | 86.0 | globlastp |
| 1973 | LYD414 lotus\|09v1\|CRPLJ029488_P1 | 9426 | 564 | 94.2 | globlastp |
| 1974 | LYD414 lotus\|09v1\|GO018872_P1 | 9427 | 564 | 94.2 | globlastp |
| 1975 | LYD414 pigeonpea\|10v1\|GW359329_P1 | 9428 | 564 | 91.3 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 1976 | LYD414 soybean\|11v1\|GLYMA17G02670 | 9429 | 564 | 91.3 | globlastp |
| 1977 | LYD414 soybean\|11v1\|GLYMA07G38030 | 9430 | 564 | 90.3 | globlastp |
| 1978 | LYD414 cleome_spinosa\|10v1\|GR933852_P1 | 9431 | 564 | 89.3 | globlastp |
| 1979 | LYD414 bean\|gb167\|FE680198_P1 | 9432 | 564 | 88.3 | globlastp |
| 1980 | LYD414 lotus\|09v1\|CRPLJ020033_P1 | 9433 | 564 | 87.4 | globlastp |
| 1981 | LYD414 peanut\|10v1\|GO265885_P1 | 9434 | 564 | 85.4 | globlastp |
| 1982 | LYD414 apple\|11v1\|CO723505_P 1 | 9435 | 564 | 84.5 | globlastp |
| 1983 | LYD414 thellungiella_parvulum\|11v1\|BY806450_P1 | 9436 | 564 | 84.5 | globlastp |
| 1984 | LYD414 thellungiella_parvulum\|11v1\|EPPRD115540_P1 | 9436 | 564 | 84.5 | globlastp |
| 1985 | LYD414 peanut\|10v1\|SRR042421S0009019_P1 | 9437 | 564 | 84.5 | globlastp |
| 1986 | LYD414 arabidopsis\|10v1\|AT5G18600_P1 | 9438 | 564 | 83.5 | globlastp |
| 1987 | LYD414 cotton\|10v2\|DW495711_P1 | 9439 | 564 | 83.5 | globlastp |
| 1988 | LYD414 nasturtium\|10v1\|SRR032563S0302860 | 9440 | 564 | 83.5 | glotblastn |
| 1989 | LYD414 strawberry\|11v1\|CRPFV006980 | 9441 | 564 | 83.5 | globlastp |
| 1990 | LYD414 strawberry\|11v1\|DY667636 | 9442 | 564 | 83.5 | globlastp |
| 1991 | LYD414 strawberry\|11v1\|EX659937 | 9443 | 564 | 83.5 | globlastp |
| 1992 | LYD414 cotton\|10v2\|SRR032877S0785567_T1 | 9444 | 564 | 82.5 | glotblastn |
| 1993 | LYD414 cannabis\|12v1\|SOLX00084372_P1 | 9445 | 564 | 82.5 | globlastp |
| 1994 | LYD414 canola\|11v1\|SRR341921.89376_P1 | 9446 | 564 | 82.5 | globlastp |
| 1995 | LYD414 clementine\|11v1\|CX299972_P1 | 9447 | 564 | 82.5 | globlastp |
| 1996 | LYD414 orange\|11v1\|CX299972_P1 | 9447 | 564 | 82.5 | globlastp |
| 1997 | LYD414 thellungiella_halophilum\|11v1\|BY806450_P1 | 9448 | 564 | 82.5 | globlastp |
| 1998 | LYD414 thellungiella_halophilum\|11v1\|EHPRD123585_P1 | 9448 | 564 | 82.5 | globlastp |
| 1999 | LYD414 chestnut\|gb170\|SRR006295S0025297_P1 | 9449 | 564 | 82.5 | globlastp |
| 2000 | LYD414 oak\|10v1\|CU657214_P1 | 9449 | 564 | 82.5 | globlastp |
| 2001 | LYD414 papaya\|gb165\|EX280370_P1 | 9450 | 564 | 82.5 | globlastp |
| 2002 | LYD414 radish\|gb164\|EV527379 | 9451 | 564 | 82.5 | globlastp |
| 2003 | LYD414 soybean\|11v1\|GLYMA13G28750 | 9452 | 564 | 82.5 | globlastp |
| 2004 | LYD414 soybean\|11v1\|GLYMA15G10340 | 9453 | 564 | 82.5 | globlastp |
| 2005 | LYD414 thellungiella\|gb167\|BY806450 | 9448 | 564 | 82.5 | globlastp |
| 2006 | LYD414 canola\|11v1\|EE445453_P1 | 9454 | 564 | 82.5 | globlastp |
| 2007 | LYD414 phyla\|11v2\|SRR0199035X103366_P | 9455 | 564 | 81.6 | globlastp |
| 2008 | LYD414 apple\|gb171\|CN912693 | 9456 | 564 | 81.6 | globlastp |
| 2009 | LYD414 arabidopsis_lyrata\|09v1\|JGIAL021580_P1 | 9457 | 564 | 81.6 | globlastp |
| 2010 | LYD414 b_rapa\|gb162\|EX127132_P1 | 9458 | 564 | 81.6 | globlastp |
| 2011 | LYD414 canola\|10v1\|T18374 | 9458 | 564 | 81.6 | globlastp |
| 2012 | LYD414 cleome_spinosa\|10v1\|SRR015531S0016539_P1 | 9459 | 564 | 81.6 | globlastp |
| 2013 | LYD414 poplar\|10v1\|CV130866_P1 | 9460 | 564 | 81.6 | globlastp |
| 2014 | LYD414 prunus\|10v1\|CN912693 | 9461 | 564 | 81.6 | globlastp |
| 2015 | LYD414 radish\|gb164\|EW716200 | 9462 | 564 | 81.6 | globlastp |
| 2016 | LYD414 strawberry\|11v1\|SRR034859S0010037 | 9463 | 564 | 81.6 | globlastp |
| 2017 | LYD414 cleome_spinosa\|10v1\|SRR015531S0048948_T1 | — | 564 | 81.6 | glotblastn |
| 2018 | LYD414 thellungiella_parvulum\|11v1\|BY806386_P1 | 9464 | 564 | 80.6 | globlastp |
| 2019 | LYD414 b_juncea\|10v2\|GT068231_P1 | 9465 | 564 | 80.6 | globlastp |
| 2020 | LYD414 canola\|10v1\|EV095853 | 9466 | 564 | 80.6 | globlastp |
| 2021 | LYD414 canola\|11v1\|EV095853_P1 | 9466 | 564 | 80.6 | globlastp |
| 2022 | LYD414 citrus\|gb166\|CX299972_P1 | 9467 | 564 | 80.6 | globlastp |
| 2023 | LYD414 poplar\|10v1\|CV240662_P1 | 9468 | 564 | 80.6 | globlastp |
| 2024 | LYD414 poplar\|10v1\|CV278171_P1 | 9469 | 564 | 80.6 | globlastp |
| 2025 | LYD416 soybean\|11v1\|GLYMA06G46430 | 9470 | 566 | 87.0 | globlastp |
| 2026 | LYD416 trigonella\|11v1\|SRR066194X101909_P1 | 9471 | 566 | 85.9 | globlastp |
| 2027 | LYD416 pigeonpea\|10v1\|SRR054580S0002803_P1 | 9472 | 566 | 85.1 | globlastp |
| 2028 | LYD416 clover\|gb162\|BB914177_P1 | 9473 | 566 | 84.4 | globlastp |
| 2029 | LYD416 peanut\|10v1\|ES713065_P1 | 9474 | 566 | 82.6 | globlastp |
| 2030 | LYD416 cowpea\|gb166\|FF552168_P1 | 9475 | 566 | 82.2 | globlastp |
| 2031 | LYD416 chestnut\|gb170\|SRR006295S0029361_P1 | 9476 | 566 | 80.9 | globlastp |
| 2032 | LYD416 oak\|10v1\|CU657704_P1 | 9477 | 566 | 80.9 | globlastp |
| 2033 | LYD416 cacao\|10v1\|CU471550_T1 | 9478 | 566 | 80.3 | glotblastn |
| 2034 | LYD419 cowpea\|gb166\|FF390537_P1 | 9479 | 569 | 80.7 | globlastp |
| 2035 | LYD422 cowpea\|gb166\|AY193836_P1 | 9480 | 572 | 85.6 | globlastp |
| 2036 | LYD422 soybean\|11v1\|GLYMA04G16670 | 9481 | 572 | 84.9 | globlastp |
| 2037 | LYD422 peanut\|10v2\|GO257637_P1 | 9482 | 572 | 83.8 | globlastp |
| 2038 | LYD422 cotton\|10v2\|CO070710_P1 | 9483 | 572 | 82.5 | globlastp |
| 2039 | LYD422 grape\|11v1\|GSVIVT01012120001_P1 | 9484 | 572 | 80.7 | globlastp |
| 2040 | LYD423 maize\|10v1\|AW065872_P1 | 9485 | 573 | 94.9 | globlastp |
| 2041 | LYD423 maize\|10v1\|BM078612_P1 | 9486 | 573 | 94.6 | globlastp |
| 2042 | LYD423 foxtail_millet\|10v2\|SICRP033197 | 9487 | 573 | 91.1 | globlastp |
| 2043 | LYD423 foxtail_millet\|11v3\|PHY7SI035674M_P1 | 9487 | 573 | 91.1 | globlastp |
| 2044 | LYD423 switchgrass\|gb167\|FE647721 | 9488 | 573 | 87.9 | glotblastn |
| 2045 | LYD424 maize\|10v1\|BM332887_P1 | 9489 | 574 | 91.7 | globlastp |
| 2046 | LYD424 foxtail_millet\|11v3\|PHY7SI036740M_P1 | 9490 | 574 | 88.4 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 2047 | LYD424 rice\|gb170\|OS03G06680 | 9491 | 574 | 80.8 | glotblastn |
| 2048 | LYD424 leymus\|gb166\|EG375050_P1 | 9492 | 574 | 80.0 | globlastp |
| 2049 | LYD424 pseudoroegneria\|gb167\|FF340165 | 9493 | 574 | 80.0 | glotblastn |
| 2050 | LYD425 amorphophallus\|11v2\|SRR089351X105267_P1 | 575 | 575 | 100.0 | globlastp |
| 2051 | LYD425 amorphophallus\|11v2\|SRR089351X161133_P1 | 575 | 575 | 100.0 | globlastp |
| 2052 | LYD425 amsonia\|11v1\|SRR098688X115913_P1 | 575 | 575 | 100.0 | globlastp |
| 2053 | LYD425 apple\|11v1\|CN489923_T1 | 9494 | 575 | 100.0 | glotblastn |
| 2054 | LYD425 apple\|11v1\|GO552106_P1 | 575 | 575 | 100.0 | globlastp |
| 2055 | LYD425 arnica\|11v1\|SRR099034X180374_P1 | 575 | 575 | 100.0 | globlastp |
| 2056 | LYD425 catharanthus\|11v1\|EG557453XX1_P1 | 575 | 575 | 100.0 | globlastp |
| 2057 | LYD425 chelidonium\|11v1\|SRR084752X213032_P1 | 575 | 575 | 100.0 | globlastp |
| 2058 | LYD425 cirsium\|11v1\|SRR346952.1007935_P1 | 575 | 575 | 100.0 | globlastp |
| 2059 | LYD425 cirsium\|11v1\|SRR346952.1040707_P1 | 575 | 575 | 100.0 | globlastp |
| 2060 | LYD425 cirsium\|11v1\|SRR346952.155897_P1 | 575 | 575 | 100.0 | globlastp |
| 2061 | LYD425 cirsium\|11v1\|SRR346952.182812_P1 | 575 | 575 | 100.0 | globlastp |
| 2062 | LYD425 cirsium\|11v1\|SRR346952.28824_P1 | 575 | 575 | 100.0 | globlastp |
| 2063 | LYD425 cirsium\|11v1\|SRR349641.179804_P1 | 575 | 575 | 100.0 | globlastp |
| 2064 | LYD425 clementine\|11v1\|BQ623073_P1 | 575 | 575 | 100.0 | globlastp |
| 2065 | LYD425 cucurbita\|11v1\|SRR091276X104602_P1 | 575 | 575 | 100.0 | globlastp |
| 2066 | LYD425 fagopyrum\|11v1\|SRR063689X107152_P1 | 575 | 575 | 100.0 | globlastp |
| 2067 | LYD425 fagopyrum\|11v1\|SRR063689X12648_P1 | 575 | 575 | 100.0 | globlastp |
| 2068 | LYD425 flaveria\|11v1\|SRR149232.324408_P1 | 575 | 575 | 100.0 | globlastp |
| 2069 | LYD425 humulus\|11v1\|GD244886_P1 | 575 | 575 | 100.0 | globlastp |
| 2070 | LYD425 olea\|11v1\|SRR014463.33572_P1 | 575 | 575 | 100.0 | globlastp |
| 2071 | LYD425 orange\|11v1\|BQ623073_P1 | 575 | 575 | 100.0 | globlastp |
| 2072 | LYD425 plantago\|11v1\|SRR066373X248945_P1 | 575 | 575 | 100.0 | globlastp |
| 2073 | LYD425 platanus\|11v1\|SRR096786X116167_P1 | 575 | 575 | 100.0 | globlastp |
| 2074 | LYD425 primula\|11v1\|SRR098679X101493_P1 | 575 | 575 | 100.0 | globlastp |
| 2075 | LYD425 primula\|11v1\|SRR098679X126892_P1 | 575 | 575 | 100.0 | globlastp |
| 2076 | LYD425 sarracenia\|11v1\|SRR192669.105268_P1 | 575 | 575 | 100.0 | globlastp |
| 2077 | LYD425 sarracenia\|11v1\|SRR192669.127382_P1 | 575 | 575 | 100.0 | globlastp |
| 2078 | LYD425 sarracenia\|1v1\|SRR192669.154681_P1 | 575 | 575 | 100.0 | globlastp |
| 2079 | LYD425 silene\|11v1\|DV768270_P1 | 575 | 575 | 100.0 | globlastp |
| 2080 | LYD425 tabernaemontana\|11v1\|SRR098689X17937_P1 | 575 | 575 | 100.0 | globlastp |
| 2081 | LYD425 thalictrum\|11v1\|SRR096787X112641_P1 | 575 | 575 | 100.0 | globlastp |
| 2082 | LYD425 tomato\|11v1\|BG130030_P1 | 575 | 575 | 100.0 | globlastp |
| 2083 | LYD425 trigonella\|11v1\|SRR066194X117847_P1 | 575 | 575 | 100.0 | globlastp |
| 2084 | LYD425 trigonella\|11v1\|SRR066194X334327_P1 | 575 | 575 | 100.0 | globlastp |
| 2085 | LYD425 valeriana\|11v1\|SRR099039X101266_P1 | 575 | 575 | 100.0 | globlastp |
| 2086 | LYD425 vinca\|11v1\|SRR098690X107973_P1 | 575 | 575 | 100.0 | globlastp |
| 2087 | LYD425 vinca\|11v1\|SRR098690X155758_P1 | 575 | 575 | 100.0 | globlastp |
| 2088 | LYD425 watermelon\|11v1\|AM735805_P1 | 575 | 575 | 100.0 | globlastp |
| 2089 | LYD425 acacia\|10v1\|FS586303_P1 | 575 | 575 | 100.0 | globlastp |
| 2090 | LYD425 antirrhinum\|gb166\|AJ559330_P1 | 575 | 575 | 100.0 | globlastp |
| 2091 | LYD425 apple\|gb171\|CN489610 | 575 | 575 | 100.0 | globlastp |
| 2092 | LYD425 aquilegia\|10v2\|JGIAC002861_P1 | 575 | 575 | 100.0 | globlastp |
| 2093 | LYD425 aquilegia\|10v2\|JGIAC004817_P1 | 575 | 575 | 100.0 | globlastp |
| 2094 | LYD425 aristolochia\|10v1\|FD748189_P1 | 575 | 575 | 100.0 | globlastp |
| 2095 | LYD425 artemisia\|10v1\|SRR019254S0007321_P1 | 575 | 575 | 100.0 | globlastp |
| 2096 | LYD425 artemisia\|10v1\|SRR019254S0067002_P1 | 575 | 575 | 100.0 | globlastp |
| 2097 | LYD425 avocado\|10v1\|FD502501_P1 | 575 | 575 | 100.0 | globlastp |
| 2098 | LYD425 banana\|10v1\|FF558222_P1 | 575 | 575 | 100.0 | globlastp |
| 2099 | LYD425 banana\|10v1\|FF561412_P1 | 575 | 575 | 100.0 | globlastp |
| 2100 | LYD425 barley\|10v2\|BI954362_P1 | 575 | 575 | 100.0 | globlastp |
| 2101 | LYD425 barley\|10v2\|BQ470638_P1 | 575 | 575 | 100.0 | globlastp |
| 2102 | LYD425 bean\|gb167\|CA912661_P1 | 575 | 575 | 100.0 | globlastp |
| 2103 | LYD425 brachypodium\|09v1\|GT766635_P1 | 575 | 575 | 100.0 | globlastp |
| 2104 | LYD425 brachypodium\|09v1\|GT789988_P1 | 575 | 575 | 100.0 | globlastp |
| 2105 | LYD425 cacao\|10v1\|CA795914_P1 | 575 | 575 | 100.0 | globlastp |
| 2106 | LYD425 cassava\|09v1\|JGICASSAVA23391VALIDM1_P1 | 575 | 575 | 100.0 | globlastp |
| 2107 | LYD425 cassava\|09v1\|JGICASSAVA37723VALIDM1_P1 | 575 | 575 | 100.0 | globlastp |
| 2108 | LYD425 castorbean\|09v1\|XM002532065 | 575 | 575 | 100.0 | globlastp |
| 2109 | LYD425 castorbean\|11v1\|XM002532065_P1 | 575 | 575 | 100.0 | globlastp |
| 2110 | LYD425 catharanthus\|gb166\|EG557453 | 575 | 575 | 100.0 | globlastp |
| 2111 | LYD425 centaurea\|gb166\|EH737074_P1 | 575 | 575 | 100.0 | globlastp |
| 2112 | LYD425 centaurea\|gb166\|EH751161_P1 | 575 | 575 | 100.0 | globlastp |
| 2113 | LYD425 chestnut\|gb170\|SRR006295S0080529_P1 | 575 | 575 | 100.0 | globlastp |
| 2114 | LYD425 cichorium\|gb171\|EH706683_P1 | 575 | 575 | 100.0 | globlastp |
| 2115 | LYD425 citrus\|gb166\|BQ623073_P1 | 575 | 575 | 100.0 | globlastp |
| 2116 | LYD425 cotton\|10v2\|BE053913_P1 | 575 | 575 | 100.0 | globlastp |
| 2117 | LYD425 cotton\|10v2\|DT456177_P1 | 575 | 575 | 100.0 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 2118 | LYD425 cowpea\|gb166\|FF393852_P1 | 575 | 575 | 100.0 | globlastp |
| 2119 | LYD425 cucumber\|09v1\|AM735805_P1 | 575 | 575 | 100.0 | globlastp |
| 2120 | LYD425 cynara\|gb167\|GE590957_P1 | 575 | 575 | 100.0 | globlastp |
| 2121 | LYD425 cynodon\|10v1\|ES301115_P1 | 575 | 575 | 100.0 | globlastp |
| 2122 | LYD425 dandelion\|10v1\|DY834532_P1 | 575 | 575 | 100.0 | globlastp |
| 2123 | LYD425 dandelion\|10v1\|GO664890_P1 | 575 | 575 | 100.0 | globlastp |
| 2124 | LYD425 eschscholzia\|10v1\|CK750386 | 575 | 575 | 100.0 | globlastp |
| 2125 | LYD425 flax\|09v1\|EH791645 | 575 | 575 | 100.0 | globlastp |
| 2126 | LYD425 foxtail_millet\|10v2\|FXTRMSLX00757488D1 | 575 | 575 | 100.0 | globlastp |
| 2127 | LYD425 foxtail_millet\|11v3\|PHY7SI023709M_P1 | 575 | 575 | 100.0 | globlastp |
| 2128 | LYD425 grape\|gb160\|CB919745 | 575 | 575 | 100.0 | globlastp |
| 2129 | LYD425 ipomoea_nil\|10v1\|BJ559825_P1 | 575 | 575 | 100.0 | globlastp |
| 2130 | LYD425 lettuce\|10v1\|DW072190_P1 | 575 | 575 | 100.0 | globlastp |
| 2131 | LYD425 lettuce\|10v1\|DW105137_P1 | 575 | 575 | 100.0 | globlastp |
| 2132 | LYD425 liquorice\|gb171\|FS241611_P1 | 575 | 575 | 100.0 | globlastp |
| 2133 | LYD425 lotus\|09v1\|CRPLJ019393_P1 | 575 | 575 | 100.0 | globlastp |
| 2134 | LYD425 lotus\|09v1\|LLGO005169_P1 | 575 | 575 | 100.0 | globlastp |
| 2135 | LYD425 medicago\|09v1\|LLAW256385_P1 | 575 | 575 | 100.0 | globlastp |
| 2136 | LYD425 melon\|10v1\|AM735805_P1 | 575 | 575 | 100.0 | globlastp |
| 2137 | LYD425 nasturtium\|10v1\|GH171159 | 575 | 575 | 100.0 | globlastp |
| 2138 | LYD425 nasturtium\|10v1\|SRR032558S0013949 | 575 | 575 | 100.0 | globlastp |
| 2139 | LYD425 oak\|10v1\|CU656518_P1 | 575 | 575 | 100.0 | globlastp |
| 2140 | LYD425 oak\|10v1\|FP030208_P1 | 575 | 575 | 100.0 | globlastp |
| 2141 | LYD425 oak\|10v1\|FP047514_P1 | 575 | 575 | 100.0 | globlastp |
| 2142 | LYD425 oat\|11v1\|GR357135_P1 | 575 | 575 | 100.0 | globlastp |
| 2143 | LYD425 papaya\|gb165\|EX245233_P1 | 575 | 575 | 100.0 | globlastp |
| 2144 | LYD425 peanut\|10v1\|EG030174_P1 | 575 | 575 | 100.0 | globlastp |
| 2145 | LYD425 peanut\|10v1\|ES718673_P1 | 575 | 575 | 100.0 | globlastp |
| 2146 | LYD425 pepper\|gb171\|GD077972_P1 | 575 | 575 | 100.0 | globlastp |
| 2147 | LYD425 pigeonpea\|10v1\|GW351313_P1 | 575 | 575 | 100.0 | globlastp |
| 2148 | LYD425 poplar\|10v1\|BU809810_P1 | 575 | 575 | 100.0 | globlastp |
| 2149 | LYD425 poplar\|10v1\|BU825464_P1 | 575 | 575 | 100.0 | globlastp |
| 2150 | LYD425 prunus\|10v1\|CN489610 | 575 | 575 | 100.0 | globlastp |
| 2151 | LYD425 prunus\|10v1\|PPA013662M | 575 | 575 | 100.0 | globlastp |
| 2152 | LYD425 rice\|gb170\|OS04G56760 | 575 | 575 | 100.0 | globlastp |
| 2153 | LYD425 rice\|gb170\|OS05G30410 | 575 | 575 | 100.0 | globlastp |
| 2154 | LYD425 safflower\|gb162\|EL407728 | 575 | 575 | 100.0 | globlastp |
| 2155 | LYD425 solanum_phureja\|09v1\|SPHBG130030 | 575 | 575 | 100.0 | globlastp |
| 2156 | LYD425 soybean\|11v1\|CD406005 | 575 | 575 | 100.0 | globlastp |
| 2157 | LYD425 soybean\|11v1\|GLYMA18G06890 | 575 | 575 | 100.0 | globlastp |
| 2158 | LYD425 strawberry\|11v1\|DY675348 | 575 | 575 | 100.0 | globlastp |
| 2159 | LYD425 strawberry\|11v1\|EX673811 | 575 | 575 | 100.0 | globlastp |
| 2160 | LYD425 sugarcane\|10v1\|CA138731 | 575 | 575 | 100.0 | globlastp |
| 2161 | LYD425 sunflower\|10v1\|DY928728 | 575 | 575 | 100.0 | globlastp |
| 2162 | LYD425 switchgrass\|gb167\|FE614700 | 575 | 575 | 100.0 | globlastp |
| 2163 | LYD425 switchgrass\|gb167\|FL832182 | 575 | 575 | 100.0 | globlastp |
| 2164 | LYD425 switchgrass\|gb167\|FL898930 | 575 | 575 | 100.0 | globlastp |
| 2165 | LYD425 switchgrass\|gb167\|FL960062 | 575 | 575 | 100.0 | globlastp |
| 2166 | LYD425 tobacco\|gb162\|AM808031 | 575 | 575 | 100.0 | globlastp |
| 2167 | LYD425 tomato\|09v1\|BG130030 | 575 | 575 | 100.0 | globlastp |
| 2168 | LYD425 walnuts\|gb166\|EL901073 | 575 | 575 | 100.0 | globlastp |
| 2169 | LYD425 wheat\|10v2\|BE399716 | 575 | 575 | 100.0 | globlastp |
| 2170 | LYD425 wheat\|10v2\|BF475119 | 575 | 575 | 100.0 | globlastp |
| 2171 | LYD425 zostera\|10v1\|SRR057351S0135099 | 575 | 575 | 100.0 | globlastp |
| 2172 | LYD425 foxtail_millet\|11v3\|PHY7SI031575M_P1 | 575 | 575 | 100.0 | globlastp |
| 2173 | LYD425 oat\|11v1\|CN815967_P1 | 575 | 575 | 100.0 | globlastp |
| 2174 | LYD425 grape\|11v1\|GSVIVT01024719001_T1 | — | 575 | 100.0 | glotblastn |
| 2175 | LYD425 apple\|11v1\|MDP0000181888_P1 | 9495 | 575 | 99.1 | globlastp |
| 2176 | LYD425 eucalyptus\|11v2\|CB967527_P1 | 9495 | 575 | 99.1 | globlastp |
| 2177 | LYD425 eucalyptus\|11v2\|CT980336_P1 | 9495 | 575 | 99.1 | globlastp |
| 2178 | LYD425 euonymus\|11v1\|SRR070038X107757_P1 | 9497 | 575 | 99.1 | globlastp |
| 2179 | LYD425 euonymus\|11v1\|SRR070038X161906_P1 | 9497 | 575 | 99.1 | globlastp |
| 2180 | LYD425 euonymus\|11v1\|SRR070038X218339_P1 | 9497 | 575 | 99.1 | globlastp |
| 2181 | LYD425 flaveria\|11v1\|SRR149232.110271_P1 | 9498 | 575 | 99.1 | globlastp |
| 2182 | LYD425 flax\|11v1\|JG020066_P1 | 9499 | 575 | 99.1 | globlastp |
| 2183 | LYD425 fraxinus\|11v1\|FR637641_P1 | 9500 | 575 | 99.1 | globlastp |
| 2184 | LYD425 pteridium\|11v1\|SRR043594X132315_P1 | 9501 | 575 | 99.1 | globlastp |
| 2185 | LYD425 thellungiella_halophilum\|11v1\|EHJGI11000570_P1 | 9497 | 575 | 99.1 | globlastp |
| 2186 | LYD425 thellungiella_halophilum\|11v1\|EHJGI11007102_P1 | 9497 | 575 | 99.1 | globlastp |
| 2187 | LYD425 thellungiella_halophilum\|11v1\|EHPRD104471_P1 | 9497 | 575 | 99.1 | globlastp |
| 2188 | LYD425 thellungiella_halophilum\|11v1\|EHPRD123829_P1 | 9497 | 575 | 99.1 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 2189 | LYD425 thellungiella_parvulum\|11v1\|EPCRP000296_P1 | 9497 | 575 | 99.1 | globlastp |
| 2190 | LYD425 thellungiella_parvulum\|11v1\|EPCRP015320_P1 | 9497 | 575 | 99.1 | globlastp |
| 2191 | LYD425 thellungiella_parvulum\|11v1\|EPPRD022332_P1 | 9497 | 575 | 99.1 | globlastp |
| 2192 | LYD425 tripterygium\|11v1\|SRR098677X132702_P1 | 9497 | 575 | 99.1 | globlastp |
| 2193 | LYD425 flax\|11v1\|EH791645_P1 | 9499 | 575 | 99.1 | globlastp |
| 2194 | LYD425 arabidopsis_lyrata\|09v1\|JGIAL014057_P1 | 9497 | 575 | 99.1 | globlastp |
| 2195 | LYD425 arabidopsis\|10v1\|AT1G07170_P1 | 9497 | 575 | 99.1 | globlastp |
| 2196 | LYD425 arabidopsis\|10v1\|AT2G30000_P1 | 9497 | 575 | 99.1 | globlastp |
| 2197 | LYD425 bruguiera\|gb166\|BP940013_P1 | 9502 | 575 | 99.1 | globlastp |
| 2198 | LYD425 canola\|11v1\|CD812292_P1 | 9495 | 575 | 99.1 | globlastp |
| 2199 | LYD425 castorbean\|09v1\|XM002525615 | 9503 | 575 | 99.1 | globlastp |
| 2200 | LYD425 castorbean\|11v1\|XM_002525615_P1 | 9503 | 575 | 99.1 | globlastp |
| 2201 | LYD425 cichorium\|gb171\|EH710067_P1 | 9504 | 575 | 99.1 | globlastp |
| 2202 | LYD425 cleome_gynandra\|10v1\|SRR015532S0098165_P1 | 9497 | 575 | 99.1 | globlastp |
| 2203 | LYD425 coffea\|10v1\|DV679024_P1 | 9495 | 575 | 99.1 | globlastp |
| 2204 | LYD425 cynara\|gb167\|GE591125_P1 | 9505 | 575 | 99.1 | globlastp |
| 2205 | LYD425 fern\|gb171\|DK956370_P1 | 9501 | 575 | 99.1 | globlastp |
| 2206 | LYD425 fescue\|gb161\|DT687441_P1 | 9495 | 575 | 99.1 | globlastp |
| 2207 | LYD425 foxtail_millet\|10v2\|FXTSLX00131413 | 9506 | 575 | 99.1 | globlastp |
| 2208 | LYD425 lovegrass\|gb167\|EH194827_P1 | 9507 | 575 | 99.1 | globlastp |
| 2209 | LYD425 maize\|10v1\|AW438239_P1 | 9495 | 575 | 99.1 | globlastp |
| 2210 | LYD425 maize\|10v1\|CD940362_P1 | 9495 | 575 | 99.1 | globlastp |
| 2211 | LYD425 medicago\|09v1\|EV260408_P1 | 9508 | 575 | 99.1 | globlastp |
| 2212 | LYD425 millet\|10v1\|EVO454PM824866_P1 | 9495 | 575 | 99.1 | globlastp |
| 2213 | LYD425 monkeyflower\|10v1\|GR130117_P1 | 9509 | 575 | 99.1 | globlastp |
| 2214 | LYD425 oat\|10v2\|CN815967 | 9495 | 575 | 99.1 | globlastp |
| 2215 | LYD425 rhizophora\|10v1\|SRR005792S0006606 | 9502 | 575 | 99.1 | globlastp |
| 2216 | LYD425 triphysaria\|10v1\|DR172195 | 9510 | 575 | 99.1 | globlastp |
| 2217 | LYD425 triphysaria\|10v1\|EY131246 | 9511 | 575 | 99.1 | globlastp |
| 2218 | LYD425 fraxinus\|11v1\|SRR058827.135537_T1 | 9512 | 575 | 99.1 | glotblastn |
| 2219 | LYD425 canola\|11v1\|EE508869_P1 | 9513 | 575 | 98.2 | globlastp |
| 2220 | LYD425 cephalotaxus\|11v1\|SRR064395X140383_P1 | 9514 | 575 | 98.2 | globlastp |
| 2221 | LYD425 euphorbia\|11v1\|DV139505_P1 | 9515 | 575 | 98.2 | globlastp |
| 2221 | LYD425 spurge\|gb161\|DV139505 | 9515 | 575 | 98.2 | globlastp |
| 2222 | LYD425 euphorbia\|11v1\|SRR098678X354943_P1 | 9515 | 575 | 98.2 | globlastp |
| 2223 | LYD425 utricularia\|11v1\|SRR094438.115684_P1 | 9516 | 575 | 98.2 | globlastp |
| 2224 | LYD425 utricularia\|11v1\|SRR094438.159351_P1 | 9516 | 575 | 98.2 | globlastp |
| 2225 | LYD425 b_oleracea\|gb161\|EH414456_P1 | 9513 | 575 | 98.2 | globlastp |
| 2226 | LYD425 b_rapa\|gb162\|CX268032_P1 | 9513 | 575 | 98.2 | globlastp |
| 2227 | LYD425 banana\|10v1\|DN238578_P1 | 9517 | 575 | 98.2 | globlastp |
| 2228 | LYD425 banana\|10v1\|FF561782_P1 | 9518 | 575 | 98.2 | globlastp |
| 2229 | LYD425 canola\|10v1\|CD822003 | 9513 | 575 | 98.2 | globlastp |
| 2230 | LYD425 canola\|11v1\|EE465300_P1 | 9513 | 575 | 98.2 | globlastp |
| 2231 | LYD425 canola\|10v1\|CD824002 | 9513 | 575 | 98.2 | globlastp |
| 2232 | LYD425 canola\|11v1\|EV061028_P1 | 9513 | 575 | 98.2 | globlastp |
| 2233 | LYD425 canola\|10v1\|DY006552 | 9513 | 575 | 98.2 | globlastp |
| 2234 | LYD425 canola\|11v1\|DY006552_P1 | 9513 | 575 | 98.2 | globlastp |
| 2235 | LYD425 cassava\|09v1\|CK644395_P1 | 9518 | 575 | 98.2 | globlastp |
| 2236 | LYD425 castorbean\|09v1\|EV520777 | 9518 | 575 | 98.2 | globlastp |
| 2237 | LYD425 castorbean\|11v1\|EV520777_P1 | 9518 | 575 | 98.2 | globlastp |
| 2238 | LYD425 ceratodon\|10v1\|SRR074890S0086532_P1 | 9514 | 575 | 98.2 | globlastp |
| 2239 | LYD425 cryptomeria\|gb166\|BY882587_P1 | 9514 | 575 | 98.2 | globlastp |
| 2240 | LYD425 gnetum\|10v1\|SRR064399S0369287_P1 | 9514 | 575 | 98.2 | globlastp |
| 2241 | LYD425 guizotia\|10v1\|GE575364_P1 | 9519 | 575 | 98.2 | globlastp |
| 2242 | LYD425 jatropha\|09v1\|GT229176_P1 | 9518 | 575 | 98.2 | globlastp |
| 2243 | LYD425 marchantia\|gb166\|BJ855887_P1 | 9514 | 575 | 98.2 | globlastp |
| 2244 | LYD425 pine\|10v2\|BQ655295_P1 | 9514 | 575 | 98.2 | globlastp |
| 2245 | LYD425 pine\|10v2\|CF392492_P1 | 9514 | 575 | 98.2 | globlastp |
| 2246 | LYD425 pseudotsuga\|10v1\|SRR065119S0137491 | 9514 | 575 | 98.2 | globlastp |
| 2247 | LYD425 radish\|gb164\|EV545012 | 9513 | 575 | 98.2 | globlastp |
| 2248 | LYD425 radish\|gb164\|EX754296 | 9513 | 575 | 98.2 | globlastp |
| 2249 | LYD425 radish\|gb164\|EY896439 | 9513 | 575 | 98.2 | globlastp |
| 2250 | LYD425 radish\|gb164\|EY919110 | 9513 | 575 | 98.2 | globlastp |
| 2251 | LYD425 rhizophora\|10v1\|SRR005792S0003196 | 9520 | 575 | 98.2 | globlastp |
| 2252 | LYD425 sciadopitys\|10v1\|SRR065035S0018437 | 9514 | 575 | 98.2 | globlastp |
| 2253 | LYD425 sequoia\|10v1\|SRR065044S0084408 | 9514 | 575 | 98.2 | globlastp |
| 2254 | LYD425 spikemoss\|gb165\|DN838775 | 9514 | 575 | 98.2 | globlastp |
| 2255 | LYD425 spikemoss\|gb165\|FE428026 | 9514 | 575 | 98.2 | globlastp |
| 2256 | LYD425 spruce\|gb162\|CO479995 | 9514 | 575 | 98.2 | globlastp |
| 2257 | LYD425 pea\|11v1\|GH720785_P1 | 9521 | 575 | 98.2 | globlastp |
| 2258 | LYD425 senecio\|gb170\|SRR006592S0014193 | 9522 | 575 | 98.2 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 2259 | LYD425 euphorbia\|11v1\|BP955584_P1 | 9523 | 575 | 97.3 | globlastp |
| 2260 | LYD425 phalaenopsis\|11v1\|SRR125771.1050171_P1 | 9524 | 575 | 97.3 | globlastp |
| 2261 | LYD425 phalaenopsis\|11v1\|SRR125771.1146944_P1 | 9524 | 575 | 97.3 | globlastp |
| 2262 | LYD425 phyla\|11v2\|SRR099035X131927_P1 | 9525 | 575 | 97.3 | globlastp |
| 2263 | LYD425 phyla\|11v2\|SRR099037X132761_P1 | 9525 | 575 | 97.3 | globlastp |
| 2264 | LYD425 b_rapa\|gb162\|CX267600_P1 | 9526 | 575 | 97.3 | globlastp |
| 2265 | LYD425 basillicum\|10v1\|DY322265_P1 | 9527 | 575 | 97.3 | globlastp |
| 2266 | LYD425 canola\|10v1\|CD817507 | 9526 | 575 | 97.3 | globlastp |
| 2267 | LYD425 canola\|10v1\|CN727481 | 9526 | 575 | 97.3 | globlastp |
| 2268 | LYD425 liriodendron\|gb166\|CK760175_P1 | 9528 | 575 | 97.3 | globlastp |
| 2269 | LYD425 monkeyflower\|10v1\|GO959242_P1 | 9529 | 575 | 97.3 | globlastp |
| 2270 | LYD425 physcomitrella\|10v1\|BG409072_P1 | 9530 | 575 | 97.3 | globlastp |
| 2271 | LYD425 poplar\|10v1\|BU811180_P1 | 9525 | 575 | 97.3 | globlastp |
| 2272 | LYD425 radish\|gb164\|EX754549 | 9526 | 575 | 97.3 | globlastp |
| 2273 | LYD425 salvia\|10v1\|SRR014553S0001069 | 9525 | 575 | 97.3 | globlastp |
| 2274 | LYD425 canola\|11v1\|CN732177_P1 | 9526 | 575 | 97.3 | globlastp |
| 2275 | LYD425 cedrus\|11v1\|SRR065007X104880_T1 | 9531 | 575 | 97.3 | glotblastn |
| 2276 | LYD425 cotton\|10v2\|SRR032367S0598584_T1 | 9532 | 575 | 97.3 | glotblastn |
| 2277 | LYD425 cycas\|gb166\|DR063171_T1 | 9533 | 575 | 97.3 | glotblastn |
| 2278 | LYD425 pea\|09v1\|GH720785 | — | 575 | 97.3 | glotblastn |
| 2279 | LYD425 maritime_pine\|10v1\|SRR073317S0023919_P1 | 9534 | 575 | 96.4 | globlastp |
| 2280 | LYD425 beet\|gb162\|BI643145_P1 | 9535 | 575 | 96.4 | globlastp |
| 2281 | LYD425 cacao\|10v1\|CGD0028700_P1 | 9536 | 575 | 96.4 | globlastp |
| 2282 | LYD425 radish\|gb164\|EW728224 | 9537 | 575 | 96.4 | globlastp |
| 2283 | LYD425 apple\|11v1\|CN489610_T1 | 9538 | 575 | 96.4 | glotblastn |
| 2284 | LYD425 ceratodon\|10v1\|SRR074890S0013809_T1 | 9539 | 575 | 96.4 | glotblastn |
| 2285 | LYD425 orobanche\|10v1\|SRRO23189S0003053_P1 | 9540 | 575 | 95.5 | globlastp |
| 2286 | LYD425 poplar\|10v1\|BU865642_P1 | 9541 | 575 | 95.5 | globlastp |
| 2287 | LYD425 prunus\|10v1\|PPA020048M | 9542 | 575 | 95.5 | globlastp |
| 2288 | LYD425 zamia\|gb166\|FD766343 | 9543 | 575 | 95.5 | globlastp |
| 2289 | LYD425 euphorbia\|11v1\|SRR098678X593150_T1 | — | 575 | 94.6 | glotblastn |
| 2290 | LYD425 apple\|11v1\|MDP0000218860_P1 | 9544 | 575 | 94.5 | globlastp |
| 2291 | LYD425 heritiera\|10v1\|SRR005795S0000676_P1 | 9545 | 575 | 93.7 | globlastp |
| 2292 | LYD425 platanus\|11v1\|SRR096786X154189_P1 | 9546 | 575 | 93.6 | globlastp |
| 2293 | LYD425 volvox\|gb162\|CBHO620FWD | 9547 | 575 | 92.7 | globlastp |
| 2294 | LYD425 fagopyrum\|11v1\|SRR063703X101645_P1 | 9548 | 575 | 91.8 | globlastp |
| 2295 | LYD425 chlamydomonas\|gb162\|BE227835_P1 | 9549 | 575 | 91.8 | globlastp |
| 2296 | LYD425 potato\|10v1\|AM907607_P1 | 9550 | 575 | 91.8 | globlastp |
| 2297 | LYD425 ambrosia\|11v1\|SRR346943.138808_P1 | 9551 | 575 | 90.0 | globlastp |
| 2298 | LYD425 silene\|11v1\|SRR096785X251497_T1 | 9552 | 575 | 90.0 | glotblastn |
| 2299 | LYD425 b_juncea\|10v2\|E6ANDIZ01C8UZ4_P1 | 9553 | 575 | 90.0 | globlastp |
| 2300 | LYD425 b_juncea\|10v2\|E6ANDIZ01CGDU5_P1 | 9553 | 575 | 90.0 | globlastp |
| 2301 | LYD425 ipomoea_batatas\|10v1\|DC882395_P1 | 9551 | 575 | 90.0 | globlastp |
| 2302 | LYD425 distylium\|11v1\|SRR065077X341600_P1 | 9554 | 575 | 89.1 | globlastp |
| 2303 | LYD425 b_juncea\|10v2\|E6ANDIZ02GDV1X_P1 | 9555 | 575 | 89.1 | globlastp |
| 2304 | LYD425 arabidopsis_lyrata\|09v1\|GFXEU379006X1_T1 | 9556 | 575 | 88.7 | glotblastn |
| 2305 | LYD425 cirsium\|11v1\|SRR349641.408180_T1 | 9557 | 575 | 88.2 | glotblastn |
| 2306 | LYD425 b_rapa\|gb162\|EE523503_P1 | 9558 | 575 | 87.3 | globlastp |
| 2307 | LYD425 canola\|11v1\|EL629739_T1 | 9559 | 575 | 87.3 | glotblastn |
| 2308 | LYD425 millet\|10v1\|EVO454PM088849_P1 | 9560 | 575 | 86.5 | globlastp |
| 2309 | LYD425 strawberry\|11v1\|SRR034902S0020015 | 9561 | 575 | 86.1 | globlastp |
| 2310 | LYD425 pteridium\|11v1\|SRR043594X168741_P1 | 9562 | 575 | 85.5 | globlastp |
| 2311 | LYD425 plantago\|11v1\|SRR066373X28590_P1 | 9563 | 575 | 85.1 | globlastp |
| 2312 | LYD425 podocarpus\|10v1\|SRR065014S0161209_P1 | 9564 | 575 | 84.5 | globlastp |
| 2313 | LYD425 amborella\|gb166\|CK758391_T1 | 9565 | 575 | 83.8 | glotblastn |
| 2314 | LYD425 ostreococcus\|gb162\|XM001415542_P1 | 9566 | 575 | 83.0 | globlastp |
| 2315 | LYD425 tobacco\|gb162\|BP133671 | 9567 | 575 | 82.3 | glotblastn |
| 2316 | LYD425 artemisia\|10v1\|SRR019254S0002036_P1 | 9568 | 575 | 81.8 | globlastp |
| 2317 | LYD425 hevea\|10v1\|EC601944_P1 | 9569 | 575 | 80.9 | globlastp |
| 2318 | LYD425 poplar\|10v1\|DB893816_P1 | 9570 | 575 | 80.9 | globlastp |
| 2319 | LYD425 flaveria\|11v1\|SRR149238.345175_P1 | 9571 | 575 | 80.0 | globlastp |
| 2320 | LYD425 kiwi\|gb166\|FG426337_T1 | 9572 | 575 | 80.0 | glotblastn |
| 2321 | LYD427 maize\|10v1\|AA979755_P1 | 9573 | 576 | 92.1 | globlastp |
| 2322 | LYD427 foxtail_millet\|11v3\|PHY7SI000345M_P1 | 9574 | 576 | 88.9 | globlastp |
| 2323 | LYD427 maize\|10v1\|CD219227_P1 | 9575 | 576 | 87.6 | globlastp |
| 2324 | LYD427 rice\|gb170\|OS01G36860 | 9576 | 576 | 80.9 | glotblastn |
| 2325 | LYD428 switchgrass\|gb167\|DN141377 | 9577 | 577 | 85.7 | globlastp |
| 2326 | LYD428 foxtail_millet\|10v2\|FXTRMSLX00010744D1 | 9578 | 577 | 84.1 | globlastp |
| 2327 | LYD428 foxtail_millet\|11v3\|PHY7SI017948M_P1 | 9578 | 577 | 84.1 | globlastp |
| 2328 | LYD428 sugarcane\|10v1\|CA082579 | 9579 | 577 | 83.8 | globlastp |
| 2329 | LYD432 maize\|10v1\|AI622413_P1 | 9580 | 579 | 95.2 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 2330 | LYD432 switchgrass\|gb167\|FL706172 | 9581 | 579 | 92.1 | globlastp |
| 2331 | LYD432 sugarcane\|10v1\|CA074303 | 9582 | 579 | 85.9 | globlastn |
| 2332 | LYD432 brachypodium\|09v1\|DV469137_P1 | 9583 | 579 | 85.5 | globlastp |
| 2333 | LYD432 rice\|gb170\|OS04G42470 | 9584 | 579 | 85.2 | globlastp |
| 2334 | LYD432 foxtail_millet\|11v3\|PHY7SI009830M_P1 | 9585 | 579 | 84.7 | globlastp |
| 2335 | LYD432 wheat\|10v2\|BE401425 | 9586 | 579 | 83.3 | globlastp |
| 2336 | LYD432 barley\|10v2\|BE413260_P1 | 9587 | 579 | 82.8 | globlastp |
| 2337 | LYD433 sugarcane\|10v1\|BQ530273 | 9588 | 580 | 96.4 | globlastp |
| 2338 | LYD433 maize\|10v1\|AW061803_P1 | 9589 | 580 | 89.8 | globlastp |
| 2339 | LYD433 switchgrass\|gb167\|FE646998 | 9590 | 580 | 89.8 | globlastp |
| 2340 | LYD433 maize\|10v1\|AI901310_P1 | 9591 | 580 | 89.3 | globlastp |
| 2341 | LYD433 foxtail_millet\|11v3\|PHY7SI014487M_P1 | 9592 | 580 | 89.3 | globlastp |
| 2342 | LYD433 switchgrass\|gb167\|DN145547 | 9593 | 580 | 88.0 | globlastp |
| 2343 | LYD433 millet\|10v1\|EVO454PM010263_P1 | 9594 | 580 | 87.8 | globlastp |
| 2344 | LYD433 foxtail_millet\|10v2\|SICRP025306 | 9595 | 580 | 87.3 | globlastp |
| 2345 | LYD435 maize\|10v1\|DW832428_P1 | 9596 | 582 | 85.9 | globlastp |
| 2346 | LYD435 foxtail_millet\|11v3\|PHY7SI014425M_P1 | 9597 | 582 | 80.8 | globlastp |
| 2347 | LYD436 sugarcane\|10v1\|BQ530893 | 9598 | 583 | 91.2 | globlastp |
| 2348 | LYD437 soybean\|11v1\|BE660894 | 9599 | 584 | 93.1 | globlastp |
| 2349 | LYD437 pigeonpea\|10v1\|SRR054580S0019273_T1 | 9600 | 584 | 85.3 | glotblastn |
| 2350 | LYD438 soybean\|11v1\|GLYMA13G41110 | 9601 | 585 | 90.2 | globlastp |
| 2351 | LYD438 soybean\|11v1\|GLYMA15G04300 | 9602 | 585 | 88.1 | globlastp |
| 2352 | LYD438 pigeonpea\|10v1\|GR471598_P1 | 9603 | 585 | 85.3 | globlastp |
| 2353 | LYD438 pea\|09v1\|Z73553 | 9604 | 585 | 80.1 | globlastp |
| 2354 | LYD438 pea\|11v1\|Z73553_P1 | 9604 | 585 | 80.1 | globlastp |
| 2355 | LYD439 soybean\|11v1\|GLYMA10G06800 | 9605 | 586 | 81.6 | globlastp |
| 2356 | LYD439 soybean\|11v1\|GLYMA13G20980 | 9606 | 586 | 81.4 | globlastp |
| 2357 | LYD440 pigeonpea\|10v1\|SRR054580S0028717_P1 | 9607 | 587 | 85.8 | globlastp |
| 2357 | LYD398 pigeonpea\|10v1\|SRR054580S0028717_T1 | 9607 | 742 | 80.6 | glotblastn |
| 2358 | LYD440 pigeonpea\|10v1\|SRR054580S0060137_P1 | 9608 | 587 | 81.8 | globlastp |
| 2358 | LYD398 pigeonpea\|10v1\|SRR054580S0060137_T1 | 9608 | 742 | 81.4 | glotblastn |
| 2359 | LYD440 bean\|gb167\|CA910622_P1 | 9609 | 587 | 81.3 | globlastp |
| 2359 | LYD398 bean\|gb167\|CA910622_P1 | 9609 | 742 | 80.0 | globlastp |
| 2360 | LYD442 soybean\|11v1\|GLYMA06G15380 | 9610 | 589 | 92.7 | globlastp |
| 2361 | LYD442 bean\|gb167\|CV537092_P1 | 9611 | 589 | 91.4 | globlastp |
| 2362 | LYD442 cowpea\|gb166\|FG808168_P1 | 9612 | 589 | 89.6 | globlastp |
| 2363 | LYD442 medicago\|09v1\|AL370263_P1 | 9613 | 589 | 89.4 | globlastp |
| 2364 | LYD442 peanut\|10v1\|ES719926_P1 | 9614 | 589 | 89.2 | globlastp |
| 2365 | LYD442 trigonella\|11v1\|SRR066194X140506_P1 | 9615 | 589 | 88.4 | globlastp |
| 2366 | LYD442 lotus\|09v1\|LLBW618756_P1 | 9616 | 589 | 87.7 | globlastp |
| 2367 | LYD442 trigonella\|11v1\|SRR066194X106162_P1 | 9617 | 589 | 86.6 | globlastp |
| 2368 | LYD442 clover\|gb162\|AB236802_P1 | 9618 | 589 | 85.6 | globlastp |
| 2369 | LYD442 cassava\|09v1\|DV441647_P1 | 9619 | 589 | 82.1 | globlastp |
| 2370 | LYD442 clementine\|11v1\|CO913065_P1 | 9620 | 589 | 81.0 | globlastp |
| 2371 | LYD442 orange\|11v1\|CO913065_P1 | 9620 | 589 | 81.0 | globlastp |
| 2372 | LYD442 citrus\|gb166\|CO913065_P1 | 9620 | 589 | 81.0 | globlastp |
| 2373 | LYD442 cucumber\|09v1\|DR974824_P1 | 9621 | 589 | 80.7 | globlastp |
| 2374 | LYD442 melon\|10v1\|DR974824_T1 | 9622 | 589 | 80.3 | glotblastn |
| 2375 | LYD442 watermelon\|11v1\|AM718097_P1 | 9623 | 589 | 80.1 | globlastp |
| 2376 | LYD445 soybean\|11v1\|GLYMA04G03420 | 9624 | 591 | 91.7 | globlastp |
| 2377 | LYD445 cowpea\|gb166\|FF543662_T1 | 9625 | 591 | 84.8 | glotblastn |
| 2378 | LYD445 bean\|gb167\|CA899425_P1 | 9626 | 591 | 83.0 | globlastp |
| 2379 | LYD445 pigeonpea\|10v1\|SRR054580S0144195_T1 | 9627 | 591 | 82.6 | glotblastn |
| 2380 | LYD446 cowpea\|gb166\|FF383047_P1 | 9628 | 592 | 91.8 | globlastp |
| 2380 | LYD519 cowpea\|gb166\|FF383047_P1 | 9628 | 654 | 80.2 | globlastp |
| 2381 | LYD446 peanut\|10v1\|SRR042413S0021557_P1 | 9629 | 592 | 85.1 | globlastp |
| 2381 | LYD519 peanut\|10v1\|SRRP0142413S0021557_P1 | 9629 | 654 | 80.2 | globlastp |
| 2382 | LYD447 soybean\|11v1\|GLYMA07G07100 | 9630 | 593 | 86.3 | glotblastn |
| 2383 | LYD450 lotus\|09v1\|AW720055_T1 | 9631 | 596 | 80.6 | glotblastn |
| 2384 | LYD451 soybean\|11v1\|GLYMA16G34190 | 9632 | 597 | 97.1 | globlastp |
| 2385 | LYD451 cowpea\|gb166\|FC460201_T1 | 9633 | 597 | 95.8 | glotblastn |
| 2386 | LYD451 medicago\|09v1\|ALF_P1 | 9634 | 597 | 83.8 | globlastp |
| 2387 | LYD451 prunus\|10v1\|CB822934 | 9635 | 597 | 82.6 | globlastp |
| 2388 | LYD451 apple\|11v1\|CO723687_P1 | 9636 | 597 | 81.5 | globlastp |
| 2389 | LYD451 peanut\|10v1\|CD038199_P1 | 9637 | 597 | 81.5 | globlastp |
| 2390 | LYD451 euonymus\|11v1\|SRR070038X249909_P1 | 9638 | 597 | 80.7 | globlastp |
| 2391 | LYD451 strawberry\|11v1\|EX658118 | 9639 | 597 | 80.4 | globlastp |
| 2392 | LYD454 amsonia\|11v1\|SRR098688X12244_P1 | 600 | 600 | 100.0 | globlastp |
| 2393 | LYD454 amsonia\|11v1\|SRR098688X270988_P1 | 600 | 600 | 100.0 | globlastp |
| 2394 | LYD454 cannabis\|12v1\|GR220629_P1 | 600 | 600 | 100.0 | globlastp |
| 2395 | LYD454 catharanthus\|11v1\|EG556445_P1 | 600 | 600 | 100.0 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 2396 | LYD454 catharanthus\|11v1\|EG559538_P1 | 600 | 600 | 100.0 | globlastp |
| 2397 | LYD454 clementine\|11v1\|CF417630_P1 | 600 | 600 | 100.0 | globlastp |
| 2398 | LYD454 cucurbita\|11v1\|SRR091276X101208_P1 | 600 | 600 | 100.0 | globlastp |
| 2399 | LYD454 cucurbita\|11v1\|SRR091276X101980_P1 | 600 | 600 | 100.0 | globlastp |
| 2400 | LYD454 cucurbita\|11v1\|SRR091276X112794_P1 | 600 | 600 | 100.0 | globlastp |
| 2401 | LYD454 eucalyptus\|11v2\|CT981964_P1 | 600 | 600 | 100.0 | globlastp |
| 2402 | LYD454 eucalyptus\|11v2\|CU404457_P1 | 600 | 600 | 100.0 | globlastp |
| 2403 | LYD454 euonymus\|11v1\|SRR070038X100586_P1 | 600 | 600 | 100.0 | globlastp |
| 2404 | LYD454 euonymus\|11v1\|SRR070038X101487_P1 | 600 | 600 | 100.0 | globlastp |
| 2405 | LYD454 euonymus\|11v1\|SRR070038X107087_P1 | 600 | 600 | 100.0 | globlastp |
| 2406 | LYD454 euonymus\|11v1\|SRR070038X115249_P1 | 600 | 600 | 100.0 | globlastp |
| 2407 | LYD454 euonymus\|11v1\|SRR070038X120420_P1 | 600 | 600 | 100.0 | globlastp |
| 2408 | LYD454 euphorbia\|11v1\|DV113425_P1 | 600 | 600 | 100.0 | globlastp |
| 2409 | LYD454 euphorbia\|11v1\|SRR098678X184654_P1 | 600 | 600 | 100.0 | globlastp |
| 2410 | LYD454 fagopyrum\|11v1\|SRR063689X101567_P1 | 600 | 600 | 100.0 | globlastp |
| 2411 | LYD454 fagopyrum\|11v1\|SRR063689X107072_P1 | 600 | 600 | 100.0 | globlastp |
| 2412 | LYD454 fagopyrum\|11v1\|SRR063689X108016_P1 | 600 | 600 | 100.0 | globlastp |
| 2413 | LYD454 fagopyrum\|11v1\|SRR063689X108966_P1 | 600 | 600 | 100.0 | globlastp |
| 2414 | LYD454 fagopyrum\|11v1\|SRR063703X101374_P1 | 600 | 600 | 100.0 | globlastp |
| 2415 | LYD454 fagopyrum\|11v1\|SRR063703X104747_P1 | 600 | 600 | 100.0 | globlastp |
| 2416 | LYD454 fagopyrum\|11v1\|SRR063703X118877_P1 | 600 | 600 | 100.0 | globlastp |
| 2417 | LYD454 fagopyrum\|11v1\|SRR063703X118890_P1 | 600 | 600 | 100.0 | globlastp |
| 2418 | LYD454 fraxinus\|11v1\|SRR058827.106502_P1 | 600 | 600 | 100.0 | globlastp |
| 2419 | LYD454 fraxinus\|11v1\|SRR058827.172228XX1_P1 | 600 | 600 | 100.0 | globlastp |
| 2420 | LYD454 fraxinus\|11v1\|SRR058827.172228XX2_P1 | 600 | 600 | 100.0 | globlastp |
| 2421 | LYD454 humulus\|11v1\|GD246231_P1 | 600 | 600 | 100.0 | globlastp |
| 2422 | LYD454 humulus\|11v1\|GD249134_P1 | 600 | 600 | 100.0 | globlastp |
| 2423 | LYD454 humulus\|11v1\|SRR098683X114579_P1 | 600 | 600 | 100.0 | globlastp |
| 2424 | LYD454 humulus\|11v1\|SRR098683X129685_P1 | 600 | 600 | 100.0 | globlastp |
| 2425 | LYD454 humulus\|11v1\|SRR098683X18710_P1 | 600 | 600 | 100.0 | globlastp |
| 2426 | LYD454 humulus\|11v1\|SRR098683X44247_P1 | 600 | 600 | 100.0 | globlastp |
| 2427 | LYD454 humulus\|11v1\|SRR098684X114260_P1 | 600 | 600 | 100.0 | globlastp |
| 2428 | LYD454 humulus\|11v1\|SRR098687X104860_P1 | 600 | 600 | 100.0 | globlastp |
| 2429 | LYD454 orange\|11v1\|CF417630_P1 | 600 | 600 | 100.0 | globlastp |
| 2430 | LYD454 phyla\|11v2\|SRR099035X102134_P1 | 600 | 600 | 100.0 | globlastp |
| 2431 | LYD454 plantago\|11v1\|SRR066373X102417_P1 | 600 | 600 | 100.0 | globlastp |
| 2432 | LYD454 plantago\|11v1\|SRR066373X115592_P1 | 600 | 600 | 100.0 | globlastp |
| 2433 | LYD454 platanus\|11v1\|SRR096786X114130_P1 | 600 | 600 | 100.0 | globlastp |
| 2434 | LYD454 platanus\|11v1\|SRR096786X142170_P1 | 600 | 600 | 100.0 | globlastp |
| 2435 | LYD454 platanus\|11v1\|SRR096786X36069_P1 | 600 | 600 | 100.0 | globlastp |
| 2436 | LYD454 pteridium\|11v1\|SRR043594X61139_P1 | 600 | 600 | 100.0 | globlastp |
| 2437 | LYD454 sarracenia\|11v1\|SRR192669.110655_P1 | 600 | 600 | 100.0 | globlastp |
| 2438 | LYD454 sarracenia\|11v1\|SRR192669.112302_P1 | 600 | 600 | 100.0 | globlastp |
| 2439 | LYD454 sarracenia\|11v1\|SRR192669.116502_P1 | 600 | 600 | 100.0 | globlastp |
| 2440 | LYD454 scabiosa\|11v1\|SRR063723X100090_P1 | 600 | 600 | 100.0 | globlastp |
| 2441 | LYD454 scabiosa\|11v1\|SRR063723X282056_P1 | 600 | 600 | 100.0 | globlastp |
| 2442 | LYD454 sorghum\|11v1\|SB04G036360_P1 | 600 | 600 | 100.0 | globlastp |
| 2443 | LYD454 thalictrum\|11v1\|SRR096787X100485_P1 | 600 | 600 | 100.0 | globlastp |
| 2444 | LYD454 thalictrum\|11v1\|SRR096787X102620_P1 | 600 | 600 | 100.0 | globlastp |
| 2445 | LYD454 thalictrum\|11v1\|SRR096787X141553_P1 | 600 | 600 | 100.0 | globlastp |
| 2446 | LYD454 tomato\|11v1\|BG125727_P1 | 600 | 600 | 100.0 | globlastp |
| 2447 | LYD454 tomato\|11v1\|BG127553_P1 | 600 | 600 | 100.0 | globlastp |
| 2448 | LYD454 tripterygium\|11v1\|SRR098677X111138_P1 | 600 | 600 | 100.0 | globlastp |
| 2449 | LYD454 tripterygium\|11v1\|SRR098677X12834_P1 | 600 | 600 | 100.0 | globlastp |
| 2450 | LYD454 tripterygium\|11v1\|SRR098677X139077_P1 | 600 | 600 | 100.0 | globlastp |
| 2451 | LYD454 utricularia\|11v1\|SRR094438.1034_P1 | 600 | 600 | 100.0 | globlastp |
| 2452 | LYD454 valeriana\|11v1\|SRR099039X16229_P1 | 600 | 600 | 100.0 | globlastp |
| 2453 | LYD454 valeriana\|11v1\|SRR099039X213611_P1 | 600 | 600 | 100.0 | globlastp |
| 2454 | LYD454 valeriana\|11v1\|SRR099039X21641_P1 | 600 | 600 | 100.0 | globlastp |
| 2455 | LYD454 vinca\|11v1\|SRR098690X116182_P1 | 600 | 600 | 100.0 | globlastp |
| 2456 | LYD454 vinca\|11v1\|SRR098690X126932_P1 | 600 | 600 | 100.0 | globlastp |
| 2457 | LYD454 vinca\|11v1\|SRR098690X17455_P1 | 600 | 600 | 100.0 | globlastp |
| 2458 | LYD454 amaranthus\|10v1\|SRR039411S0005040_P1 | 600 | 600 | 100.0 | globlastp |
| 2459 | LYD454 aristolochia\|10v1\|SRR039082S0002270_P1 | 600 | 600 | 100.0 | globlastp |
| 2460 | LYD454 bean\|gb167\|CA897327_P1 | 600 | 600 | 100.0 | globlastp |
| 2461 | LYD454 bean\|gb167\|CA897339_P1 | 600 | 600 | 100.0 | globlastp |
| 2462 | LYD454 beech\|gb170\|SRR006294S0004097_P1 | 600 | 600 | 100.0 | globlastp |
| 2463 | LYD454 cacao\|10v1\|CU482595_P1 | 600 | 600 | 100.0 | globlastp |
| 2464 | LYD454 castorbean\|09v1\|XM002514131 | 600 | 600 | 100.0 | globlastp |
| 2465 | LYD454 castorbean\|11v1\|XM_002514131_P1 | 600 | 600 | 100.0 | globlastp |
| 2466 | LYD454 castorbean\|09v1\|XM002515849 | 600 | 600 | 100.0 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 2467 | LYD454 castorbean|11v1|XM_002515849_P1 | 600 | 600 | 100.0 | globlastp |
| 2468 | LYD454 catharanthus|gb166|EG556445 | 600 | 600 | 100.0 | globlastp |
| 2469 | LYD454 catharanthus|gb166|EG559538 | 600 | 600 | 100.0 | globlastp |
| 2470 | LYD454 chestnut|gb170|SRR006295S0000137_P1 | 600 | 600 | 100.0 | globlastp |
| 2471 | LYD454 chestnut|gb170|SRR006295S0000483_P1 | 600 | 600 | 100.0 | globlastp |
| 2472 | LYD454 chickpea|09v2|GR392983_P1 | 600 | 600 | 100.0 | globlastp |
| 2473 | LYD454 chickpea|09v2|GR397603_P1 | 600 | 600 | 100.0 | globlastp |
| 2474 | LYD454 citrus|gb166|CF417630_P1 | 600 | 600 | 100.0 | globlastp |
| 2475 | LYD454 cleome_gynandra|10v1|SRR015532S0005421_P1 | 600 | 600 | 100.0 | globlastp |
| 2476 | LYD454 cleome_gynandra|10v1|SRR015532S0058847_P1 | 600 | 600 | 100.0 | globlastp |
| 2477 | LYD454 cleome_gynandra|10v1|SRR015532S0108969_P1 | 600 | 600 | 100.0 | globlastp |
| 2478 | LYD454 cleome_spinosa|10v1|GR931858_P1 | 600 | 600 | 100.0 | globlastp |
| 2479 | LYD454 cleome_spinosa|10v1|SRR015531S0018215_P1 | 600 | 600 | 100.0 | globlastp |
| 2480 | LYD454 cleome_spinosa|10v1|SRR015531S0018672_P1 | 600 | 600 | 100.0 | globlastp |
| 2481 | LYD454 coffea|10v1|DV664965_P1 | 600 | 600 | 100.0 | globlastp |
| 2482 | LYD454 cowpea|gb166|ES884175_P1 | 600 | 600 | 100.0 | globlastp |
| 2483 | LYD454 cowpea|gb166|FC460241_P1 | 600 | 600 | 100.0 | globlastp |
| 2484 | LYD454 cucumber|09v1|AM715327_P1 | 600 | 600 | 100.0 | globlastp |
| 2485 | LYD454 cucumber|09v1|CK086097_P1 | 600 | 600 | 100.0 | globlastp |
| 2486 | LYD454 cyamopsis|10v1|EG974840_P1 | 600 | 600 | 100.0 | globlastp |
| 2487 | LYD454 cynodon|10v1|ES292646_T1 | 9640 | 600 | 100.0 | glotblastn |
| 2488 | LYD454 eggplant|10v1|FS001318_P1 | 600 | 600 | 100.0 | globlastp |
| 2489 | LYD454 eggplant|10v1|FS003293_P1 | 600 | 600 | 100.0 | globlastp |
| 2490 | LYD454 eschscholzia|10v1|SRR014116S0004486 | 600 | 600 | 100.0 | globlastp |
| 2491 | LYD454 eucalyptus|11v2|CT983213_P1 | 600 | 600 | 100.0 | globlastp |
| 2492 | LYD454 eucalyptus|gb166|CT983213 | 600 | 600 | 100.0 | globlastp |
| 2493 | LYD454 foxtail_millet|10v2|OXFXTRMSLX00188138D1T1 | 600 | 600 | 100.0 | globlastp |
| 2494 | LYD454 foxtail_millet|10v2|OXFXTRMSLX00541902D1T1 | 600 | 600 | 100.0 | globlastp |
| 2495 | LYD454 foxtail_millet|11v3|PHY7SI019362M_P1 | 600 | 600 | 100.0 | globlastp |
| 2496 | LYD454 ginger|gb164|DY361101_T1 | 9641 | 600 | 100.0 | glotblastn |
| 2497 | LYD454 ginger|gb164|DY363934_T1 | 9642 | 600 | 100.0 | glotblastn |
| 2498 | LYD454 ginseng|10v1|DV555276_P1 | 600 | 600 | 100.0 | globlastp |
| 2499 | LYD454 ginseng|10v1|ES672876_P1 | 600 | 600 | 100.0 | globlastp |
| 2500 | LYD454 grape|11v1|CB003420_P1 | 600 | 600 | 100.0 | globlastp |
| 2501 | LYD454 grape|gb160|CB003420 | 600 | 600 | 100.0 | globlastp |
| 2502 | LYD454 grape|11v1|GSVIVT01016902001_P1 | 600 | 600 | 100.0 | globlastp |
| 2503 | LYD454 grape|gb160|CB006467 | 9643 | 600 | 100.0 | glotblastn |
| 2504 | LYD454 ipomoea_batatas|10v1|CB330103_P1 | 600 | 600 | 100.0 | globlastp |
| 2505 | LYD454 ipomoea_batatas|10v1|CB330148_P1 | 600 | 600 | 100.0 | globlastp |
| 2506 | LYD454 ipomoea_nil|10v1|CJ748162_P1 | 600 | 600 | 100.0 | globlastp |
| 2507 | LYD454 jatropha|09v1|GT228650_P1 | 600 | 600 | 100.0 | globlastp |
| 2508 | LYD454 liquorice|gb171|FS239086_P1 | 600 | 600 | 100.0 | globlastp |
| 2509 | LYD454 liquorice|gb171|FS246568_P1 | 600 | 600 | 100.0 | globlastp |
| 2510 | LYD454 liriodendron|gb166|CK764053_P1 | 600 | 600 | 100.0 | globlastp |
| 2511 | LYD454 liriodendron|gb166|FD490791_P1 | 600 | 600 | 100.0 | globlastp |
| 2512 | LYD454 lotus|09v1|BG662483_P1 | 600 | 600 | 100.0 | globlastp |
| 2513 | LYD454 lotus|09v1|LLBW611845_P1 | 600 | 600 | 100.0 | globlastp |
| 2514 | LYD454 maize|10v1|AI395997_P1 | 600 | 600 | 100.0 | globlastp |
| 2515 | LYD454 maize|10v1|AW119946_P1 | 600 | 600 | 100.0 | globlastp |
| 2516 | LYD454 melon|10v1|AM715327_P1 | 600 | 600 | 100.0 | globlastp |
| 2517 | LYD454 melon|10v1|DV632974_P1 | 600 | 600 | 100.0 | globlastp |
| 2518 | LYD454 millet|10v1|CD726330_T1 | 9644 | 600 | 100.0 | glotblastn |
| 2519 | LYD454 momordica|10v1|SRR071315S0001369_P1 | 600 | 600 | 100.0 | globlastp |
| 2520 | LYD454 monkeyflower|10v1|CV519494_P1 | 600 | 600 | 100.0 | globlastp |
| 2521 | LYD454 monkeyflower|10v1|DV209402_P1 | 600 | 600 | 100.0 | globlastp |
| 2522 | LYD454 nicotiana_benthamiana|gb162|EH365061_T1 | 9645 | 600 | 100.0 | glotblastn |
| 2523 | LYD454 oak|10v1|CU656826_P1 | 600 | 600 | 100.0 | globlastp |
| 2524 | LYD454 oak|10v1|DN950635_P1 | 600 | 600 | 100.0 | globlastp |
| 2525 | LYD454 orobanche|10v1|SRR023189S0043706_P1 | 600 | 600 | 100.0 | globlastp |
| 2526 | LYD454 orobanche|10v1|SRR023495S0065779_P1 | 600 | 600 | 100.0 | globlastp |
| 2527 | LYD454 papaya|gb165|EX265362_P1 | 600 | 600 | 100.0 | globlastp |
| 2528 | LYD454 peanut|10v1|CD037648_P1 | 600 | 600 | 100.0 | globlastp |
| 2529 | LYD454 peanut|10v1|CD038347_P1 | 600 | 600 | 100.0 | globlastp |
| 2530 | LYD454 pepper|gb171|BM064227_P1 | 600 | 600 | 100.0 | globlastp |
| 2531 | LYD454 pigeonpea|10v1|GR468726_P1 | 600 | 600 | 100.0 | globlastp |
| 2532 | LYD454 pigeonpea|10v1|GW353331_P1 | 600 | 600 | 100.0 | globlastp |
| 2533 | LYD454 poplar|10v1|BI128513_P1 | 600 | 600 | 100.0 | globlastp |
| 2534 | LYD454 poplar|10v1|BI129531_P1 | 600 | 600 | 100.0 | globlastp |
| 2535 | LYD454 poplar|10v1|BU815653_P1 | 600 | 600 | 100.0 | globlastp |
| 2536 | LYD454 poppy|gb166|FE965539_P1 | 600 | 600 | 100.0 | globlastp |
| 2537 | LYD454 potato|10v1|BG593145_T1 | 9646 | 600 | 100.0 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name  cluster name | Polyp. SEQ ID NO: | Hom to SEQ ID NO: | % glob. iden. | Algor. |
|---|---|---|---|---|---|
| 2538 | LYD454 potato\|10v1\|BQ515532_P1 | 600 | 600 | 100.0 | globlastp |
| 2539 | LYD454 prunus\|10v1\|AJ533719 | 600 | 600 | 100.0 | globlastp |
| 2540 | LYD454 prunus\|10v1\|CB821207 | 600 | 600 | 100.0 | globlastp |
| 2541 | LYD454 rice\|gb170\|OS02G56014 | 600 | 600 | 100.0 | globlastp |
| 2542 | LYD454 rice\|gb170\|OS06G07580 | 600 | 600 | 100.0 | globlastp |
| 2543 | LYD454 rose\|10v1\|BI977665 | 600 | 600 | 100.0 | globlastp |
| 2544 | LYD454 rose\|10v1\|EC588358 | 600 | 600 | 100.0 | globlastp |
| 2545 | LYD454 salvia\|10v1\|CV168286 | 600 | 600 | 100.0 | globlastp |
| 2546 | LYD454 sesame\|10v1\|BU670320 | 600 | 600 | 100.0 | globlastp |
| 2547 | LYD454 solanum_phureja\|09v1\|SPHBG125727 | 600 | 600 | 100.0 | globlastp |
| 2548 | LYD454 solanum_phureja\|09v1\|SPHBG127553 | 600 | 600 | 100.0 | globlastp |
| 2549 | LYD454 sorghum\|09v1\|SB04G036360 | 600 | 600 | 100.0 | globlastp |
| 2550 | LYD454 sorghum\|09v1\|SB10G004940 | 600 | 600 | 100.0 | globlastp |
| 2551 | LYD454 sorghum\|11v1\|SB10G004940_P1 | 600 | 600 | 100.0 | globlastp |
| 2552 | LYD454 spurge\|gb161\|DV113425 | 600 | 600 | 100.0 | globlastp |
| 2553 | LYD454 strawberry\|11v1\|CO381759 | 600 | 600 | 100.0 | globlastp |
| 2554 | LYD454 strawberry\|11v1\|CO381795 | 600 | 600 | 100.0 | globlastp |
| 2555 | LYD454 sugarcane\|10v1\|CA118705 | 600 | 600 | 100.0 | globlastp |
| 2556 | LYD454 tea\|10v1\|CV014310 | 600 | 600 | 100.0 | globlastp |
| 2557 | LYD454 tobacco\|gb162\|BP192531 | 9647 | 600 | 100.0 | glotblastn |
| 2558 | LYD454 tobacco\|gb162\|CV017550 | 9648 | 600 | 100.0 | glotblastn |
| 2559 | LYD454 tomato\|09v1\|BG125727 | 600 | 600 | 100.0 | globlastp |
| 2560 | LYD454 tomato\|09v1\|BG127553 | 600 | 600 | 100.0 | globlastp |
| 2561 | LYD454 walnuts\|gb166\|EL901674 | 600 | 600 | 100.0 | globlastp |
| 2562 | LYD454 wheat\|10v2\|BE401696 | 600 | 600 | 100.0 | globlastp |
| 2563 | LYD454 wheat\|10v2\|CA626902 | 600 | 600 | 100.0 | globlastp |
| 2564 | LYD454 humulus\|11v1\|SRR098683X22545_T1 | — | 600 | 100.0 | glotblastn |
| 2565 | LYD454 petunia\|gb171\|DY395525_T1 | — | 600 | 100.0 | glotblastn |
| 2566 | LYD454 amorphophallus\|11v2\|SRR089351X100022_P1 | 9649 | 600 | 98.4 | globlastp |
| 2567 | LYD454 amorphophallus\|11v2\|SRR089351X100594_P1 | 9649 | 600 | 98.4 | globlastp |
| 2568 | LYD454 apple\|11v1\|CN882330_P1 | 9650 | 600 | 98.4 | globlastp |
| 2569 | LYD454 chelidonium\|11v1\|SRR084752X10217_P1 | 9651 | 600 | 98.4 | globlastp |
| 2570 | LYD454 chelidonium\|11v1\|SRR084752X155146_P1 | 9651 | 600 | 98.4 | globlastp |
| 2571 | LYD454 euphorbia\|11v1\|DV132150_P1 | 9652 | 600 | 98.4 | globlastp |
| 2572 | LYD454 foxtail_millet\|11v3\|PHY7SI007769M_P1 | 9649 | 600 | 98.4 | globlastp |
| 2573 | LYD454 humulus\|11v1\|EX519236_P1 | 9653 | 600 | 98.4 | globlastp |
| 2574 | LYD454 phalaenopsis\|11v1\|SRR125771.1233743_P1 | 9649 | 600 | 98.4 | globlastp |
| 2575 | LYD454 phalaenopsis\|11v1\|SRR138262.105880_P1 | 9649 | 600 | 98.4 | globlastp |
| 2576 | LYD454 phalaenopsis\|11v1\|SRR138262.24922_P1 | 9649 | 600 | 98.4 | globlastp |
| 2577 | LYD454 pteridium\|11v1\|SRR043594X358491_P1 | 9649 | 600 | 98.4 | globlastp |
| 2578 | LYD454 sarracenia\|11v1\|SRR192669.235484_P1 | 9654 | 600 | 98.4 | globlastp |
| 2579 | LYD454 silene\|11v1\|SRR096785X107709_P1 | 9650 | 600 | 98.4 | globlastp |
| 2580 | LYD454 silene\|11v1\|SRR096785X10884_P1 | 9650 | 600 | 98.4 | globlastp |
| 2581 | LYD454 tabernaemontana\|11v1\|SRR098689X185122_P1 | 9651 | 600 | 98.4 | globlastp |
| 2582 | LYD454 thellungiella_halophilum\|11v1\|DN773562_P1 | 9655 | 600 | 98.4 | globlastp |
| 2583 | LYD454 trigonella\|11v1\|SRR066194X101436_P1 | 9651 | 600 | 98.4 | globlastp |
| 2584 | LYD454 trigonella\|11v1\|SRR066194X107589_P1 | 9651 | 600 | 98.4 | globlastp |
| 2585 | LYD454 antirrhinum\|gb166\|AJ787682_P1 | 9656 | 600 | 98.4 | globlastp |
| 2586 | LYD454 antirrhinum\|gb166\|AJ789805_P1 | 9656 | 600 | 98.4 | globlastp |
| 2587 | LYD454 apple\|11v1\|CN489296_P1 | 9650 | 600 | 98.4 | globlastp |
| 2588 | LYD454 apple\|gb171\|CN489296 | 9650 | 600 | 98.4 | globlastp |
| 2589 | LYD454 apple\|11v1\|CN490680_P1 | 9650 | 600 | 98.4 | globlastp |
| 2590 | LYD454 apple\|gb171\|CN490680 | 9650 | 600 | 98.4 | globlastp |
| 2591 | LYD454 apple\|11v1\|CN492591_P1 | 9650 | 600 | 98.4 | globlastp |
| 2592 | LYD454 apple\|gb171\|CN492591 | 9650 | 600 | 98.4 | globlastp |
| 2593 | LYD454 apple\|gb171\|CN865222 | 9650 | 600 | 98.4 | globlastp |
| 2594 | LYD454 apple\|11v1\|CN897757_P1 | 9650 | 600 | 98.4 | globlastp |
| 2595 | LYD454 apple\|gb171\|CN882330 | 9650 | 600 | 98.4 | globlastp |
| 2596 | LYD454 apple\|11v1\|CN865222_P1 | 9650 | 600 | 98.4 | globlastp |
| 2597 | LYD454 apple\|gb171\|CN893137 | 9650 | 600 | 98.4 | globlastp |
| 2598 | LYD454 apple\|gb171\|CN941296 | 9650 | 600 | 98.4 | globlastp |
| 2599 | LYD454 avocado\|10v1\|FD505930_P1 | 9657 | 600 | 98.4 | globlastp |
| 2600 | LYD454 banana\|10v1\|DN238454_P1 | 9649 | 600 | 98.4 | globlastp |
| 2601 | LYD454 basilicum\|10v1\|DY328963_P1 | 9651 | 600 | 98.4 | globlastp |
| 2602 | LYD454 beet\|gb162\|BI096274_P1 | 9658 | 600 | 98.4 | globlastp |
| 2603 | LYD454 beet\|gb162\|EG550268_P1 | 9658 | 600 | 98.4 | globlastp |
| 2604 | LYD454 bruguiera\|gb166\|BP941089_P1 | 9649 | 600 | 98.4 | globlastp |
| 2605 | LYD454 cacao\|10v1\|CA794757_P1 | 9649 | 600 | 98.4 | globlastp |
| 2606 | LYD454 coffea\|10v1\|DV665767_P1 | 9649 | 600 | 98.4 | globlastp |
| 2607 | LYD454 cotton\|10v2\|BE054657_P1 | 9649 | 600 | 98.4 | globlastp |
| 2608 | LYD454 cotton\|10v2\|BE054863_P1 | 9649 | 600 | 98.4 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 2609 | LYD454 cotton\|10v2\|DT046683_P1 | 9649 | 600 | 98.4 | globlastp |
| 2610 | LYD454 cotton\|10v2\|SRR032367S0039743_P1 | 9649 | 600 | 98.4 | globlastp |
| 2611 | LYD454 ipomoea_batatas\|10v1\|EE878924_P1 | 9659 | 600 | 98.4 | globlastp |
| 2612 | LYD454 ipomoea_nil\|10v1\|BJ565105_P1 | 9660 | 600 | 98.4 | globlastp |
| 2613 | LYD454 kiwi\|gb166\|FG412755_P1 | 9655 | 600 | 98.4 | globlastp |
| 2614 | LYD454 kiwi\|gb166\|FG416230_P1 | 9655 | 600 | 98.4 | globlastp |
| 2615 | LYD454 kiwi\|gb166\|FG471624_P1 | 9655 | 600 | 98.4 | globlastp |
| 2616 | LYD454 maize\|10v1\|AW171898_P1 | 9649 | 600 | 98.4 | globlastp |
| 2617 | LYD454 maize\|10v1\|BI325283_P1 | 9649 | 600 | 98.4 | globlastp |
| 2618 | LYD454 medicago\|09v1\|AJ388930_P1 | 9651 | 600 | 98.4 | globlastp |
| 2619 | LYD454 medicago\|09v1\|AL380582_P1 | 9651 | 600 | 98.4 | globlastp |
| 2620 | LYD454 medicago\|09v1\|LLCO514023_P1 | 9651 | 600 | 98.4 | globlastp |
| 2621 | LYD454 medicago\|09v1\|LLEX525300_P1 | 9651 | 600 | 98.4 | globlastp |
| 2622 | LYD454 millet\|10v1\|EVO454PM068270_P1 | 9650 | 600 | 98.4 | globlastp |
| 2623 | LYD454 millet\|10v1\|EVO454PM354861_P1 | 9650 | 600 | 98.4 | globlastp |
| 2624 | LYD454 nasturtium\|10v1\|GH162285 | 9661 | 600 | 98.4 | globlastp |
| 2625 | LYD454 nasturtium\|10v1\|GH168259 | 9661 | 600 | 98.4 | globlastp |
| 2626 | LYD454 nasturtium\|10v1\|SRR032558S0008289 | 9661 | 600 | 98.4 | globlastp |
| 2627 | LYD454 nasturtium\|10v1\|SRR032558S0150221 | 9661 | 600 | 98.4 | globlastp |
| 2628 | LYD454 orobanche\|10v1\|SRR023189S0002177_P1 | 9651 | 600 | 98.4 | globlastp |
| 2629 | LYD454 orobanche\|10v1\|SRR023495S0047682_P1 | 9662 | 600 | 98.4 | globlastp |
| 2630 | LYD454 papaya\|gb165\|EX283640_P1 | 9649 | 600 | 98.4 | globlastp |
| 2631 | LYD454 pepper\|gb171\|BM063775_P1 | 9656 | 600 | 98.4 | globlastp |
| 2632 | LYD454 sequoia\|10v1\|SRR065044S0018120 | 9663 | 600 | 98.4 | globlastp |
| 2633 | LYD454 switchgrass\|gb167\|FL957137 | 9649 | 600 | 98.4 | globlastp |
| 2634 | LYD454 tamarix\|gb166\|CF199241 | 9664 | 600 | 98.4 | globlastp |
| 2635 | LYD454 thellungiella\|gb167\|EC599225 | 9655 | 600 | 98.4 | globlastp |
| 2636 | LYD454 foxtail_millet\|11v3\|PHY7SI008503M_T1 | 9665 | 600 | 98.4 | glotblastn |
| 2637 | LYD454 tabernaemontana\|11v1\|SRR098689X173836_T1 | 9666 | 600 | 98.4 | glotblastn |
| 2638 | LYD454 spurge\|gb161\|DV132150 | 9667 | 600 | 98.4 | glotblastn |
| 2639 | LYD454 tobacco\|gb162\|CV016060 | 9668 | 600 | 98.4 | glotblastn |
| 2640 | LYD454 walnuts\|gb166\|CV196094 | 9669 | 600 | 98.4 | glotblastn |
| 2641 | LYD454 fraxinus\|11v1\|SRR058827.155403_T1 | — | 600 | 98.4 | glotblastn |
| 2642 | LYD454 trigonella\|11v1\|SRR066198X205427_T1 | — | 600 | 98.4 | glotblastn |
| 2643 | LYD454 cotton\|10v2\|SRR032367S0013477_T1 | — | 600 | 98.4 | glotblastn |
| 2644 | LYD454 abies\|11v2\|SRR098676X122703_P1 | 9670 | 600 | 96.8 | globlastp |
| 2645 | LYD454 ambrosia\|11v1\|SRR346943.110563XX1_P1 | 9671 | 600 | 96.8 | globlastp |
| 2646 | LYD454 canola\|11v1\|DW997505_P1 | 9672 | 600 | 96.8 | globlastp |
| 2647 | LYD454 canola\|11v1\|DY010683_P1 | 9672 | 600 | 96.8 | globlastp |
| 2648 | LYD454 canola\|11v1\|EE452544_P1 | 9672 | 600 | 96.8 | globlastp |
| 2649 | LYD454 canola\|11v1\|GR447572_P1 | 9672 | 600 | 96.8 | globlastp |
| 2650 | LYD454 cephalotaxus\|11v1\|SRR064395X121034_P1 | 9673 | 600 | 96.8 | globlastp |
| 2651 | LYD454 cirsium\|11v1\|SRR346952.1065042_P1 | 9671 | 600 | 96.8 | globlastp |
| 2652 | LYD454 cirsium\|11v1\|SRR346952.695965XX2_P1 | 9671 | 600 | 96.8 | globlastp |
| 2653 | LYD454 distylium\|11v1\|SRR065077X104288_P1 | 9673 | 600 | 96.8 | globlastp |
| 2654 | LYD454 flaveria\|11v1\|SRR149229.107796XX2_P1 | 9671 | 600 | 96.8 | globlastp |
| 2655 | LYD454 flaveria\|11v1\|SRR149229.115151_P1 | 9671 | 600 | 96.8 | globlastp |
| 2656 | LYD454 flaveria\|11v1\|SRR149229.1175_P1 | 9671 | 600 | 96.8 | globlastp |
| 2657 | LYD454 flaveria\|11v1\|SRR149229.141267_P1 | 9671 | 600 | 96.8 | globlastp |
| 2658 | LYD454 flaveria\|11v1\|SRR149229.223529_P1 | 9671 | 600 | 96.8 | globlastp |
| 2659 | LYD454 flaveria\|11v1\|SRR149232.15596_P1 | 9671 | 600 | 96.8 | globlastp |
| 2660 | LYD454 flaveria\|11v1\|SRR149241.269089_P1 | 9671 | 600 | 96.8 | globlastp |
| 2661 | LYD454 flaveria\|11v1\|SRR149244.126778_P1 | 9671 | 600 | 96.8 | globlastp |
| 2662 | LYD454 maritime_pine\|10v1\|BX252798_P1 | 9670 | 600 | 96.8 | globlastp |
| 2663 | LYD454 maritime_pine\|10v1\|BX254877_P1 | 9670 | 600 | 96.8 | globlastp |
| 2664 | LYD454 maritime_pine\|10v1\|FN705856_P1 | 9670 | 600 | 96.8 | globlastp |
| 2665 | LYD454 maritime_pine\|10v1\|SRR073317S0015296_P1 | 9670 | 600 | 96.8 | globlastp |
| 2666 | LYD454 maritime_pine\|10v1\|SRR073317S0027363_P1 | 9670 | 600 | 96.8 | globlastp |
| 2667 | LYD454 oat\|11v1\|GO586308_P1 | 9671 | 600 | 96.8 | globlastp |
| 2668 | LYD454 oat\|11v1\|GO586317_P1 | 9671 | 600 | 96.8 | globlastp |
| 2669 | LYD454 oat\|11v1\|SRR020741.145798_P1 | 9671 | 600 | 96.8 | globlastp |
| 2670 | LYD454 primula\|11v1\|SRR098679X1160_P1 | 9674 | 600 | 96.8 | globlastp |
| 2671 | LYD454 primula\|11v1\|SRR098679X146021_P1 | 9674 | 600 | 96.8 | globlastp |
| 2672 | LYD454 thellungiella_halophilum\|11v1\|EHJGI11013517_P1 | 9675 | 600 | 96.8 | globlastp |
| 2673 | LYD454 arabidopsis_lyrata\|09v1\|JGIAL012029_P1 | 9672 | 600 | 96.8 | globlastp |
| 2674 | LYD454 arabidopsis_lyrata\|09v1\|JGIAL025122_P1 | 9672 | 600 | 96.8 | globlastp |
| 2675 | LYD454 arabidopsis_lyrata\|09v1\|JGIAL030232_P1 | 9672 | 600 | 96.8 | globlastp |
| 2676 | LYD454 arabidopsis\|10v1\|AT2G19750_P1 | 9672 | 600 | 96.8 | globlastp |
| 2677 | LYD454 arabidopsis\|10v1\|AT4G29390_P1 | 9672 | 600 | 96.8 | globlastp |
| 2678 | LYD454 arabidopsis\|10v1\|AT5G56670_P1 | 9672 | 600 | 96.8 | globlastp |
| 2679 | LYD454 artemisia\|10v1\|ES582153_P1 | 9671 | 600 | 96.8 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 2680 | LYD454 artemisia\|10v1\|EY038405_P1 | 9671 | 600 | 96.8 | globlastp |
| 2681 | LYD454 artemisia\|10v1\|EY050476_P1 | 9671 | 600 | 96.8 | globlastp |
| 2682 | LYD454 artemisia\|10v1\|EY057298_P1 | 9671 | 600 | 96.8 | globlastp |
| 2683 | LYD454 artemisia\|10v1\|EY076672_P1 | 9671 | 600 | 96.8 | globlastp |
| 2684 | LYD454 b_juncea\|10v2\|BJ1SLX00102850D1_P1 | 9672 | 600 | 96.8 | globlastp |
| 2685 | LYD454 b_juncea\|10v2\|E6ANDIZ01A0LY1_P1 | 9672 | 600 | 96.8 | globlastp |
| 2686 | LYD454 b_juncea\|10v2\|E6ANDIZ01A1XAZ_P1 | 9672 | 600 | 96.8 | globlastp |
| 2687 | LYD454 b_juncea\|10v2\|E6ANDIZ01A7DRE_P1 | 9672 | 600 | 96.8 | globlastp |
| 2688 | LYD454 b_juncea\|10v2\|E6ANDIZ01A8M5U_P1 | 9672 | 600 | 96.8 | globlastp |
| 2689 | LYD454 b_juncea\|10v2\|E6ANDIZ01A919N_P1 | 9672 | 600 | 96.8 | globlastp |
| 2690 | LYD454 b_juncea\|10v2\|E6ANDIZ01ADZTM_P1 | 9672 | 600 | 96.8 | globlastp |
| 2691 | LYD454 b_juncea\|10v2\|E6ANDIZ01AT472_P1 | 9672 | 600 | 96.8 | globlastp |
| 2692 | LYD454 b_juncea\|10v2\|E6ANDIZ01B0N7G_P1 | 9672 | 600 | 96.8 | globlastp |
| 2693 | LYD454 b_juncea\|10v2\|E6ANDIZ01BSLTA_P1 | 9672 | 600 | 96.8 | globlastp |
| 2694 | LYD454 b_juncea\|10v2\|E6ANDIZ01CBBHY_P1 | 9672 | 600 | 96.8 | globlastp |
| 2695 | LYD454 b_oleracea\|gb161\|EE534617_P1 | 9672 | 600 | 96.8 | globlastp |
| 2696 | LYD454 b_oleracea\|gb161\|EE535639_P1 | 9672 | 600 | 96.8 | globlastp |
| 2697 | LYD454 b_oleracea\|gb161\|ES938999_P1 | 9672 | 600 | 96.8 | globlastp |
| 2698 | LYD454 b_rapa\|gb162\|CA991993_P1 | 9672 | 600 | 96.8 | globlastp |
| 2699 | LYD454 b_rapa\|gb162\|CV433918_P1 | 9672 | 600 | 96.8 | globlastp |
| 2700 | LYD454 b_rapa\|gb162\|DY010043_P1 | 9672 | 600 | 96.8 | globlastp |
| 2701 | LYD454 b_rapa\|gb162\|ES931561_P1 | 9672 | 600 | 96.8 | globlastp |
| 2702 | LYD454 barley\|10v2\|BE454732_P1 | 9671 | 600 | 96.8 | globlastp |
| 2703 | LYD454 barley\|10v2\|BE601876_P1 | 9671 | 600 | 96.8 | globlastp |
| 2704 | LYD454 barley\|10v2\|BF621642_P1 | 9671 | 600 | 96.8 | globlastp |
| 2705 | LYD454 brachypodium\|09v1\|GT765606_P1 | 9671 | 600 | 96.8 | globlastp |
| 2706 | LYD454 brachypodium\|09v1\|GT769811_P1 | 9671 | 600 | 96.8 | globlastp |
| 2707 | LYD454 canola\|10v1\|CD812564 | 9672 | 600 | 96.8 | globlastp |
| 2708 | LYD454 canola\|11v1\|CN732375_P1 | 9672 | 600 | 96.8 | globlastp |
| 2709 | LYD454 canola\|10v1\|CD813072 | 9672 | 600 | 96.8 | globlastp |
| 2710 | LYD454 canola\|10v1\|CD814874 | 9672 | 600 | 96.8 | globlastp |
| 2711 | LYD454 canola\|10v1\|CD818449 | 9672 | 600 | 96.8 | globlastp |
| 2712 | LYD454 canola\|11v1\|EE415534_P1 | 9672 | 600 | 96.8 | globlastp |
| 2713 | LYD454 canola\|10v1\|CD819525 | 9672 | 600 | 96.8 | globlastp |
| 2714 | LYD454 canola\|11v1\|DW998052_P1 | 9672 | 600 | 96.8 | globlastp |
| 2715 | LYD454 canola\|10v1\|CD839528 | 9672 | 600 | 96.8 | globlastp |
| 2716 | LYD454 canola\|11v1\|CN731337_P1 | 9672 | 600 | 96.8 | globlastp |
| 2717 | LYD454 canola\|10v1\|CN726009 | 9672 | 600 | 96.8 | globlastp |
| 2718 | LYD454 canola\|10v1\|CX189267 | 9672 | 600 | 96.8 | globlastp |
| 2719 | LYD454 canola\|10v1\|CX192558 | 9672 | 600 | 96.8 | globlastp |
| 2720 | LYD454 canola\|10v1\|CX278325 | 9672 | 600 | 96.8 | globlastp |
| 2721 | LYD454 canola\|10v1\|DW997505 | 9672 | 600 | 96.8 | globlastp |
| 2722 | LYD454 canola\|10v1\|DY007588 | 9672 | 600 | 96.8 | globlastp |
| 2723 | LYD454 canola\|11v1\|DY007588_P1 | 9672 | 600 | 96.8 | globlastp |
| 2724 | LYD454 canola\|10v1\|EG019457 | 9672 | 600 | 96.8 | globlastp |
| 2725 | LYD454 canola\|10v1\|H74605 | 9672 | 600 | 96.8 | globlastp |
| 2726 | LYD454 cassava\|09v1\|CK641062_P1 | 9676 | 600 | 96.8 | globlastp |
| 2727 | LYD454 ceratodon\|10v1\|AW086856_P1 | 9677 | 600 | 96.8 | globlastp |
| 2728 | LYD454 ceratodon\|10v1\|SRR074890S0000398_P1 | 9677 | 600 | 96.8 | globlastp |
| 2729 | LYD454 cichorium\|gb171\|DT213339_P1 | 9671 | 600 | 96.8 | globlastp |
| 2730 | LYD454 cichorium\|gb171\|EH697772_P1 | 9671 | 600 | 96.8 | globlastp |
| 2731 | LYD454 cryptomeria\|gb166\|BP176298_P1 | 9678 | 600 | 96.8 | globlastp |
| 2732 | LYD454 dandelion\|10v1\|DY814562_P1 | 9671 | 600 | 96.8 | globlastp |
| 2733 | LYD454 dandelion\|10v1\|DY818579_P1 | 9671 | 600 | 96.8 | globlastp |
| 2734 | LYD454 dandelion\|10v1\|DY820989_P1 | 9671 | 600 | 96.8 | globlastp |
| 2735 | LYD454 eucalyptus\|gb166\|CT981964 | 9679 | 600 | 96.8 | globlastp |
| 2736 | LYD454 gerbera\|09v1\|AJ751842_P1 | 9671 | 600 | 96.8 | globlastp |
| 2737 | LYD454 iceplant\|gb164\|BE034600_P1 | 9671 | 600 | 96.8 | globlastp |
| 2738 | LYD454 lettuce\|10v1\|DW044488_P1 | 9671 | 600 | 96.8 | globlastp |
| 2739 | LYD454 lettuce\|10v1\|DW049058_P1 | 9671 | 600 | 96.8 | globlastp |
| 2740 | LYD454 lettuce\|10v1\|DW051320_P1 | 9671 | 600 | 96.8 | globlastp |
| 2741 | LYD454 lettuce\|10v1\|DW077155_P1 | 9671 | 600 | 96.8 | globlastp |
| 2742 | LYD454 lettuce\|10v1\|DW081576_P1 | 9671 | 600 | 96.8 | globlastp |
| 2743 | LYD454 lolium\|10v1\|ES699043_P1 | 9671 | 600 | 96.8 | globlastp |
| 2744 | LYD454 oat\|10v2\|GO586308 | 9671 | 600 | 96.8 | globlastp |
| 2745 | LYD454 oat\|10v2\|GO597060 | 9671 | 600 | 96.8 | globlastp |
| 2746 | LYD454 oat\|11v1\|GO597060_P1 | 9671 | 600 | 96.8 | globlastp |
| 2747 | LYD454 oat\|10v2\|SRR020741S0014111 | 9671 | 600 | 96.8 | globlastp |
| 2748 | LYD454 oat\|11v1\|SRR020741.14111_P1 | 9671 | 600 | 96.8 | globlastp |
| 2749 | LYD454 oat\|10v2\|SRR020741S0017135 | 9671 | 600 | 96.8 | globlastp |
| 2750 | LYD454 orobanche\|10v1\|SRR023189S0000868_P1 | 9680 | 600 | 96.8 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 2751 | LYD454 physcomitrella\|10v1\|AW145371_P1 | 9677 | 600 | 96.8 | globlastp |
| 2752 | LYD454 physcomitrella\|10v1\|AW145482_P1 | 9677 | 600 | 96.8 | globlastp |
| 2753 | LYD454 physcomitrella\|10v1\|AW145643_P1 | 9677 | 600 | 96.8 | globlastp |
| 2754 | LYD454 physcomitrella\|10v1\|AW738898_P1 | 9677 | 600 | 96.8 | globlastp |
| 2755 | LYD454 podocarpus\|10v1\|SRR065014S0028153_P1 | 9673 | 600 | 96.8 | globlastp |
| 2756 | LYD454 radish\|gb164\|EV546138 | 9672 | 600 | 96.8 | globlastp |
| 2757 | LYD454 radish\|gb164\|EW714205 | 9672 | 600 | 96.8 | globlastp |
| 2758 | LYD454 radish\|gb164\|EW733313 | 9672 | 600 | 96.8 | globlastp |
| 2759 | LYD454 radish\|gb164\|EX748549 | 9672 | 600 | 96.8 | globlastp |
| 2760 | LYD454 radish\|gb164\|EX764385 | 9672 | 600 | 96.8 | globlastp |
| 2761 | LYD454 radish\|gb164\|EX773248 | 9672 | 600 | 96.8 | globlastp |
| 2762 | LYD454 radish\|gb164\|FD536591 | 9672 | 600 | 96.8 | globlastp |
| 2763 | LYD454 salvia\|10v1\|CV170531 | 9671 | 600 | 96.8 | globlastp |
| 2764 | LYD454 salvia\|10v1\|SRR014553S0003235 | 9671 | 600 | 96.8 | globlastp |
| 2765 | LYD454 sciadopitys\|10v1\|SRR065035S0030903 | 9681 | 600 | 96.8 | globlastp |
| 2766 | LYD454 senecio\|gb170\|DV038747 | 9671 | 600 | 96.8 | globlastp |
| 2767 | LYD454 spruce\|gb162\|CO223398 | 9670 | 600 | 96.8 | globlastp |
| 2768 | LYD454 spruce\|gb162\|DR508930 | 9670 | 600 | 96.8 | globlastp |
| 2769 | LYD454 sugarcane\|10v1\|CN611654 | 9682 | 600 | 96.8 | globlastp |
| 2770 | LYD454 sunflower\|10v1\|CD845768 | 9671 | 600 | 96.8 | globlastp |
| 2771 | LYD454 sunflower\|10v1\|CD846382 | 9671 | 600 | 96.8 | globlastp |
| 2772 | LYD454 sunflower\|10v1\|CD849049 | 9671 | 600 | 96.8 | globlastp |
| 2773 | LYD454 sunflower\|10v1\|DY910601 | 9671 | 600 | 96.8 | globlastp |
| 2774 | LYD454 taxus\|10v1\|SRR032523_S0012471 | 9673 | 600 | 96.8 | globlastp |
| 2775 | LYD454 tragopogon\|10v1\|SRR020205S0009242 | 9671 | 600 | 96.8 | globlastp |
| 2776 | LYD454 wheat\|10v2\|AL826328 | 9671 | 600 | 96.8 | globlastp |
| 2777 | LYD454 wheat\|10v2\|BE399345 | 9671 | 600 | 96.8 | globlastp |
| 2778 | LYD454 wheat\|10v2\|BE416316 | 9671 | 600 | 96.8 | globlastp |
| 2779 | LYD454 wheat\|10v2\|BF473734 | 9671 | 600 | 96.8 | globlastp |
| 2780 | LYD454 zamia\|gb166\|DY032275 | 9683 | 600 | 96.8 | globlastp |
| 2781 | LYD454 zostera\|10v1\|SRR057351S0002653 | 9671 | 600 | 96.8 | globlastp |
| 2782 | LYD454 canola\|11v1\|CN729033_P1 | 9672 | 600 | 96.8 | globlastp |
| 2783 | LYD454 canola\|11v1\|CN726009_P1 | 9672 | 600 | 96.8 | globlastp |
| 2784 | LYD454 canola\|11v1\|EG019457_P1 | 9672 | 600 | 96.8 | globlastp |
| 2785 | LYD454 oat\|11v1\|SRR020741.119516_P1 | 9671 | 600 | 96.8 | globlastp |
| 2786 | LYD454 cirsium\|11v1\|SRR346952.621859_T1 | 9684 | 600 | 96.8 | glotblastn |
| 2787 | LYD454 utricularia\|11v1\|SRR094438.105225_T1 | 9685 | 600 | 96.8 | glotblastn |
| 2788 | LYD454 amaranthus\|10v1\|SRR039411S0030601_T1 | 9686 | 600 | 96.8 | glotblastn |
| 2789 | LYD454 b_oleracea\|gb161\|DY027988_T1 | 9687 | 600 | 96.8 | glotblastn |
| 2790 | LYD454 b_rapa\|gb162\|CX265916_T1 | 9688 | 600 | 96.8 | glotblastn |
| 2791 | LYD454 b_rapa\|gb162\|CX269689_T1 | 9689 | 600 | 96.8 | glotblastn |
| 2792 | LYD454 b_rapa\|gb162\|CX270469_T1 | 9690 | 600 | 96.8 | glotblastn |
| 2793 | LYD454 oil_palm\|gb166\|EL690410_T1 | 9691 | 600 | 96.8 | glotblastn |
| 2794 | LYD454 radish\|gb164\|EV536026 | 9692 | 600 | 96.8 | glotblastn |
| 2795 | LYD454 radish\|gb164\|EW715786 | 9693 | 600 | 96.8 | glotblastn |
| 2796 | LYD454 safflower\|gb162\|EL409667 | 9694 | 600 | 96.8 | glotblastn |
| 2797 | LYD454 sequoia\|10v1\|SRR065044S0001520 | 9695 | 600 | 96.8 | glotblastn |
| 2798 | LYD454 zostera\|10v1\|AM769623 | 9696 | 600 | 96.8 | glotblastn |
| 2799 | LYD454 utricularia\|11v1\|SRR094438.106041_T1 | — | 600 | 96.8 | glotblastn |
| 2800 | LYD454 cedrus\|11v1\|SRR065007X108153_P1 | 9697 | 600 | 95.2 | globlastp |
| 2801 | LYD454 cedrus\|11v1\|SRR065007X133520_P1 | 9698 | 600 | 95.2 | globlastp |
| 2802 | LYD454 clementine\|11v1\|DN797432_P1 | 9699 | 600 | 95.2 | globlastp |
| 2803 | LYD454 flax\|11v1\|EU829296_P1 | 9700 | 600 | 95.2 | globlastp |
| 2804 | LYD454 flax\|11v1\|JG082410_P1 | 9700 | 600 | 95.2 | globlastp |
| 2805 | LYD454 fraxinus\|11v1\|SRR058827.122124_P1 | 9701 | 600 | 95.2 | globlastp |
| 2806 | LYD454 orange\|11v1\|DN797432_P1 | 9699 | 600 | 95.2 | globlastp |
| 2807 | LYD454 canola\|10v1\|ES994411 | 9702 | 600 | 95.2 | globlastp |
| 2808 | LYD454 canola\|11v1\|EV138550_P1 | 9702 | 600 | 95.2 | globlastp |
| 2809 | LYD454 cassava\|09v1\|CK641617_P1 | 9703 | 600 | 95.2 | globlastp |
| 2810 | LYD454 citrus\|gb166\|DN797432_P1 | 9699 | 600 | 95.2 | globlastp |
| 2811 | LYD454 flax\|09v1\|EU829296 | 9700 | 600 | 95.2 | globlastp |
| 2812 | LYD454 flax\|11v1\|EU829395_P1 | 9700 | 600 | 95.2 | globlastp |
| 2813 | LYD454 gerbera\|09v1\|AJ764262_P1 | 9704 | 600 | 95.2 | globlastp |
| 2814 | LYD454 marchantia\|gb166\|C96083_P1 | 9705 | 600 | 95.2 | globlastp |
| 2815 | LYD454 pine\|10v2\|AA556923_P1 | 9706 | 600 | 95.2 | globlastp |
| 2816 | LYD454 pseudotsuga\|10v1\|SRR065119S0016763 | 9697 | 600 | 95.2 | globlastp |
| 2817 | LYD454 pseudotsuga\|10v1\|SRR065119S0069145 | 9697 | 600 | 95.2 | globlastp |
| 2818 | LYD454 sciadopitys\|10v1\|SRR065035S0026248 | 9707 | 600 | 95.2 | globlastp |
| 2819 | LYD454 thellungiella\|gb167\|BY827021 | 9708 | 600 | 95.2 | globlastp |
| 2820 | LYD454 ambrosia\|11v1\|SRR346943.171352_T1 | 9709 | 600 | 95.2 | glotblastn |
| 2821 | LYD454 cirsium\|11v1\|SRR346952.106937XX2_T1 | 9710 | 600 | 95.2 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 2822 | LYD454 flaveria\|11v1\|SRR149229.47685_T1 | 9711 | 600 | 95.2 | glotblastn |
| 2823 | LYD454 flaveria\|11v1\|SRR149244.156117_T1 | 9712 | 600 | 95.2 | glotblastn |
| 2824 | LYD454 phalaenopsis\|11v1\|SRR125771.1386203XX1_T1 | 9713 | 600 | 95.2 | glotblastn |
| 2825 | LYD454 radish\|gb164\|EW714228 | 9714 | 600 | 95.2 | glotblastn |
| 2826 | LYD454 safflower\|gb162\|EL510939 | 9715 | 600 | 95.2 | glotblastn |
| 2827 | LYD454 humulus\|11v1\|SRR098683X12029_T1 | — | 600 | 95.2 | glotblastn |
| 2828 | LYD454 scabiosa\|11v1\|SRR063723X110130_T1 | — | 600 | 95.2 | glotblastn |
| 2829 | LYD454 barley\|10v2\|CA028561_T1 | — | 600 | 95.2 | glotblastn |
| 2830 | LYD454 taxus\|10v1\|SRR032523S0049257 | — | 600 | 95.2 | glotblastn |
| 2831 | LYD454 gnetum\|10v1\|SRRP0164399S0003290_P1 | 9716 | 600 | 93.7 | globlastp |
| 2832 | LYD454 b_oleracea\|gb161\|EE534016_T1 | 9717 | 600 | 93.6 | glotblastn |
| 2833 | LYD454 iceplant\|gb164\|BE033574_T1 | 9718 | 600 | 93.6 | glotblastn |
| 2834 | LYD454 wheat\|10v2\|CA616714 | 9719 | 600 | 93.6 | glotblastn |
| 2835 | LYD454 sarracenia\|11v1\|SRR192669.251034_T1 | — | 600 | 93.6 | glotblastn |
| 2836 | LYD454 thellungiella_parvulum\|11v1\|BY827021_T1 | — | 600 | 93.6 | glotblastn |
| 2837 | LYD454 cichorium\|gb171\|FL679669_T1 | — | 600 | 93.6 | glotblastn |
| 2838 | LYD454 pine\|10v2\|AW064649_P1 | 9720 | 600 | 93.5 | globlastp |
| 2839 | LYD454 pine\|10v2\|BF221379_P1 | 9721 | 600 | 93.5 | globlastp |
| 2840 | LYD454 tragopogon\|10v1\|SRR020205S0114897 | 9722 | 600 | 93.5 | globlastp |
| 2841 | LYD454 sarracenia\|11v1\|SRR192671.234142_T1 | 9723 | 600 | 91.9 | glotblastn |
| 2842 | LYD454 rye\|gb164\|BE704867 | 9724 | 600 | 91.9 | glotblastn |
| 2843 | LYD454 b_juncea\|10v2\|E6ANDIZ02JYZYI_P1 | 9725 | 600 | 91.9 | globlastp |
| 2844 | LYD454 marchantia\|gb166\|C96371_P1 | 9726 | 600 | 91.9 | globlastp |
| 2845 | LYD454 pine\|10v2\|AW010141_P1 | 9727 | 600 | 91.9 | globlastp |
| 2846 | LYD454 triphysaria\|10v1\|BM356870 | 9728 | 600 | 91.9 | globlastp |
| 2847 | LYD454 triphysaria\|10v1\|EY008970 | 9728 | 600 | 91.9 | globlastp |
| 2848 | LYD454 triphysaria\|10v1\|SRR023500S0063179 | 9728 | 600 | 91.9 | globlastp |
| 2849 | LYD454 fagopyrum\|11v1\|SRR063703X169382_T1 | 9729 | 600 | 90.6 | glotblastn |
| 2850 | LYD454 thalictrum\|11v1\|SRR096787X107927_T1 | 9730 | 600 | 90.3 | glotblastn |
| 2851 | LYD454 pine\|10v2\|DN631114_T1 | 9731 | 600 | 90.3 | glotblastn |
| 2852 | LYD454 euphorbia\|11v1\|BP959302_T1 | — | 600 | 90.3 | glotblastn |
| 2853 | LYD454 pteridium\|11v1\|SRR043594X10825XX1_T1 | — | 600 | 90.3 | glotblastn |
| 2854 | LYD454 banana\|10v1\|FL658159_P1 | 9732 | 600 | 90.3 | globlastp |
| 2855 | LYD454 fern\|gb171\|DK944768_P1 | 9733 | 600 | 90.3 | globlastp |
| 2856 | LYD454 ginger\|gb164\|DY345606_P1 | 9734 | 600 | 89.9 | globlastp |
| 2857 | LYD454 b_rapa\|gb162\|EX116720_T1 | 9735 | 600 | 88.7 | glotblastn |
| 2858 | LYD454 beet\|gb162\|EG551257_T1 | 9736 | 600 | 88.7 | glotblastn |
| 2859 | LYD454 cleome_spinosa\|10v1\|SRR015531S0050567_P1 | 9737 | 600 | 87.3 | globlastp |
| 2860 | LYD454 thellungiella_halophilum\|11v1\|BY827021_P1 | 9738 | 600 | 86.6 | globlastp |
| 2861 | LYD454 thellungiella_parvulum\|11v1\|EC599225_P1 | 9739 | 600 | 86.6 | globlastp |
| 2862 | LYD454 thellungiella_parvulum\|11v1\|EPCRP031238_P1 | 9740 | 600 | 86.6 | globlastp |
| 2863 | LYD454 canola\|11v1\|EE504791_P1 | 9741 | 600 | 85.5 | globlastp |
| 2864 | LYD454 spikemoss\|gb165\|DN838769 | 9742 | 600 | 84.1 | globlastp |
| 2865 | LYD454 triphysaria\|10v1\|CB815014 | 9743 | 600 | 84.1 | globlastp |
| 2866 | LYD454 orobanche\|10v1\|SRR023189S0157062_P1 | 9744 | 600 | 83.9 | globlastp |
| 2867 | LYD454 volvox\|gb162\|AW676277 | 9745 | 600 | 83.9 | globlastp |
| 2868 | LYD454 chlamydomonas\|gb162\|AW676277_T1 | 9746 | 600 | 83.9 | glotblastn |
| 2869 | LYD454 tobacco\|gb162\|CV015984 | 9747 | 600 | 82.7 | globlastp |
| 2870 | LYD454 mesostigma\|gb166\|EC726985_P1 | 9748 | 600 | 82.3 | globlastp |
| 2871 | LYD454 wheat\|10v2\|CJ525342 | 9749 | 600 | 82.3 | globlastp |
| 2872 | LYD454 apple\|11v1\|CV128717_T1 | 9750 | 600 | 82.3 | glotblastn |
| 2873 | LYD454 sarracenia\|11v1\|SRR192669.238960_T1 | — | 600 | 82.3 | glotblastn |
| 2874 | LYD454 nicotiana_benthamiana\|gb162\|CN742184_P1 | 9751 | 600 | 81.3 | globlastp |
| 2875 | LYD454 onion\|gb162\|CF436447_P1 | 9752 | 600 | 81.3 | globlastp |
| 2876 | LYD454 aquilegia\|10v2\|DT735337_T1 | 9753 | 600 | 80.7 | glotblastn |
| 2877 | LYD454 olea\|11v1\|SRR014464.70506_T1 | — | 600 | 80.7 | glotblastn |
| 2878 | LYD454 mesostigma\|gb166\|DN255051_P1 | 9754 | 600 | 80.6 | globlastp |
| 2879 | LYD454 spruce\|gb162\|ES660969 | 9755 | 600 | 80.6 | globlastp |
| 2880 | LYD454 watermelon\|11v1\|AM715327_P1 | 9756 | 600 | 80.3 | globlastp |
| 2881 | LYD454 watermelon\|11v1\|DV634285_P1 | 9757 | 600 | 80.3 | globlastp |
| 2882 | LYD458 soybean\|11v1\|GLYMA02G06120 | 9758 | 603 | 89.7 | globlastp |
| 2883 | LYD458 pigeonpea\|10v1\|SRR054580S0707957_P1 | 9759 | 603 | 87.7 | globlastp |
| 2884 | LYD458 cowpea\|gb166\|FC457470_P1 | 9760 | 603 | 87.4 | globlastp |
| 2885 | LYD458 medicago\|09v1\|AL370573_P1 | 9761 | 603 | 83.7 | globlastp |
| 2886 | LYD458 trigonella\|11v1\|SRR066194X87106_T1 | 9762 | 603 | 82.6 | glotblastn |
| 2887 | LYD459 soybean\|11v1\|GLYMA19G01330 | 9763 | 604 | 88.5 | globlastp |
| 2888 | LYD460 bean\|gb167\|CB542551_P1 | 9764 | 605 | 94.9 | globlastp |
| 2889 | LYD460 cowpea\|gb166\|FC458286_T1 | 9765 | 605 | 94.6 | glotblastn |
| 2890 | LYD460 soybean\|11v1\|GLYMA15G10490 | 9766 | 605 | 93.8 | globlastp |
| 2891 | LYD460 medicago\|09v1\|AL376477_P1 | 9767 | 605 | 87.3 | globlastp |
| 2892 | LYD460 lotus\|09v1\|AW720440_P1 | 9768 | 605 | 86.8 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 2893 | LYD460 cassava\|09v1\|DV443765_P1 | 9769 | 605 | 80.6 | globlastp |
| 2894 | LYD461 soybean\|11v1\|GLYMA13G26930_P1 | 9770 | 606 | 90.4 | globlastp |
| 2895 | LYD465 soybean\|11v1\|GLYMA05G21280 | 9771 | 608 | 92.7 | globlastp |
| 2896 | LYD466 liquorice\|gb171\|FS244484_P1 | 609 | 609 | 100.0 | globlastp |
| 2897 | LYD466 cyamopsis\|10v1\|EG981534_P1 | 9772 | 609 | 99.2 | globlastp |
| 2898 | LYD466 liquorice\|gb171\|FS238727_P1 | 9773 | 609 | 99.2 | globlastp |
| 2899 | LYD466 oak\|10v1\|DN950897_P1 | 9774 | 609 | 99.2 | globlastp |
| 2900 | LYD466 pigeonpea\|10v1\|GR466152_P1 | 9775 | 609 | 99.2 | globlastp |
| 2901 | LYD466 cucurbita\|11v1\|SRR091276X101348_P1 | 9776 | 609 | 98.3 | globlastp |
| 2902 | LYD466 cucurbita\|11v1\|SRR091276X229924XX2_P1 | 9776 | 609 | 98.3 | globlastp |
| 2903 | LYD466 eucalyptus\|11v2\|CD668247_P1 | 9777 | 609 | 98.3 | globlastp |
| 2904 | LYD466 cacao\|10v1\|CU477307_P1 | 9778 | 609 | 98.3 | globlastp |
| 2905 | LYD466 chestnut\|gb170\|SRR006295S0007913_P1 | 9779 | 609 | 98.3 | globlastp |
| 2906 | LYD466 chestnut\|gb170\|SRR006295S0008800_P1 | 9780 | 609 | 98.3 | globlastp |
| 2907 | LYD466 cucumber\|09v1\|DV633091_P1 | 9776 | 609 | 98.3 | globlastp |
| 2908 | LYD466 eucalyptus\|gb166\|CD668247 | 9777 | 609 | 98.3 | globlastp |
| 2909 | LYD466 grape\|11v1\|GSVIVT01011419001_P1 | 9781 | 609 | 98.3 | globlastp |
| 2910 | LYD466 grape\|gb160\|BQ799013 | 9781 | 609 | 98.3 | globlastp |
| 2911 | LYD466 grape\|11v1\|GSVIVT01019985001_P1 | 9781 | 609 | 98.3 | globlastp |
| 2912 | LYD466 grape\|gb160\|CB002131 | 9781 | 609 | 98.3 | globlastp |
| 2913 | LYD466 hevea\|10v1\|EC601405_P1 | 9782 | 609 | 98.3 | globlastp |
| 2914 | LYD466 lotus\|09v1\|LLBG662070_P1 | 9783 | 609 | 98.3 | globlastp |
| 2915 | LYD466 momordica\|10v1\|SRR071315S0007426_P1 | 9776 | 609 | 98.3 | globlastp |
| 2916 | LYD466 oak\|10v1\|FP041651_P1 | 9780 | 609 | 98.3 | globlastp |
| 2917 | LYD466 peanut\|10v1\|ES717592_P1 | 9784 | 609 | 98.3 | globlastp |
| 2918 | LYD466 poplar\|10v1\|BU823770_P1 | 9785 | 609 | 98.3 | globlastp |
| 2919 | LYD466 soybean\|11v1\|GLYMA01G05740 | 9786 | 609 | 98.3 | globlastp |
| 2920 | LYD466 soybean\|11v1\|GLYMA02G11920 | 9786 | 609 | 98.3 | globlastp |
| 2921 | LYD466 clementine\|11v1\|CF829369_P1 | 9787 | 609 | 97.5 | globlastp |
| 2922 | LYD466 euphorbia\|11v1\|DV127901_P1 | 9788 | 609 | 97.5 | globlastp |
| 2923 | LYD466 flaveria\|11v1\|SRR149229.123657_P1 | 9789 | 609 | 97.5 | globlastp |
| 2924 | LYD466 flaveria\|11v1\|SRR149229.155515_P1 | 9790 | 609 | 97.5 | globlastp |
| 2925 | LYD466 flaveria\|11v1\|SRR149229.356445XX2_P1 | 9789 | 609 | 97.5 | globlastp |
| 2926 | LYD466 orange\|11v1\|CF829369_P1 | 9787 | 609 | 97.5 | globlastp |
| 2927 | LYD466 phyla\|11v2\|SRR099035X100505_P1 | 9791 | 609 | 97.5 | globlastp |
| 2928 | LYD466 phyla\|11v2\|SRR099037X112964_P1 | 9792 | 609 | 97.5 | globlastp |
| 2929 | LYD466 watermelon\|11v1\|AA660127_P1 | 9788 | 609 | 97.5 | globlastp |
| 2930 | LYD466 bruguiera\|gb166\|BP940899_P1 | 9793 | 609 | 97.5 | globlastp |
| 2931 | LYD466 cacao\|10v1\|CA794726_P1 | 9794 | 609 | 97.5 | globlastp |
| 2932 | LYD466 cacao\|10v1\|CU476824_P1 | 9795 | 609 | 97.5 | globlastp |
| 2933 | LYD466 cassava\|09v1\|BM260178_P1 | 9796 | 609 | 97.5 | globlastp |
| 2934 | LYD466 cassava\|09v1\|CK645001_P1 | 9797 | 609 | 97.5 | globlastp |
| 2935 | LYD466 cassava\|09v1\|FF535419_P1 | 9797 | 609 | 97.5 | globlastp |
| 2936 | LYD466 citrus\|gb166\|CF829369_P1 | 9787 | 609 | 97.5 | globlastp |
| 2937 | LYD466 cowpea\|gb166\|FC457012_P1 | 9798 | 609 | 97.5 | globlastp |
| 2938 | LYD466 cucumber\|09v1\|BG1454G0050262_P1 | 9799 | 609 | 97.5 | globlastp |
| 2939 | LYD466 cucumber\|09v1\|CK085571_P1 | 9799 | 609 | 97.5 | globlastp |
| 2940 | LYD466 cyamopsis\|10v1\|EG977518_P1 | 9800 | 609 | 97.5 | globlastp |
| 2941 | LYD466 ginseng\|10v1\|DV555890_P1 | 9801 | 609 | 97.5 | globlastp |
| 2942 | LYD466 heritiera\|10v1\|SRR005795S0004876_P1 | 9802 | 609 | 97.5 | globlastp |
| 2943 | LYD466 ipomoea_nil\|10v1\|BJ555580_P1 | 9803 | 609 | 97.5 | globlastp |
| 2944 | LYD466 ipomoea_nil\|10v1\|BJ555811_P1 | 9804 | 609 | 97.5 | globlastp |
| 2945 | LYD466 jatropha\|09v1\|FM887510_P1 | 9805 | 609 | 97.5 | globlastp |
| 2946 | LYD466 melon\|10v1\|DV632616_P1 | 9799 | 609 | 97.5 | globlastp |
| 2947 | LYD466 melon\|10v1\|VMEL00700107581081_P1 | 9799 | 609 | 97.5 | globlastp |
| 2948 | LYD466 poplar\|10v1\|AI163146_P1 | 9806 | 609 | 97.5 | globlastp |
| 2949 | LYD466 prunus\|10v1\|CN488753 | 9807 | 609 | 97.5 | globlastp |
| 2950 | LYD466 salvia\|10v1\|CV162376 | 9808 | 609 | 97.5 | globlastp |
| 2951 | LYD466 eucalyptus\|11v2\|CD669633_P1 | 9809 | 609 | 97.5 | globlastp |
| 2952 | LYD466 ambrosia\|11v1\|SRR346935.460478_P1 | 9810 | 609 | 96.7 | globlastp |
| 2953 | LYD466 ambrosia\|11v1\|SRR346943.138303_P1 | 9811 | 609 | 96.7 | globlastp |
| 2954 | LYD466 amsonia\|11v1\|SRR098688X10157_P1 | 9812 | 609 | 96.7 | globlastp |
| 2955 | LYD466 cirsium\|11v1\|SRR346952.1001857_P1 | 9813 | 609 | 96.7 | globlastp |
| 2956 | LYD466 cirsium\|11v1\|SRR346952.105500XX1_P1 | 9814 | 609 | 96.7 | globlastp |
| 2957 | LYD466 clementine\|11v1\|CF834581_P1 | 9815 | 609 | 96.7 | globlastp |
| 2958 | LYD466 cucurbita\|11v1\|SRR091276X111559_P1 | 9816 | 609 | 96.7 | globlastp |
| 2959 | LYD466 flaveria\|11v1\|SRR149229.157079XX1_P1 | 9810 | 609 | 96.7 | globlastp |
| 2960 | LYD466 flaveria\|11v1\|SRR149229.223524_P1 | 9817 | 609 | 96.7 | globlastp |
| 2961 | LYD466 flaveria\|11v1\|SRR149232.140872_P1 | 9810 | 609 | 96.7 | globlastp |
| 2962 | LYD466 flaveria\|11v1\|SRR149232.146129_P1 | 9817 | 609 | 96.7 | globlastp |
| 2963 | LYD466 flaveria\|11v1\|SRR149232.200003_P1 | 9810 | 609 | 96.7 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 2964 | LYD466 flaveria\|11v1\|SRR149244.106209_P1 | 9817 | 609 | 96.7 | globlastp |
| 2965 | LYD466 orange\|11v1\|CF834581_P1 | 9815 | 609 | 96.7 | globlastp |
| 2966 | LYD466 phyla\|11v2\|SRR099035X113093_P1 | 9818 | 609 | 96.7 | globlastp |
| 2967 | LYD466 platanus\|11v1\|SRR096786X104422_P1 | 9819 | 609 | 96.7 | globlastp |
| 2968 | LYD466 platanus\|11v1\|SRR096786X108393_P1 | 9820 | 609 | 96.7 | globlastp |
| 2969 | LYD466 sarracenia\|11v1\|SRR192669.103397_P1 | 9821 | 609 | 96.7 | globlastp |
| 2970 | LYD466 sarracenia\|11v1\|SRR192669.124864_P1 | 9821 | 609 | 96.7 | globlastp |
| 2971 | LYD466 sarracenia\|11v1\|SRR192669.160452_P1 | 9821 | 609 | 96.7 | globlastp |
| 2972 | LYD466 tabernaemontana\|11v1\|SRR098689X108564_P1 | 9822 | 609 | 96.7 | globlastp |
| 2973 | LYD466 thalictrum\|11v1\|SRR096787X101277_P1 | 9823 | 609 | 96.7 | globlastp |
| 2974 | LYD466 thalictrum\|11v1\|SRR096787X103040_P1 | 9823 | 609 | 96.7 | globlastp |
| 2975 | LYD466 tomato\|11v1\|BG124377_P1 | 9824 | 609 | 96.7 | globlastp |
| 2976 | LYD466 trigonella\|11v1\|SRR066194X184530_P1 | 9825 | 609 | 96.7 | globlastp |
| 2977 | LYD466 tripterygium\|11v1\|SRR098677X111938_P1 | 9826 | 609 | 96.7 | globlastp |
| 2978 | LYD466 watermelon\|11v1\|DV632616_P1 | 9827 | 609 | 96.7 | globlastp |
| 2979 | LYD466 watermelon\|11v1\|SRR057379.197960_P1 | 9828 | 609 | 96.7 | globlastp |
| 2980 | LYD466 bean\|gb167\|CA897859_P1 | 9829 | 609 | 96.7 | globlastp |
| 2981 | LYD466 bean\|gb167\|CA897862_P1 | 9829 | 609 | 96.7 | globlastp |
| 2982 | LYD466 cassava\|09v1\|CK642565_P1 | 9830 | 609 | 96.7 | globlastp |
| 2983 | LYD466 castorbean\|09v1\|EV520590 | 9831 | 609 | 96.7 | globlastp |
| 2984 | LYD466 castorbean\|11v1\|EV520590_P1 | 9831 | 609 | 96.7 | globlastp |
| 2985 | LYD466 cichorium\|gb171\|EH684815_P1 | 9832 | 609 | 96.7 | globlastp |
| 2986 | LYD466 citrus\|gb166\|CF834581_P1 | 9815 | 609 | 96.7 | globlastp |
| 2987 | LYD466 coffea\|10v1\|GR995923_P1 | 9833 | 609 | 96.7 | globlastp |
| 2988 | LYD466 cotton\|10v2\|SRR032367S0001161_P1 | 9834 | 609 | 96.7 | globlastp |
| 2989 | LYD466 cotton\|10v2\|SRR032367S0164472_P1 | 9835 | 609 | 96.7 | globlastp |
| 2990 | LYD466 cowpea\|gb166\|FC459928_P1 | 9836 | 609 | 96.7 | globlastp |
| 2991 | LYD466 cynara\|gb167\|GE585982_P1 | 9837 | 609 | 96.7 | globlastp |
| 2992 | LYD466 eggplant\|10v1\|FS013353_P1 | 9824 | 609 | 96.7 | globlastp |
| 2993 | LYD466 eucalyptus\|gb166\|CU398698 | 9838 | 609 | 96.7 | globlastp |
| 2994 | LYD466 hevea\|10v1\|EC600287_P1 | 9839 | 609 | 96.7 | globlastp |
| 2995 | LYD466 ipomoea_batatas\|10v1\|CB330053_P1 | 9840 | 609 | 96.7 | globlastp |
| 2996 | LYD466 ipomoea_nil\|10v1\|BJ555282_P1 | 9841 | 609 | 96.7 | globlastp |
| 2997 | LYD466 kiwi\|gb166\|FG489709_P1 | 9842 | 609 | 96.7 | globlastp |
| 2998 | LYD466 liriodendron\|gb166\|CK753799_P1 | 9843 | 609 | 96.7 | globlastp |
| 2999 | LYD466 medicago\|09v1\|AW125981_P1 | 9844 | 609 | 96.7 | globlastp |
| 3000 | LYD466 medicago\|09v1\|AW698456_P1 | 9845 | 609 | 96.7 | globlastp |
| 3001 | LYD466 oil_palm\|gb166\|CN599981_P1 | 9846 | 609 | 96.7 | globlastp |
| 3002 | LYD466 peanut\|10v1\|CD038251_P1 | 9847 | 609 | 96.7 | globlastp |
| 3003 | LYD466 peanut\|10v1\|ES718269_P1 | 9847 | 609 | 96.7 | globlastp |
| 3004 | LYD466 pepper\|gb171\|BM062074_P1 | 9848 | 609 | 96.7 | globlastp |
| 3005 | LYD466 pepper\|gb171\|BM065228_P1 | 9849 | 609 | 96.7 | globlastp |
| 3006 | LYD466 pigeonpea\|10v1\|GR472227_P1 | 9850 | 609 | 96.7 | globlastp |
| 3007 | LYD466 pigeonpea\|10v1\|SRR054580S0064353_P1 | 9851 | 609 | 96.7 | globlastp |
| 3008 | LYD466 poplar\|10v1\|AI161812_P1 | 9852 | 609 | 96.7 | globlastp |
| 3009 | LYD466 salvia\|10v1\|CV162276 | 9853 | 609 | 96.7 | globlastp |
| 3010 | LYD466 salvia\|10v1\|SRR014553S0001485 | 9854 | 609 | 96.7 | globlastp |
| 3011 | LYD466 strawberry\|11v1\|DV438309 | 9855 | 609 | 96.7 | globlastp |
| 3012 | LYD466 sunflower\|10v1\|CD849342 | 9810 | 609 | 96.7 | globlastp |
| 3013 | LYD466 sunflower\|10v1\|CD852072 | 9817 | 609 | 96.7 | globlastp |
| 3014 | LYD466 tomato\|09v1\|BG124377 | 9824 | 609 | 96.7 | globlastp |
| 3015 | LYD466 tragopogon\|10v1\|SRR020205S0010714 | 9817 | 609 | 96.7 | globlastp |
| 3016 | LYD466 tragopogon\|10v1\|SRR020205S0024028 | 9814 | 609 | 96.7 | globlastp |
| 3017 | LYD466 eucalyptus\|11v2\|CD670009_P1 | 9856 | 609 | 96.7 | globlastp |
| 3018 | LYD466 ambrosia\|11v1\|SRR346946.133561_T1 | 9857 | 609 | 96.7 | glotblastn |
| 3019 | LYD466 flaveria\|11v1\|SRR149240.392156XX1_T1 | 9858 | 609 | 96.7 | glotblastn |
| 3020 | LYD466 apple\|11v1\|CN488753_P1 | 9859 | 609 | 95.9 | globlastp |
| 3021 | LYD466 apple\|gb171\|CN488753 | 9859 | 609 | 95.9 | globlastp |
| 3022 | LYD466 flaveria\|11v1\|SRR149244.158738_T1 | 9860 | 609 | 95.8 | glotblastn |
| 3023 | LYD466 fraxinus\|11v1\|SRR058827.125544_T1 | 9861 | 609 | 95.8 | glotblastn |
| 3024 | LYD466 phyla\|11v2\|SRR099037X137502_T1 | 9862 | 609 | 95.8 | glotblastn |
| 3025 | LYD466 lettuce\|10v1\|DW082930_T1 | 9863 | 609 | 95.8 | glotblastn |
| 3026 | LYD466 ambrosia\|11v1\|SRR346943.155207_T1 | — | 609 | 95.8 | glotblastn |
| 3027 | LYD466 ambrosia\|11v1\|GW917906_P1 | 9864 | 609 | 95.8 | globlastp |
| 3028 | LYD466 ambrosia\|11v1\|SRR346943.109747_P1 | 9865 | 609 | 95.8 | globlastp |
| 3029 | LYD466 amsonia\|11v1\|SRR098688X106682_P1 | 9866 | 609 | 95.8 | globlastp |
| 3030 | LYD466 amsonia\|11v1\|SRR098688X115447_P1 | 9867 | 609 | 95.8 | globlastp |
| 3031 | LYD466 arnica\|11v1\|SRR099034X122814_P1 | 9864 | 609 | 95.8 | globlastp |
| 3032 | LYD466 arnica\|11v1\|SRR099034X125577_P1 | 9864 | 609 | 95.8 | globlastp |
| 3033 | LYD466 catharanthus\|11v1\|EG560575_P1 | 9868 | 609 | 95.8 | globlastp |
| 3034 | LYD466 cirsium\|11v1\|SRR346952.1037114_P1 | 9869 | 609 | 95.8 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 3035 | LYD466 cirsium\|11v1\|SRR346952.107984_P1 | 9870 | 609 | 95.8 | globlastp |
| 3036 | LYD466 clementine\|11v1\|CK665249_P1 | 9871 | 609 | 95.8 | globlastp |
| 3037 | LYD466 euonymus\|11v1\|SRR070038X509880_P1 | 9872 | 609 | 95.8 | globlastp |
| 3038 | LYD466 euphorbia\|11v1\|BP954359_P1 | 9873 | 609 | 95.8 | globlastp |
| 3039 | LYD466 euphorbia\|11v1\|BP961561_P1 | 9873 | 609 | 95.8 | globlastp |
| 3040 | LYD466 euphorbia\|11v1\|SRR098678X142028_P1 | 9873 | 609 | 95.8 | globlastp |
| 3041 | LYD466 flaveria\|11v1\|SRR149232.123466_P1 | 9874 | 609 | 95.8 | globlastp |
| 3042 | LYD466 flax\|11v1\|JG023418_P1 | 9875 | 609 | 95.8 | globlastp |
| 3043 | LYD466 fraxinus\|11v1\|SRR058827.112513_P1 | 9876 | 609 | 95.8 | globlastp |
| 3044 | LYD466 fraxinus\|11v1\|SRR058827.155166_P1 | 9876 | 609 | 95.8 | globlastp |
| 3045 | LYD466 fraxinus\|11v1\|SRR058827.199934_P1 | 9877 | 609 | 95.8 | globlastp |
| 3046 | LYD466 olea\|11v1\|SRR014464.48863_P1 | 9878 | 609 | 95.8 | globlastp |
| 3047 | LYD466 platanus\|11v1\|SRR096786X101281_P1 | 9879 | 609 | 95.8 | globlastp |
| 3048 | LYD466 scabiosa\|11v1\|SRR063723X112360_P1 | 9880 | 609 | 95.8 | globlastp |
| 3049 | LYD466 scabiosa\|11v1\|SRR063723X131858_P1 | 9880 | 609 | 95.8 | globlastp |
| 3050 | LYD466 tabernaemontana\|11v1\|SRR098689X114081_P1 | 9881 | 609 | 95.8 | globlastp |
| 3051 | LYD466 tomato\|11v1\|TOB6RPL_P1 | 9882 | 609 | 95.8 | globlastp |
| 3052 | LYD466 trigonella\|11v1\|SRR066194X104803_P1 | 9883 | 609 | 95.8 | globlastp |
| 3053 | LYD466 trigonella\|11v1\|SRR066194X108892_P1 | 9884 | 609 | 95.8 | globlastp |
| 3054 | LYD466 tripterygium\|11v1\|SRR098677X102042_P1 | 9885 | 609 | 95.8 | globlastp |
| 3055 | LYD466 acacia\|10v1\|GR480866_P1 | 9886 | 609 | 95.8 | globlastp |
| 3056 | LYD466 aquilegia\|10v2\|JGIAC020198_P1 | 9887 | 609 | 95.8 | globlastp |
| 3057 | LYD466 aristolochia\|10v1\|SRR039082S0084500_P1 | 9888 | 609 | 95.8 | globlastp |
| 3058 | LYD466 bean\|gb167\|CA897867_P1 | 9889 | 609 | 95.8 | globlastp |
| 3059 | LYD466 catharanthus\|gb166\|EG560575 | 9868 | 609 | 95.8 | globlastp |
| 3060 | LYD466 centaurea\|gb166\|EH741299_P1 | 9890 | 609 | 95.8 | globlastp |
| 3061 | LYD466 chickpea\|09v2\|GR391680_P1 | 9891 | 609 | 95.8 | globlastp |
| 3062 | LYD466 chickpea\|09v2\|GR408111_P1 | 9892 | 609 | 95.8 | globlastp |
| 3063 | LYD466 coffea\|10v1\|DV665302_P1 | 9893 | 609 | 95.8 | globlastp |
| 3064 | LYD466 cotton\|10v2\|BF278805_P1 | 9894 | 609 | 95.8 | globlastp |
| 3065 | LYD466 cynara\|gb167\|GE585895_P1 | 9895 | 609 | 95.8 | globlastp |
| 3066 | LYD466 dandelion\|10v1\|DQ160155_P1 | 9865 | 609 | 95.8 | globlastp |
| 3067 | LYD466 dandelion\|10v1\|DR399235_P1 | 9865 | 609 | 95.8 | globlastp |
| 3068 | LYD466 dandelion\|10v1\|DR401148_P1 | 9896 | 609 | 95.8 | globlastp |
| 3069 | LYD466 gerbera\|09v1\|AJ750117_P1 | 9897 | 609 | 95.8 | globlastp |
| 3070 | LYD466 gerbera\|09v1\|AJ756963_P1 | 9898 | 609 | 95.8 | globlastp |
| 3071 | LYD466 guizotia\|10v1\|GE557999_P1 | 9899 | 609 | 95.8 | globlastp |
| 3072 | LYD466 kiwi\|gb166\|FG412429_P1 | 9900 | 609 | 95.8 | globlastp |
| 3073 | LYD466 kiwi\|gb166\|FG422831_P1 | 9901 | 609 | 95.8 | globlastp |
| 3074 | LYD466 lettuce\|10v1\|DW045460_P1 | 9865 | 609 | 95.8 | globlastp |
| 3075 | LYD466 lettuce\|10v1\|DW050381_P1 | 9865 | 609 | 95.8 | globlastp |
| 3076 | LYD466 lettuce\|10v1\|DW056327_P1 | 9896 | 609 | 95.8 | globlastp |
| 3077 | LYD466 lettuce\|10v1\|DW078130_P1 | 9865 | 609 | 95.8 | globlastp |
| 3078 | LYD466 lotus\|09v1\|AI967492_P1 | 9902 | 609 | 95.8 | globlastp |
| 3079 | LYD466 medicago\|09v1\|LLAW328958_P1 | 9903 | 609 | 95.8 | globlastp |
| 3080 | LYD466 monkeyflower\|10v1\|DV206096_P1 | 9904 | 609 | 95.8 | globlastp |
| 3081 | LYD466 orobanche\|10v1\|SRR023189S0018550_P1 | 9905 | 609 | 95.8 | globlastp |
| 3082 | LYD466 papaya\|gb165\|EX283981_P1 | 9906 | 609 | 95.8 | globlastp |
| 3083 | LYD466 pea\|09v1\|CD860560 | 9891 | 609 | 95.8 | globlastp |
| 3084 | LYD466 pea\|11v1\|CD860560_P1 | 9891 | 609 | 95.8 | globlastp |
| 3085 | LYD466 pepper\|gb171\|BM065210_P1 | 9907 | 609 | 95.8 | globlastp |
| 3086 | LYD466 petunia\|gb171\|CV292770_P1 | 9908 | 609 | 95.8 | globlastp |
| 3087 | LYD466 potato\|10v1\|BG590201_P1 | 9909 | 609 | 95.8 | globlastp |
| 3088 | LYD466 potato\|10v1\|BG597356_P1 | 9910 | 609 | 95.8 | globlastp |
| 3089 | LYD466 prunus\|10v1\|BU043944 | 9911 | 609 | 95.8 | globlastp |
| 3090 | LYD466 rose\|10v1\|EC586485 | 9912 | 609 | 95.8 | globlastp |
| 3091 | LYD466 solanum_phureja\|09v1\|SPHBG123236 | 9909 | 609 | 95.8 | globlastp |
| 3092 | LYD466 solanum_phureja\|09v1\|SPHBG124377 | 9910 | 609 | 95.8 | globlastp |
| 3093 | LYD466 solanum_phureja\|09v1\|SPHBG129941 | 9913 | 609 | 95.8 | globlastp |
| 3094 | LYD466 strawberry\|11v1\|EX671725 | 9914 | 609 | 95.8 | globlastp |
| 3095 | LYD466 sunflower\|10v1\|CD848121 | 9915 | 609 | 95.8 | globlastp |
| 3096 | LYD466 sunflower\|10v1\|CD851684 | 9916 | 609 | 95.8 | globlastp |
| 3097 | LYD466 tobacco\|gb162\|CV016534 | 9917 | 609 | 95.8 | globlastp |
| 3098 | LYD466 tomato\|09v1\|BG129941 | 9882 | 609 | 95.8 | globlastp |
| 3099 | LYD466 triphysaria\|10v1\|DR173191 | 9918 | 609 | 95.8 | globlastp |
| 3100 | LYD466 eggplant\|10v1\|FS011818_P1 | 9919 | 609 | 95.1 | globlastp |
| 3101 | LYD466 ambrosia\|11v1\|SRR346935.32223_P1 | 9920 | 609 | 95.0 | globlastp |
| 3102 | LYD466 ambrosia\|11v1\|SRR346946.152229_P1 | 9921 | 609 | 95.0 | globlastp |
| 3103 | LYD466 arnica\|11v1\|SRR099034X110065_T1 | 9922 | 609 | 95.0 | glotblastn |
| 3104 | LYD466 catharanthus\|11v1\|EG561156_P1 | 9923 | 609 | 95.0 | globlastp |
| 3105 | LYD466 catharanthus\|11v1\|SRR098691X100213_P1 | 9924 | 609 | 95.0 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 3106 | LYD466 cirsium\|11v1\|SRR346952.1018707_P1 | 9925 | 609 | 95.0 | globlastp |
| 3107 | LYD466 euonymus\|11v1\|SRR070038X10352_P1 | 9926 | 609 | 95.0 | globlastp |
| 3108 | LYD466 euonymus\|11v1\|SRR070038X107613_P1 | 9926 | 609 | 95.0 | globlastp |
| 3109 | LYD466 euonymus\|11v1\|SRR070038X115885_P1 | 9926 | 609 | 95.0 | globlastp |
| 3110 | LYD466 euonymus\|11v1\|SRR070038X191281_P1 | 9927 | 609 | 95.0 | globlastp |
| 3111 | LYD466 euphorbia\|11v1\|DV116308_P1 | 9928 | 609 | 95.0 | globlastp |
| 3112 | LYD466 euphorbia\|11v1\|DV117602_P1 | 9928 | 609 | 95.0 | globlastp |
| 3113 | LYD466 flaveria\|11v1\|SRR149229.154397_P1 | 9921 | 609 | 95.0 | globlastp |
| 3114 | LYD466 flaveria\|11v1\|SRR149229.168348_P1 | 9929 | 609 | 95.0 | globlastp |
| 3115 | LYD466 flaveria\|11v1\|SRR149244.128380_P1 | 9921 | 609 | 95.0 | globlastp |
| 3116 | LYD466 flaveria\|11v1\|SRR149244.363711_T1 | 9930 | 609 | 95.0 | glotblastn |
| 3117 | LYD466 flax\|11v1\|JG023203_P1 | 9931 | 609 | 95.0 | globlastp |
| 3118 | LYD466 flax\|11v1\|JG031097_P1 | 9932 | 609 | 95.0 | globlastp |
| 3119 | LYD466 flax\|11v1\|JG095374_P1 | 9931 | 609 | 95.0 | globlastp |
| 3120 | LYD466 fraxinus\|11v1\|SRR058827.109128_P1 | 9933 | 609 | 95.0 | globlastp |
| 3121 | LYD466 fraxinus\|11v1\|SRR058827.138818_P1 | 9934 | 609 | 95.0 | globlastp |
| 3122 | LYD466 fraxinus\|11v1\|SRR058827.162993_P1 | 9935 | 609 | 95.0 | globlastp |
| 3123 | LYD466 fraxinus\|11v1\|SRR058827.22962_P1 | 9936 | 609 | 95.0 | globlastp |
| 3124 | LYD466 olea\|11v1\|SRR014463.59393_P1 | 9933 | 609 | 95.0 | globlastp |
| 3125 | LYD466 pea\|11v1\|PSU10047_P1 | 9937 | 609 | 95.0 | globlastp |
| 3126 | LYD466 phyla\|11v2\|SRR099035X109229_P1 | 9938 | 609 | 95.0 | globlastp |
| 3127 | LYD466 phyla\|11v2\|SRR099037X132753XX1_P1 | 9939 | 609 | 95.0 | globlastp |
| 3128 | LYD466 plantago\|11v1\|SRR066373X1005_P1 | 9940 | 609 | 95.0 | globlastp |
| 3129 | LYD466 plantago\|11v1\|SRR066373X105321_P1 | 9941 | 609 | 95.0 | globlastp |
| 3130 | LYD466 sarracenia\|11v1\|SRR192669.115424XX1_P1 | 9942 | 609 | 95.0 | globlastp |
| 3131 | LYD466 scabiosa\|11v1\|SRR063723X112852_P1 | 9943 | 609 | 95.0 | globlastp |
| 3132 | LYD466 scabiosa\|11v1\|SRR063723X114440_P1 | 9943 | 609 | 95.0 | globlastp |
| 3133 | LYD466 thalictrum\|11v1\|SRR096787X121276_P1 | 9944 | 609 | 95.0 | globlastp |
| 3134 | LYD466 tomato\|11v1\|BG123236_P1 | 9945 | 609 | 95.0 | globlastp |
| 3135 | LYD466 tripterygium\|11v1\|SRR098677X101173_P1 | 9946 | 609 | 95.0 | globlastp |
| 3136 | LYD466 vinca\|11v1\|SRR098690X106248_P1 | 9947 | 609 | 95.0 | globlastp |
| 3137 | LYD466 vinca\|11v1\|SRR098690X112349_P1 | 9948 | 609 | 95.0 | globlastp |
| 3138 | LYD466 vinca\|11v1\|SRR098690X114203_P1 | 9923 | 609 | 95.0 | globlastp |
| 3139 | LYD466 antirrhinum\|gb166\|AJ558542_P1 | 9949 | 609 | 95.0 | globlastp |
| 3140 | LYD466 antirrhinum\|gb166\|AJ559402_P1 | 9950 | 609 | 95.0 | globlastp |
| 3141 | LYD466 aquilegia\|10v2\|JGIAC008518_P1 | 9951 | 609 | 95.0 | globlastp |
| 3142 | LYD466 artemisia\|10v1\|EY033427_P1 | 9952 | 609 | 95.0 | globlastp |
| 3143 | LYD466 artemisia\|10v1\|EY043212_P1 | 9953 | 609 | 95.0 | globlastp |
| 3144 | LYD466 banana\|10v1\|FL649878_P1 | 9954 | 609 | 95.0 | globlastp |
| 3145 | LYD466 castorbean\|09v1\|AM267451 | 9955 | 609 | 95.0 | globlastp |
| 3146 | LYD466 castorbean\|11v1\|T14866_P1 | 9955 | 609 | 95.0 | globlastp |
| 3147 | LYD466 catharanthus\|gb166\|CX119705 | 9923 | 609 | 95.0 | globlastp |
| 3148 | LYD466 catharanthus\|gb166\|FD420757 | 9924 | 609 | 95.0 | globlastp |
| 3149 | LYD466 citrus\|gb166\|CK665249_P1 | 9956 | 609 | 95.0 | globlastp |
| 3150 | LYD466 coffea\|10v1\|DV665604_P1 | 9957 | 609 | 95.0 | globlastp |
| 3151 | LYD466 cotton\|10v2\|BE054921_P1 | 9958 | 609 | 95.0 | globlastp |
| 3152 | LYD466 cotton\|10v2\|BF274382_P1 | 9959 | 609 | 95.0 | globlastp |
| 3153 | LYD466 cotton\|10v2\|SRR032878S0109146XX1_P1 | 9959 | 609 | 95.0 | globlastp |
| 3154 | LYD466 cotton\|10v2\|SRR032880S0007101_P1 | 9960 | 609 | 95.0 | globlastp |
| 3155 | LYD466 cowpea\|gb166\|FF546625_P1 | 9961 | 609 | 95.0 | globlastp |
| 3156 | LYD466 dandelion\|10v1\|DR398599_P1 | 9962 | 609 | 95.0 | globlastp |
| 3157 | LYD466 eggplant\|10v1\|FS007663_P1 | 9963 | 609 | 95.0 | globlastp |
| 3158 | LYD466 eucalyptus\|gb166\|CD670009 | 9964 | 609 | 95.0 | glotblastn |
| 3159 | LYD466 gerbera\|09v1\|AJ750464_P1 | 9965 | 609 | 95.0 | globlastp |
| 3160 | LYD466 guizotia\|10v1\|GE565909_P1 | 9966 | 609 | 95.0 | globlastp |
| 3161 | LYD466 iceplant\|gb164\|BE033619_P1 | 9967 | 609 | 95.0 | globlastp |
| 3162 | LYD466 kiwi\|gb166\|FG414714_P1 | 9968 | 609 | 95.0 | globlastp |
| 3163 | LYD466 lettuce\|10v1\|DW044860_P1 | 9969 | 609 | 95.0 | globlastp |
| 3164 | LYD466 lettuce\|10v1\|DW076953_P1 | 9970 | 609 | 95.0 | globlastp |
| 3165 | LYD466 monkeyflower\|10v1\|CV521479_P1 | 9971 | 609 | 95.0 | globlastp |
| 3166 | LYD466 monkeyflower\|10v1\|DV210095_P1 | 9972 | 609 | 95.0 | globlastp |
| 3167 | LYD466 nasturtium\|10v1\|GH166126 | 9973 | 609 | 95.0 | globlastp |
| 3168 | LYD466 nicotiana_benthamiana\|gb162\|ES887594_P1 | 9974 | 609 | 95.0 | globlastp |
| 3169 | LYD466 pea\|09v1\|PSU10047 | 9937 | 609 | 95.0 | globlastp |
| 3170 | LYD466 petunia\|gb171\|CV294109_P1 | 9975 | 609 | 95.0 | globlastp |
| 3171 | LYD466 petunia\|gb171\|DC240417_P1 | 9976 | 609 | 95.0 | globlastp |
| 3172 | LYD466 prunus\|10v1\|BU042353 | 9977 | 609 | 95.0 | globlastp |
| 3173 | LYD466 sesame\|10v1\|BU669488 | 9978 | 609 | 95.0 | globlastp |
| 3174 | LYD466 soybean\|11v1\|GLYMA08G41280 | 9979 | 609 | 95.0 | globlastp |
| 3175 | LYD466 soybean\|11v1\|GLYMA18G14980 | 9980 | 609 | 95.0 | globlastp |
| 3176 | LYD466 spurge\|gb161\|DV116308 | 9928 | 609 | 95.0 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 3177 | LYD466 sunflower\|10v1\|CD850130 | 9921 | 609 | 95.0 | globlastp |
| 3178 | LYD466 tomato\|09v1\|BG123236 | 9945 | 609 | 95.0 | globlastp |
| 3179 | LYD466 triphysaria\|10v1\|BE574817 | 9981 | 609 | 95.0 | globlastp |
| 3180 | LYD466 triphysaria\|10v1\|EX985120 | 9982 | 609 | 95.0 | globlastp |
| 3181 | LYD466 fraxinus\|11v1\|SRR058827.128040_T1 | — | 609 | 95.0 | glotblastn |
| 3182 | LYD466 ambrosia\|11v1\|SRR346943.181135XX1_P1 | 9983 | 609 | 94.2 | globlastp |
| 3183 | LYD466 amorphophallus\|11v2\|SRR089351X106208_P1 | 9984 | 609 | 94.2 | globlastp |
| 3184 | LYD466 amorphophallus\|11v2\|SRR089351X125311_P1 | 9985 | 609 | 94.2 | globlastp |
| 3185 | LYD466 euonymus\|11v1\|SRR070038X10972_P1 | 9986 | 609 | 94.2 | globlastp |
| 3186 | LYD466 flaveria\|11v1\|SRR149229.144499_P1 | 9987 | 609 | 94.2 | globlastp |
| 3187 | LYD466 flax\|11v1\|GW864813_P1 | 9988 | 609 | 94.2 | globlastp |
| 3188 | LYD466 flax\|11v1\|JG032437_P1 | 9988 | 609 | 94.2 | globlastp |
| 3189 | LYD466 flax\|11v1\|JG036980_P1 | 9988 | 609 | 94.2 | globlastp |
| 3190 | LYD466 flax\|11v1\|JG106265_P1 | 9988 | 609 | 94.2 | globlastp |
| 3191 | LYD466 humulus\|11v1\|ES654081_P1 | 9989 | 609 | 94.2 | globlastp |
| 3192 | LYD466 humulus\|11v1\|EX515678_P1 | 9990 | 609 | 94.2 | globlastp |
| 3193 | LYD466 plantago\|11v1\|SRR066373X112214_P1 | 9991 | 609 | 94.2 | globlastp |
| 3194 | LYD466 silene\|11v1\|GH292442_P1 | 9992 | 609 | 94.2 | globlastp |
| 3195 | LYD466 silene\|11v1\|SRR096785X10017_P1 | 9992 | 609 | 94.2 | globlastp |
| 3196 | LYD466 silene\|11v1\|SRR096785X106520_P1 | 9992 | 609 | 94.2 | globlastp |
| 3197 | LYD466 vinca\|11v1\|SRR098690X107741_P1 | 9993 | 609 | 94.2 | globlastp |
| 3198 | LYD466 amborella\|gb166\|CK750154_P1 | 9994 | 609 | 94.2 | globlastp |
| 3199 | LYD466 apple\|11v1\|CN443945_P1 | 9995 | 609 | 94.2 | globlastp |
| 3200 | LYD466 apple\|gb171\|CN443945 | 9995 | 609 | 94.2 | globlastp |
| 3201 | LYD466 avocado\|10v1\|CK767109_P1 | 9996 | 609 | 94.2 | globlastp |
| 3202 | LYD466 avocado\|10v1\|DT592051_P1 | 9997 | 609 | 94.2 | globlastp |
| 3203 | LYD466 banana\|10v1\|FF558891_P1 | 9998 | 609 | 94.2 | globlastp |
| 3204 | LYD466 beet\|gb162\|BF011200_P1 | 9999 | 609 | 94.2 | globlastp |
| 3205 | LYD466 beet\|gb162\|BQ592290_P1 | 10000 | 609 | 94.2 | globlastp |
| 3206 | LYD466 centaurea\|gb166\|EH741072_P1 | 10001 | 609 | 94.2 | globlastp |
| 3207 | LYD466 centaurea\|gb166\|EH788075_P1 | 10002 | 609 | 94.2 | globlastp |
| 3208 | LYD466 cotton\|10v2\|DR456115_P1 | 10003 | 609 | 94.2 | globlastp |
| 3209 | LYD466 curcuma\|10v1\|DY389480_P1 | 10004 | 609 | 94.2 | globlastp |
| 3210 | LYD466 flax\|09v1\|EU830206 | 9988 | 609 | 94.2 | globlastp |
| 3211 | LYD466 flax\|11v1\|EU830206_P1 | 9988 | 609 | 94.2 | globlastp |
| 3212 | LYD466 iceplant\|gb164\|BM300151_P1 | 10005 | 609 | 94.2 | globlastp |
| 3213 | LYD466 monkeyflower\|10v1\|DV207094_P1 | 10006 | 609 | 94.2 | globlastp |
| 3214 | LYD466 nicotiana_benthamiana\|gb162\|EH364881_P1 | 10007 | 609 | 94.2 | globlastp |
| 3215 | LYD466 tobacco\|gb162\|BQ842868 | 10008 | 609 | 94.2 | globlastp |
| 3216 | LYD466 tobacco\|gb162\|TOB6RPL | 10009 | 609 | 94.2 | globlastp |
| 3217 | LYD466 triphysaria\|10v1\|BM357574 | 10010 | 609 | 94.2 | globlastp |
| 3218 | LYD466 triphysaria\|10v1\|EX988172 | 10011 | 609 | 94.2 | globlastp |
| 3219 | LYD466 triphysaria\|10v1\|EX993123 | 10012 | 609 | 94.2 | globlastp |
| 3220 | LYD466 pteridium\|11v1\|SRR043594X101690_T1 | 10013 | 609 | 94.2 | glotblastn |
| 3221 | LYD466 antirrhinum\|gb166\|AJ559698_T1 | 10014 | 609 | 94.2 | glotblastn |
| 3222 | LYD466 ginger\|gb164\|DY345132_T1 | 10015 | 609 | 94.2 | glotblastn |
| 3223 | LYD466 cucurbita\|11v1\|SRR091276X109737_P1 | 10016 | 609 | 93.4 | globlastp |
| 3224 | LYD466 ginger\|gb164\|DY369183_P1 | 10017 | 609 | 93.4 | globlastp |
| 3225 | LYD466 orobanche\|10v1\|SRR023189S0023963_P1 | 10018 | 609 | 93.4 | globlastp |
| 3226 | LYD466 flax\|11v1\|JG135899_T1 | 10019 | 609 | 93.3 | glotblastn |
| 3227 | LYD466 heritiera\|10v1\|SRR005795S0064531_T1 | 10020 | 609 | 93.3 | glotblastn |
| 3228 | LYD466 ipomoea_nil\|10v1\|BJ555491_T1 | 10021 | 609 | 93.3 | glotblastn |
| 3229 | LYD466 flax\|11v1\|JG029702_P1 | 10022 | 609 | 93.3 | globlastp |
| 3230 | LYD466 fraxinus\|11v1\|SRR058827.130137_P1 | 10023 | 609 | 93.3 | globlastp |
| 3231 | LYD466 silene\|11v1\|GH293781_P1 | 10024 | 609 | 93.3 | globlastp |
| 3232 | LYD466 tripterygium\|11v1\|SRR098677X118539_P1 | 10025 | 609 | 93.3 | globlastp |
| 3233 | LYD466 valeriana\|11v1\|SRR099039X100858_P1 | 10026 | 609 | 93.3 | globlastp |
| 3234 | LYD466 valeriana\|11v1\|SRR099039X105788_P1 | 10026 | 609 | 93.3 | globlastp |
| 3235 | LYD466 vinca\|11v1\|SRR098690X187529_P1 | 10027 | 609 | 93.3 | globlastp |
| 3236 | LYD466 banana\|10v1\|FL659202_P1 | 10028 | 609 | 93.3 | globlastp |
| 3237 | LYD466 basilicum\|10v1\|DY342675_P1 | 10029 | 609 | 93.3 | globlastp |
| 3238 | LYD466 beet\|gb162\|BQ587673_P1 | 10030 | 609 | 93.3 | globlastp |
| 3239 | LYD466 millet\|10v1\|CD725510_P1 | 10031 | 609 | 93.3 | globlastp |
| 3240 | LYD466 nasturtium\|10v1\|GH164367 | 10032 | 609 | 93.3 | globlastp |
| 3241 | LYD466 nasturtium\|10v1\|SRR032558S0034221 | 10033 | 609 | 93.3 | globlastp |
| 3242 | LYD466 pineapple\|10v1\|DT335779_P1 | 10034 | 609 | 93.3 | globlastp |
| 3243 | LYD466 tamarix\|gb166\|EH050924 | 10035 | 609 | 93.3 | globlastp |
| 3244 | LYD466 apple\|11v1\|CN879530_P1 | 10036 | 609 | 92.7 | globlastp |
| 3245 | LYD466 apple\|gb171\|CN879530 | 10036 | 609 | 92.7 | globlastp |
| 3246 | LYD466 chelidonium\|11v1\|SRR084752X102887_P1 | 10037 | 609 | 92.6 | globlastp |
| 3247 | LYD466 apple\|11v1\|CN493979_P1 | 10038 | 609 | 92.6 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 3248 | LYD466 apple\|gb171\|CN493979 | 10038 | 609 | 92.6 | globlastp |
| 3249 | LYD466 tea\|10v1\|CV013646 | 10039 | 609 | 92.6 | globlastp |
| 3250 | LYD466 orobanche\|10v1\|SRR023189S0005952_T1 | — | 609 | 92.6 | glotblastn |
| 3251 | LYD466 cannabis\|12v1\|SOLX00031938_P1 | 10040 | 609 | 92.5 | globlastp |
| 3252 | LYD466 cannabis\|12v1\|SOLX00060787_P1 | 10040 | 609 | 92.5 | globlastp |
| 3253 | LYD466 chelidonium\|11v1\|SRR084752X103339_P1 | 10041 | 609 | 92.5 | globlastp |
| 3254 | LYD466 fagopyrum\|11v1\|SRR063689X100103_P1 | 10042 | 609 | 92.5 | globlastp |
| 3255 | LYD466 fagopyrum\|11v1\|SRR063689X14726_P1 | 10043 | 609 | 92.5 | globlastp |
| 3256 | LYD466 fagopyrum\|11v1\|SRR063703X100631_P1 | 10043 | 609 | 92.5 | globlastp |
| 3257 | LYD466 flax\|11v1\|JG037856_P1 | 10044 | 609 | 92.5 | globlastp |
| 3258 | LYD466 fraxinus\|11v1\|SRR058827.130264_P1 | 10045 | 609 | 92.5 | globlastp |
| 3259 | LYD466 phalaenopsis\|11v1\|CK857186_P1 | 10046 | 609 | 92.5 | globlastp |
| 3260 | LYD466 primula\|11v1\|SRR098679X103059_T1 | 10047 | 609 | 92.5 | glotblastn |
| 3261 | LYD466 sarracenia\|11v1\|SRR192669.108867_P1 | 10048 | 609 | 92.5 | globlastp |
| 3262 | LYD466 utricularia\|11v1\|SRR094438.108088_P1 | 10049 | 609 | 92.5 | globlastp |
| 3263 | LYD466 valeriana\|11v1\|SRR099039X103096_P1 | 10050 | 609 | 92.5 | globlastp |
| 3264 | LYD466 artemisia\|10v1\|EY048995_P1 | 10051 | 609 | 92.5 | globlastp |
| 3265 | LYD466 banana\|10v1\|FL662344_P1 | 10052 | 609 | 92.5 | globlastp |
| 3266 | LYD466 cleome_gynandra\|10v1\|SRR015532S0002556_P1 | 10053 | 609 | 92.5 | globlastp |
| 3267 | LYD466 cleome_gynandra\|10v1\|SRR015532S0018406_P1 | 10054 | 609 | 92.5 | globlastp |
| 3268 | LYD466 cleome_spinosa\|10v1\|SRR015531S0067386_P1 | 10055 | 609 | 92.5 | globlastp |
| 3269 | LYD466 eschscholzia\|10v1\|CD480276 | 10056 | 609 | 92.5 | globlastp |
| 3270 | LYD466 kiwi\|gb166\|FG419070_P1 | 10057 | 609 | 92.5 | globlastp |
| 3271 | LYD466 nicotiana_benthamiana\|gb162\|CN742494_P1 | 10058 | 609 | 92.5 | globlastp |
| 3272 | LYD466 strawberry\|11v1\|DV438433 | 10059 | 609 | 92.5 | globlastp |
| 3273 | LYD466 zinnia\|gb171\|AU305312 | 10060 | 609 | 92.5 | glotblastn |
| 3274 | LYD466 apple\|11v1\|CN579382_P1 | 10061 | 609 | 91.9 | globlastp |
| 3275 | LYD466 apple\|gb171\|CN579382 | 10061 | 609 | 91.9 | globlastp |
| 3276 | LYD466 fagopyrum\|11v1\|SRR063689X10183_P1 | 10062 | 609 | 91.7 | globlastp |
| 3277 | LYD466 fagopyrum\|11v1\|SRR063703X102368_P1 | 10062 | 609 | 91.7 | globlastp |
| 3278 | LYD466 fagopyrum\|11v1\|SRR063703X107830_P1 | 10062 | 609 | 91.7 | globlastp |
| 3279 | LYD466 phalaenopsis\|11v1\|SRR125771.1010654_P1 | 10063 | 609 | 91.7 | globlastp |
| 3280 | LYD466 silene\|11v1\|SRR096785X104821_P1 | 10064 | 609 | 91.7 | globlastp |
| 3281 | LYD466 thellungiella_parvulum\|11v1\|BM985665_P1 | 10065 | 609 | 91.7 | globlastp |
| 3282 | LYD466 arabidopsis_lyrata\|09v1\|JGIAL002665_P1 | 10066 | 609 | 91.7 | globlastp |
| 3283 | LYD466 arabidopsis_lyrata\|09v1\|JGIAL007167_P1 | 10067 | 609 | 91.7 | globlastp |
| 3284 | LYD466 arabidopsis\|10v1\|AT1G26880_P1 | 10066 | 609 | 91.7 | globlastp |
| 3285 | LYD466 banana\|10v1\|FL651470_P1 | 10068 | 609 | 91.7 | globlastp |
| 3286 | LYD466 bruguiera\|gb166\|BP946784_P1 | 10069 | 609 | 91.7 | globlastp |
| 3287 | LYD466 eschscholzia\|10v1\|SRR014116S0009486 | 10070 | 609 | 91.7 | globlastp |
| 3288 | LYD466 foxtail_millet\|10v2\|SICRP010306 | 10071 | 609 | 91.7 | globlastp |
| 3289 | LYD466 foxtail_millet\|11v3\|PHY7SI014672M_P1 | 10071 | 609 | 91.7 | globlastp |
| 3290 | LYD466 lolium\|10v1\|ES699501_P1 | 10072 | 609 | 91.7 | globlastp |
| 3291 | LYD466 maize\|10v1\|AI665168_P1 | 10073 | 609 | 91.7 | globlastp |
| 3292 | LYD466 millet\|10v1\|EB410932_P1 | 10074 | 609 | 91.7 | globlastp |
| 3293 | LYD466 nuphar\|gb166\|CK750236_P1 | 10075 | 609 | 91.7 | globlastp |
| 3294 | LYD466 oil_palm\|gb166\|EL682504_P1 | 10076 | 609 | 91.7 | globlastp |
| 3295 | LYD466 papaya\|gb165\|EX228263P1 | 10077 | 609 | 91.7 | globlastp |
| 3296 | LYD466 rice\|gb170\|OS09G24690 | 10078 | 609 | 91.7 | globlastp |
| 3297 | LYD466 sorghum\|09v1\|SB07G003770 | 10071 | 609 | 91.7 | globlastp |
| 3298 | LYD466 sorghum\|11v1\|SB07G003770_P1 | 10071 | 609 | 91.7 | globlastp |
| 3299 | LYD466 switchgrass\|gb167\|DN142201 | 10079 | 609 | 91.7 | globlastp |
| 3300 | LYD466 switchgrass\|gb167\|FE606301 | 10079 | 609 | 91.7 | globlastp |
| 3301 | LYD466 switchgrass\|gb167\|FE608833 | 10071 | 609 | 91.7 | globlastp |
| 3302 | LYD466 switchgrass\|gb167\|FE641195 | 10071 | 609 | 91.7 | globlastp |
| 3303 | LYD466 tamarix\|gb166\|CF198906 | 10080 | 609 | 91.7 | globlastp |
| 3304 | LYD466 zamia\|gb166\|DY033077 | 10081 | 609 | 91.7 | globlastp |
| 3305 | LYD466 humulus\|11v1\|SRR098683X131447_T1 | 10082 | 609 | 91.7 | glotblastn |
| 3306 | LYD466 phyla\|11v2\|SRR099037X15202_T1 | 10083 | 609 | 91.7 | glotblastn |
| 3307 | LYD466 curcuma\|10v1\|DY384916_T1 | 10084 | 609 | 91.7 | glotblastn |
| 3308 | LYD466 iceplant\|gb164\|BE034528_T1 | 10085 | 609 | 90.8 | glotblastn |
| 3309 | LYD466 kiwi\|gb166\|FG489451_T1 | 10086 | 609 | 90.8 | glotblastn |
| 3310 | LYD466 canola\|11v1\|CN729041_T1 | 10087 | 609 | 90.8 | glotblastn |
| 3311 | LYD466 b_oleracea\|gb161\|DY027255_T1 | — | 609 | 90.8 | glotblastn |
| 3312 | LYD466 foxtail_millet\|11v3\|PHY7SI011205M_P1 | 10088 | 609 | 90.8 | globlastp |
| 3313 | LYD466 oat\|11v1\|CN815407_P1 | 10089 | 609 | 90.8 | globlastp |
| 3314 | LYD466 oat\|11v1\|GO587489_P1 | 10090 | 609 | 90.8 | globlastp |
| 3315 | LYD466 thellungiella_halophilum\|11v1\|BM985665_P1 | 10091 | 609 | 90.8 | globlastp |
| 3316 | LYD466 thellungiella_halophilum\|11v1\|EHJGI11006410_P1 | 10092 | 609 | 90.8 | globlastp |
| 3317 | LYD466 utricularia\|11v1\|SRR094438.10278_P1 | 10093 | 609 | 90.8 | globlastp |
| 3318 | LYD466 arabidopsis\|10v1\|AT1G69620_P1 | 10094 | 609 | 90.8 | globlastp |

TABLE 54-continued

Homologous polynucleotides and polypeptides which can increase plant yield, seed
yield, oil yield, oil content, growth rate, fiber yield, fiber quality, biomass, vigor,
ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 3319 | LYD466 b_juncea\|10v2\|E6ANDIZ01A85WV_P1 | 10095 | 609 | 90.8 | globlastp |
| 3320 | LYD466 b_rapa\|gb162\|CV432313_P1 | 10095 | 609 | 90.8 | globlastp |
| 3321 | LYD466 b_rapa\|gb162\|EX015446_P1 | 10095 | 609 | 90.8 | globlastp |
| 3322 | LYD466 barley\|10v2\|BE213979_P1 | 10096 | 609 | 90.8 | globlastp |
| 3323 | LYD466 canola\|10v1\|CD811629 | 10095 | 609 | 90.8 | globlastp |
| 3324 | LYD466 canola\|10v1\|CD820310 | 10095 | 609 | 90.8 | globlastp |
| 3325 | LYD466 canola\|10v1\|EE502392 | 10097 | 609 | 90.8 | globlastp |
| 3326 | LYD466 canola\|11v1\|EE502392_P1 | 10097 | 609 | 90.8 | globlastp |
| 3327 | LYD466 cenchrus\|gb166\|EB652499_P1 | 10098 | 609 | 90.8 | globlastp |
| 3328 | LYD466 cleome_gynandra\|10v1\|SRR015532S0018831_P1 | 10099 | 609 | 90.8 | globlastp |
| 3329 | LYD466 cynodon\|10v1\|ES296047_P1 | 10100 | 609 | 90.8 | globlastp |
| 3330 | LYD466 fescue\|gb161\|DT689471_P1 | 10090 | 609 | 90.8 | globlastp |
| 3331 | LYD466 fescue\|gb161\|DT705028_P1 | 10101 | 609 | 90.8 | globlastp |
| 3332 | LYD466 foxtail_millet\|10v2\|OXFXTSLX00002448D1T1 | 10098 | 609 | 90.8 | globlastp |
| 3333 | LYD466 foxtail_millet\|11v3\|PHY7SI032704M_P1 | 10098 | 609 | 90.8 | globlastp |
| 3334 | LYD466 lovegrass\|gb167\|DN481127_P1 | 10100 | 609 | 90.8 | globlastp |
| 3335 | LYD466 maize\|10v1\|AI668539_P1 | 10102 | 609 | 90.8 | globlastp |
| 3336 | LYD466 maize\|10v1\|AI901491_P1 | 10103 | 609 | 90.8 | globlastp |
| 3337 | LYD466 millet\|10v1\|EVO454PM050725_P1 | 10104 | 609 | 90.8 | globlastp |
| 3338 | LYD466 nuphar\|gb166\|CD475058_P1 | 10105 | 609 | 90.8 | globlastp |
| 3339 | LYD466 oat\|10v2\|CN815407 | 10089 | 609 | 90.8 | globlastp |
| 3340 | LYD466 oat\|10v2\|GO587489 | 10090 | 609 | 90.8 | globlastp |
| 3341 | LYD466 oat\|11v1\|GO588768_P1 | 10090 | 609 | 90.8 | globlastp |
| 3342 | LYD466 poppy\|gb166\|FE964496_P1 | 10106 | 609 | 90.8 | globlastp |
| 3343 | LYD466 rose\|10v1\|EC586444 | 10107 | 609 | 90.8 | globlastp |
| 3344 | LYD466 sorghum\|09v1\|SB07G021410_P1 | 10108 | 609 | 90.8 | globlastp |
| 3345 | LYD466 sorghum\|11v1\|SB07G021410_P1 | 10108 | 609 | 90.8 | globlastp |
| 3346 | LYD466 sugarcane\|10v1\|BQ535353 | 10108 | 609 | 90.8 | globlastp |
| 3347 | LYD466 switchgrass\|gb167\|FE626801 | 10088 | 609 | 90.8 | globlastp |
| 3348 | LYD466 switchgrass\|gb167\|FL729319 | 10088 | 609 | 90.8 | globlastp |
| 3349 | LYD466 thellungiella\|gb167\|BM985665 | 10091 | 609 | 90.8 | globlastp |
| 3350 | LYD466 wheat\|10v2\|BE426547 | 10090 | 609 | 90.8 | globlastp |
| 3351 | LYD466 wheat\|10v2\|BE427371 | 10096 | 609 | 90.8 | globlastp |
| 3352 | LYD466 wheat\|10v2\|CA484908 | 10108 | 609 | 90.8 | globlastp |
| 3353 | LYD466 zostera\|10v1\|AM766443 | 10109 | 609 | 90.8 | globlastp |
| 3354 | LYD466 canola\|11v1\|CN737769XX1_P1 | 10110 | 609 | 90.0 | globlastp |
| 3355 | LYD466 canola\|11v1\|EE451365_P1 | 10110 | 609 | 90.0 | globlastp |
| 3356 | LYD466 canola\|11v1\|EG020375_P1 | 10111 | 609 | 90.0 | globlastp |
| 3357 | LYD466 canola\|11v1\|SRR329661.101532_P1 | 10110 | 609 | 90.0 | globlastp |
| 3358 | LYD466 oat\|11v1\|CN814739_P1 | 10112 | 609 | 90.0 | globlastp |
| 3359 | LYD466 arabidopsis\|10v1\|AT3G28900_P1 | 10113 | 609 | 90.0 | globlastp |
| 3360 | LYD466 b_juncea\|10v2\|E6ANDIZ01A4QS7_P1 | 10110 | 609 | 90.0 | globlastp |
| 3361 | LYD466 b_juncea\|10v2\|E6ANDIZ01ATREW_P1 | 10114 | 609 | 90.0 | globlastp |
| 3362 | LYD466 b_juncea\|10v2\|E6ANDIZ01BJG1O_P1 | 10115 | 609 | 90.0 | globlastp |
| 3363 | LYD466 b_oleracea\|gb161\|DY029440_P1 | 10110 | 609 | 90.0 | globlastp |
| 3364 | LYD466 b_oleracea\|gb161\|DY029567_P1 | 10110 | 609 | 90.0 | globlastp |
| 3365 | LYD466 b_rapa\|gb162\|AT002072_P1 | 10110 | 609 | 90.0 | globlastp |
| 3366 | LYD466 b_rapa\|gb162\|CA991923_P1 | 10110 | 609 | 90.0 | globlastp |
| 3367 | LYD466 b_rapa\|gb162\|CX268735_P1 | 10110 | 609 | 90.0 | globlastp |
| 3368 | LYD466 b_rapa\|gb162\|ES936659_P1 | 10115 | 609 | 90.0 | globlastp |
| 3369 | LYD466 b_rapa\|gb162\|L47940_P1 | 10110 | 609 | 90.0 | globlastp |
| 3370 | LYD466 barley\|10v2\|BE420950_P1 | 10116 | 609 | 90.0 | globlastp |
| 3371 | LYD466 barley\|10v2\|BE421373_P1 | 10117 | 609 | 90.0 | globlastp |
| 3372 | LYD466 canola\|10v1\|CD812261 | 10110 | 609 | 90.0 | globlastp |
| 3373 | LYD466 canola\|11v1\|CN730536_P1 | 10110 | 609 | 90.0 | globlastp |
| 3374 | LYD466 canola\|10v1\|CD812811 | 10110 | 609 | 90.0 | globlastp |
| 3375 | LYD466 canola\|11v1\|CN732346_P1 | 10110 | 609 | 90.0 | globlastp |
| 3376 | LYD466 canola\|10v1\|CD817148 | 10111 | 609 | 90.0 | globlastp |
| 3377 | LYD466 canola\|11v1\|EE457869_P1 | 10111 | 609 | 90.0 | globlastp |
| 3378 | LYD466 canola\|10v1\|CD822926 | 10110 | 609 | 90.0 | globlastp |
| 3379 | LYD466 canola\|11v1\|CN732484_P1 | 10110 | 609 | 90.0 | globlastp |
| 3380 | LYD466 canola\|10v1\|CN730618 | 10115 | 609 | 90.0 | globlastp |
| 3381 | LYD466 canola\|10v1\|CN734486 | 10115 | 609 | 90.0 | globlastp |
| 3382 | LYD466 canola\|11v1\|CN730618_P1 | 10115 | 609 | 90.0 | globlastp |
| 3383 | LYD466 cleome_spinosa\|10v1\|SRR015531S0010384_P1 | 10118 | 609 | 90.0 | globlastp |
| 3384 | LYD466 foxtail_millet\|10v2\|SICRP026937 | 10119 | 609 | 90.0 | globlastp |
| 3385 | LYD466 foxtail_millet\|11v3\|EC613306_P1 | 10119 | 609 | 90.0 | globlastp |
| 3386 | LYD466 lolium\|10v1\|AU250783_P1 | 10120 | 609 | 90.0 | globlastp |
| 3387 | LYD466 lovegrass\|gb167\|EH188905_P1 | 10121 | 609 | 90.0 | globlastp |
| 3388 | LYD466 maize\|10v1\|AI615141_P1 | 10122 | 609 | 90.0 | globlastp |
| 3389 | LYD466 maize\|10v1\|AI901307_P1 | 10123 | 609 | 90.0 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name  cluster name | Polyp. SEQ ID NO: | Hom to SEQ ID NO: | % glob. iden. | Algor. |
|---|---|---|---|---|---|
| 3390 | LYD466 oat\|10v2\|CN814739 | 10112 | 609 | 90.0 | globlastp |
| 3391 | LYD466 oat\|10v2\|CN817735 | 10120 | 609 | 90.0 | globlastp |
| 3392 | LYD466 oat\|11v1\|CN817735_P1 | 10120 | 609 | 90.0 | globlastp |
| 3393 | LYD466 pseudoroegneria\|gb167\|FF340771 | 10117 | 609 | 90.0 | globlastp |
| 3394 | LYD466 senecio\|gb170\|SRR006592S0003334 | 10124 | 609 | 90.0 | globlastp |
| 3395 | LYD466 sorghum\|09v1\|SB02G024610 | 10125 | 609 | 90.0 | globlastp |
| 3396 | LYD466 sorghum\|11v1\|SB02G024610_P1 | 10125 | 609 | 90.0 | globlastp |
| 3397 | LYD466 sugarcane\|10v1\|BQ536361 | 10126 | 609 | 90.0 | globlastp |
| 3398 | LYD466 switchgrass\|gb167\|FE629679 | 10127 | 609 | 90.0 | globlastp |
| 3399 | LYD466 switchgrass\|gb167\|FE638524 | 10127 | 609 | 90.0 | globlastp |
| 3400 | LYD466 tamarix\|gb166\|EG967245 | 10128 | 609 | 90.0 | glotblastn |
| 3401 | LYD466 wheat\|10v2\|BE429097 | 10116 | 609 | 90.0 | globlastp |
| 3402 | LYD466 zostera\|10v1\|SRR057351S0001505 | 10129 | 609 | 90.0 | globlastp |
| 3403 | LYD466 abies\|11v2\|SRR098676X117135_P1 | 10130 | 609 | 89.2 | globlastp |
| 3404 | LYD466 abies\|11v2\|SRR098676X140759XX2_P1 | 10131 | 609 | 89.2 | globlastp |
| 3405 | LYD466 canola\|11v1\|ES976955_P1 | 10132 | 609 | 89.2 | globlastp |
| 3406 | LYD466 canola\|11v1\|SRR341920.942381_P1 | 10132 | 609 | 89.2 | globlastp |
| 3407 | LYD466 flaveria\|11v1\|SRR149241.187612XX1_P1 | 10133 | 609 | 89.2 | globlastp |
| 3408 | LYD466 maritime_pine\|10v1\|BX680042_P1 | 10134 | 609 | 89.2 | globlastp |
| 3409 | LYD466 b_juncea\|10v2\|E6ANDIZ01AX4JX_P1 | 10135 | 609 | 89.2 | globlastp |
| 3410 | LYD466 b_juncea\|10v2\|E6ANDIZ01BJV8P_P1 | 10136 | 609 | 89.2 | globlastp |
| 3411 | LYD466 b_juncea\|10v2\|E6ANDIZ01BMIAL2_P1 | 10135 | 609 | 89.2 | globlastp |
| 3412 | LYD466 b_juncea\|10v2\|E6ANDIZ02G104G_P1 | 10137 | 609 | 89.2 | globlastp |
| 3413 | LYD466 brachypodium\|09v1\|DV477596_P1 | 10138 | 609 | 89.2 | globlastp |
| 3414 | LYD466 canola\|10v1\|DY006620 | 10139 | 609 | 89.2 | globlastp |
| 3415 | LYD466 canola\|11v1\|DY006620_P1 | 10139 | 609 | 89.2 | globlastp |
| 3416 | LYD466 canola\|10v1\|ES917673 | 10139 | 609 | 89.2 | globlastp |
| 3417 | LYD466 canola\|11v1\|ES917673_P1 | 10139 | 609 | 89.2 | globlastp |
| 3418 | LYD466 gnetum\|10v1\|SRR064399S0009119_P1 | 10140 | 609 | 89.2 | globlastp |
| 3419 | LYD466 pine\|10v2\|AW289731_P1 | 10130 | 609 | 89.2 | globlastp |
| 3420 | LYD466 poplar\|10v1\|NM002318742_P1 | 10141 | 609 | 89.2 | globlastp |
| 3421 | LYD466 rice\|gb170\|OS08G06040 | 10142 | 609 | 89.2 | globlastp |
| 3422 | LYD466 rice\|gb170\|OS08G33920 | 10143 | 609 | 89.2 | globlastp |
| 3423 | LYD466 rye\|gb164\|BE587146 | 10144 | 609 | 89.2 | globlastp |
| 3424 | LYD466 spruce\|gb162\|CO218416 | 10145 | 609 | 89.2 | globlastp |
| 3425 | LYD466 b_rapa\|gb162\|EX050031_T1 | 10146 | 609 | 89.2 | glotblastn |
| 3426 | LYD466 zostera\|10v1\|AM770964 | 10147 | 609 | 89.2 | glotblastn |
| 3427 | LYD466 poplar\|10v1\|XM002305594_P1 | 10148 | 609 | 88.4 | globlastp |
| 3428 | LYD466 flaveria\|11v1\|SRR149232.124853_T1 | 10149 | 609 | 88.3 | glotblastn |
| 3429 | LYD466 flaveria\|11v1\|SRR149232.14349_P1 | 10150 | 609 | 88.3 | globlastp |
| 3430 | LYD466 flaveria\|11v1\|SRR149240.379001XX1_P1 | 10150 | 609 | 88.3 | globlastp |
| 3431 | LYD466 thellungiella_halophilum\|11v1\|EHJGI11019261_P1 | 10151 | 609 | 88.3 | globlastp |
| 3432 | LYD466 brachypodium\|09v1\|DV470647_P1 | 10152 | 609 | 88.3 | globlastp |
| 3433 | LYD466 cycas\|gb166\|CB089723_P1 | 10153 | 609 | 88.3 | globlastp |
| 3434 | LYD466 cynodon\|10v1\|ES293313_P1 | 10154 | 609 | 88.3 | globlastp |
| 3435 | LYD466 kiwi\|gb166\|FG527795_P1 | 10155 | 609 | 88.3 | globlastp |
| 3436 | LYD466 onion\|gb162\|BE205663_P1 | 10156 | 609 | 88.3 | globlastp |
| 3437 | LYD466 peanut\|10v1\|SRR042413S0010874_P1 | 10157 | 609 | 88.3 | globlastp |
| 3438 | LYD466 pine\|10v2\|AW010336_P1 | 10158 | 609 | 88.3 | globlastp |
| 3439 | LYD466 pseudotsuga\|10v1\|SRR065119S0000181 | 10158 | 609 | 88.3 | globlastp |
| 3440 | LYD466 radish\|gb164\|EV525005 | 10159 | 609 | 88.3 | globlastp |
| 3441 | LYD466 radish\|gb164\|EV566975 | 10160 | 609 | 88.3 | globlastp |
| 3442 | LYD466 radish\|gb164\|EX754106 | 10161 | 609 | 88.3 | globlastp |
| 3443 | LYD466 radish\|gb164\|EY905161 | 10161 | 609 | 88.3 | globlastp |
| 3444 | LYD466 radish\|gb164\|T25172 | 10161 | 609 | 88.3 | globlastp |
| 3445 | LYD466 radish\|gb164\|T25177 | 10162 | 609 | 88.3 | globlastp |
| 3446 | LYD466 spruce\|gb162\|CO215644 | 10163 | 609 | 88.3 | globlastp |
| 3447 | LYD466 zostera\|10v1\|AM770097 | 10164 | 609 | 88.3 | globlastp |
| 3448 | LYD466 cedrus\|11v1\|SRR065007X161440_P1 | 10165 | 609 | 87.5 | globlastp |
| 3449 | LYD466 distylium\|11v1\|SRR065077X135159_P1 | 10166 | 609 | 87.5 | globlastp |
| 3450 | LYD466 flaveria\|11v1\|SRR149232.108816_P1 | 10167 | 609 | 87.5 | globlastp |
| 3451 | LYD466 maritime_pine\|10v1\|AL750317_T1 | 10168 | 609 | 87.5 | glotblastn |
| 3452 | LYD466 thellungiella_parvulum\|11v1\|EPCRP006700_P1 | 10169 | 609 | 87.5 | globlastp |
| 3453 | LYD466 antirrhinum\|gb166\|AJ560122_P1 | 10170 | 609 | 87.5 | globlastp |
| 3454 | LYD466 b_juncea\|10v2\|E6ANDIZ01A6GJL1_P1 | 10171 | 609 | 87.5 | globlastp |
| 3455 | LYD466 ginger\|gb164\|DY347970T1 | 10172 | 609 | 87.5 | glotblastn |
| 3456 | LYD466 onion\|gb162\|CF439762T1 | 10173 | 609 | 87.5 | glotblastn |
| 3457 | LYD466 pine\|10v2\|CD018384_P1 | 10174 | 609 | 87.5 | globlastp |
| 3458 | LYD466 pseudotsuga\|10v1\|SRR065119S0009795 | 10175 | 609 | 87.5 | globlastp |
| 3459 | LYD466 sequoia\|10v1\|SRR065044S0012708 | 10176 | 609 | 87.5 | globlastp |
| 3460 | LYD466 phyla\|11v2\|SRR099037X39930_P1 | 10177 | 609 | 87.3 | globlastp |

TABLE 54-continued

Homologous polynucleotides and polypeptides which can increase plant yield, seed
yield, oil yield, oil content, growth rate, fiber yield, fiber quality, biomass, vigor,
ABST and/or NUE of a plant

| Polyn. SEQ ID NO: | Hom to Gene Name  cluster name | Polyp. SEQ ID NO: | Hom to SEQ ID NO: | % glob. iden. | Algor. |
|---|---|---|---|---|---|
| 3461 | LYD466 nasturtium\|10v1\|SRR032558S0005061 | 10178 | 609 | 87.1 | globlastp |
| 3462 | LYD466 cedrus\|11v1\|SRR065007X10003_P1 | 10179 | 609 | 86.7 | globlastp |
| 3463 | LYD466 sciadopitys\|10v1\|SRR065035S0015070 | 10180 | 609 | 86.7 | globlastp |
| 3464 | LYD466 taxus\|10v1\|SRR032523S0068882 | 10181 | 609 | 86.7 | globlastp |
| 3465 | LYD466 gnetum\|10v1\|SRR064399S0011018_T1 | 10182 | 609 | 86.7 | glotblastn |
| 3466 | LYD466 thalictrum\|11v1\|SRR096787X108768_T1 | — | 609 | 86.7 | glotblastn |
| 3467 | LYD466 arabidopsis_lyrata\|09v1\|JGIAL017076_P1 | 10183 | 609 | 86.1 | globlastp |
| 3468 | LYD466 flaveria\|11v1\|SRR149232.193203_P1 | 10184 | 609 | 86.0 | globlastp |
| 3469 | LYD466 wheat\|10v2\|CA622324 | 10185 | 609 | 85.8 | glotblastn |
| 3470 | LYD466 cephalotaxus\|11v1\|SRR064395X129251_P1 | 10186 | 609 | 85.8 | globlastp |
| 3471 | LYD466 cucurbita\|11v1\|SRR091276X100037_P1 | 10187 | 609 | 85.8 | globlastp |
| 3472 | LYD466 cucurbita\|11v1\|SRR091276X120168_P1 | 10188 | 609 | 85.8 | globlastp |
| 3473 | LYD466 distylium\|11v1\|SRR065077X104309_P1 | 10189 | 609 | 85.8 | globlastp |
| 3474 | LYD466 humulus\|11v1\|SRR098683X100674_P1 | 10190 | 609 | 85.8 | globlastp |
| 3475 | LYD466 thellungiella_parvulum\|11v1\|EPCRP001172_P1 | 10191 | 609 | 85.8 | globlastp |
| 3476 | LYD466 cryptomeria\|gb166\|AU299748_P1 | 10192 | 609 | 85.8 | globlastp |
| 3477 | LYD466 podocarpus\|10v1\|SRR065014S0007932_P1 | 10193 | 609 | 85.8 | globlastp |
| 3478 | LYD466 vinca\|11v1\|SRR098690X193654_P1 | 10194 | 609 | 85.0 | globlastp |
| 3479 | LYD466 fescue\|gb161\|DT686314_P1 | 10195 | 609 | 85.0 | globlastp |
| 3480 | LYD466 canola\|11v1\|EV180786T1 | — | 609 | 85.0 | glotblastn |
| 3481 | LYD466 valeriana\|11v1\|SRR099039X158152_T1 | 10196 | 609 | 84.4 | glotblastn |
| 3482 | LYD466 canola\|11v1\|SRR341920.845570_P1 | 10197 | 609 | 84.2 | globlastp |
| 3483 | LYD466 fern\|gb171\|DK944547_P1 | 10198 | 609 | 84.2 | globlastp |
| 3484 | LYD466 radish\|gb164\|EW734752 | 10199 | 609 | 84.2 | globlastp |
| 3485 | LYD466 sciadopitys\|10v1\|SRR065035S0015867 | 10200 | 609 | 84.2 | globlastp |
| 3486 | LYD466 b_oleracea\|gb161\|EE532161_T1 | 10201 | 609 | 84.2 | glotblastn |
| 3487 | LYD466 lovegrass\|gb167\|EH186435_T1 | 10202 | 609 | 84.2 | glotblastn |
| 3488 | LYD466 wheat\|10v2\|CA618490XX1 | 10203 | 609 | 84.2 | glotblastn |
| 3489 | LYD466 ceratodon\|10v1\|AW087022_P1 | 10204 | 609 | 83.6 | globlastp |
| 3490 | LYD466 ceratodon\|10v1\|SRR074890S0047922_P1 | 10205 | 609 | 83.5 | globlastp |
| 3491 | LYD466 wheat\|10v2\|CA619143 | 10206 | 609 | 83.3 | glotblastn |
| 3492 | LYD466 flaveria\|11v1\|SRR149240.369708_P1 | 10207 | 609 | 83.3 | globlastp |
| 3493 | LYD466 flax\|11v1\|JG159162_P1 | 10208 | 609 | 83.3 | globlastp |
| 3494 | LYD466 kiwi\|gb166\|FG403924_P1 | 10209 | 609 | 83.3 | globlastp |
| 3495 | LYD466 ceratodon\|10v1\|SRR074890S0021625_P1 | 10210 | 609 | 82.8 | globlastp |
| 3496 | LYD466 cotton\|10v2\|BG447191_T1 | 10211 | 609 | 81.7 | glotblastn |
| 3497 | LYD466 citrus\|gb166\|EY796850_T1 | 10212 | 609 | 80.8 | glotblastn |
| 3498 | LYD466 physcomitrella\|10v1\|AW476934_T1 | 10213 | 609 | 80.8 | glotblastn |
| 3499 | LYD466 physcomitrella\|10v1\|BQ039887_T1 | 10214 | 609 | 80.8 | glotblastn |
| 3500 | LYD466 rhizophora\|10v1\|SRR005793S0033046 | 10215 | 609 | 80.8 | glotblastn |
| 3501 | LYD466 orobanche\|10v1\|SRR023189S0012984_P1 | 10216 | 609 | 80.8 | globlastp |
| 3502 | LYD466 pteridium\|11v1\|GW574873_P1 | 10217 | 609 | 80.3 | globlastp |
| 3503 | LYD466 fern\|gb171\|DK944445_P1 | 10218 | 609 | 80.3 | globlastp |
| 3504 | LYD466 physcomitrella\|10v1\|AW476753_P1 | 10219 | 609 | 80.3 | globlastp |
| 3505 | LYD466 physcomitrella\|10v1\|BG409369_P1 | 10220 | 609 | 80.3 | globlastp |
| 3506 | LYD466 physcomitrella\|10v1\|FC401949_P1 | 10221 | 609 | 80.3 | globlastp |
| 3507 | LYD466 flaveria\|11v1\|SRR149238.136603_T1 | 10222 | 609 | 80.0 | glotblastn |
| 3508 | LYD466 cryptomeria\|gb166\|DC429756_T1 | 10223 | 609 | 80.0 | glotblastn |
| 3509 | LYD466 physcomitrella\|10v1\|AW599486_T1 | 10224 | 609 | 80.0 | glotblastn |
| 3510 | LYD469 soybean\|11v1\|GLYMA03G36190 | 10225 | 612 | 89.0 | globlastp |
| 3511 | LYD470 soybean\|11v1\|GLYMA03G40960 | 10226 | 613 | 85.6 | globlastp |
| 3512 | LYD470 pigeonpea\|10v1\|SRR054580S0017387_P1 | 10227 | 613 | 85.2 | globlastp |
| 3513 | LYD472 soybean\|11v1\|GLYMA03G31970 | 10228 | 615 | 95.5 | globlastp |
| 3514 | LYD472 lotus\|09v1\|LLBP080700_P1 | 10229 | 615 | 85.4 | globlastp |
| 3515 | LYD473 soybean\|11v1\|GLYMA09G31690 | 10230 | 616 | 82.2 | globlastp |
| 3516 | LYD474 dandelion\|10v1\|DY809911_P1 | 10231 | 617 | 96.6 | globlastp |
| 3517 | LYD474 ambrosia\|11v1\|SRR346943.226548XX1_T1 | 10232 | 617 | 91.9 | glotblastn |
| 3518 | LYD474 parthenium\|10v1\|GW778335_P1 | 10233 | 617 | 91.1 | globlastp |
| 3519 | LYD474 parthenium\|10v1\|GW775759_P1 | 10234 | 617 | 89.4 | globlastp |
| 3520 | LYD474 ambrosia\|11v1\|SRR346943.107836_P1 | 10235 | 617 | 88.9 | globlastp |
| 3521 | LYD474 ambrosia\|11v1\|SRR346947.102324_T1 | 10236 | 617 | 88.5 | glotblastn |
| 3522 | LYD474 sunflower\|10v1\|CD846908 | 10237 | 617 | 88.5 | globlastp |
| 3523 | LYD474 ambrosia\|11v1\|SRR346935.10269_P1 | 10238 | 617 | 87.7 | globlastp |
| 3524 | LYD474 sunflower\|10v1\|EE654323 | 10239 | 617 | 85.5 | globlastp |
| 3525 | LYD474 ambrosia\|11v1\|SRR346935.259596_P1 | 10240 | 617 | 85.1 | globlastp |
| 3526 | LYD474 flaveria\|11v1\|SRR149229.140773_P1 | 10241 | 617 | 84.7 | globlastp |
| 3527 | LYD474 arnica\|11v1\|SRR099034X10926_P1 | 10242 | 617 | 84.3 | globlastp |
| 3528 | LYD474 flaveria\|11v1\|SRR149232.113834_P1 | 10243 | 617 | 84.3 | globlastp |
| 3529 | LYD474 flaveria\|11v1\|SRR149232.15805_P1 | 10244 | 617 | 83.8 | globlastp |
| 3530 | LYD474 guizotia\|10v1\|GE551791_P1 | 10245 | 617 | 83.5 | globlastp |
| 3531 | LYD474 ambrosia\|11v1\|SRR346935.116981_P1 | 10246 | 617 | 82.3 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 3532 | LYD474 safflower\|gb162\|EL401339 | 10247 | 617 | 82.3 | globlastp |
| 3533 | LYD474 ambrosia\|11v1\|SRR346935.171311_P1 | 10248 | 617 | 82.1 | globlastp |
| 3534 | LYD474 centaurea\|gb166\|EH741181_P1 | 10249 | 617 | 81.4 | globlastp |
| 3535 | LYD474 cirsium\|11v1\|SRR346952.1005770_P1 | 10250 | 617 | 81.0 | globlastp |
| 3536 | LYD474 cirsium\|11v1\|SRR346952.103446_P1 | 10251 | 617 | 80.6 | globlastp |
| 3537 | LYD474 cynara\|gb167\|GE605300_T1 | 10252 | 617 | 80.1 | glotblastn |
| 3538 | LYD475 solanum_phureja\|09v1\|SPHAI485596 | 10253 | 618 | 84.1 | globlastp |
| 3539 | LYD477 solanum_phureja\|09v1\|SPHBP884530 | 10254 | 619 | 95.2 | globlastp |
| 3540 | LYD478 solanum_phureja\|09v1\|SPHAI483112 | 10255 | 620 | 95.2 | globlastp |
| 3541 | LYD479 solanum_phureja\|09v1\|SPHCV506145 | 10256 | 621 | 94.2 | globlastp |
| 3542 | LYD479 eggplant\|10v1\|FS042319_P1 | 10257 | 621 | 82.2 | globlastp |
| 3543 | LYD481 solanum_phureja\|09v1\|SPHAI771986 | 10258 | 623 | 97.5 | globlastp |
| 3544 | LYD481 tobacco\|gb162\|EB425742 | 10259 | 623 | 91.7 | globlastp |
| 3545 | LYD481 tabernaemontana\|11v1\|SRR098689X102070_P1 | 10260 | 623 | 82.8 | globlastp |
| 3546 | LYD481 ipomoea_nil\|10v1\|CJ749177_T1 | 10261 | 623 | 82.8 | glotblastn |
| 3547 | LYD481 amsonia\|11v1\|SRR098688X129208_P1 | 10262 | 623 | 81.9 | globlastp |
| 3548 | LYD481 phyla\|11v2\|SRR099035X119207_P1 | 10263 | 623 | 81.9 | globlastp |
| 3549 | LYD481 triphysaria\|10v1\|EX984006 | 10264 | 623 | 81.7 | globlastp |
| 3550 | LYD481 antirrhinum\|gb166\|AJ790278_T1 | 10265 | 623 | 81.5 | glotblastn |
| 3551 | LYD481 phyla\|11v2\|SRR099037X107300_P1 | 10266 | 623 | 81.1 | globlastp |
| 3552 | LYD481 flax\|11v1\|EU830660_P1 | 10267 | 623 | 80.3 | globlastp |
| 3553 | LYD481 monkeyflower\|10v1\|G0997296_P1 | 10268 | 623 | 80.3 | globlastp |
| 3554 | LYD481 plantago\|11v1\|SRR066373X102791_T1 | 10269 | 623 | 80.3 | glotblastn |
| 3555 | LYD482 solanum_phureja\|09v1\|SPHAI777950 | 10270 | 624 | 97.1 | globlastp |
| 3556 | LYD482 potato\|10v1\|BG593342_P1 | 10271 | 624 | 96.7 | globlastp |
| 3557 | LYD482 pepper\|gb171\|BM061913_P1 | 10272 | 624 | 91.2 | globlastp |
| 3558 | LYD482 olea\|11v1\|SRR014463.21854_P1 | 10273 | 624 | 83.4 | globlastp |
| 3559 | LYD482 monkeyflower\|10v1\|DV213085_P1 | 10274 | 624 | 82.2 | globlastp |
| 3560 | LYD482 fraxinus\|11v1\|SRR058827.10179_T1 | 10275 | 624 | 82.0 | glotblastn |
| 3561 | LYD482 vinca\|11v1\|SRR098690X130952_P1 | 10276 | 624 | 81.9 | globlastp |
| 3562 | LYD482 poplar\|10v1\|BU820838_P1 | 10277 | 624 | 81.8 | globlastp |
| 3563 | LYD482 poplar\|10v1\|BU102278_P1 | 10278 | 624 | 81.6 | globlastp |
| 3564 | LYD482 triphysaria\|10v1\|EY154119 | 10279 | 624 | 81.6 | globlastp |
| 3565 | LYD482 vinca\|11v1\|SRR098690X102232_T1 | 10280 | 624 | 81.6 | glotblastn |
| 3566 | LYD482 euonymus\|11v1\|SRR070038X148338_P1 | 10281 | 624 | 81.4 | globlastp |
| 3567 | LYD482 catharanthus\|11v1\|EG556968XX1_P1 | 10282 | 624 | 81.2 | globlastp |
| 3568 | LYD482 amsonia\|11v1\|SRR098688X104050_P1 | 10283 | 624 | 81.1 | globlastp |
| 3569 | LYD482 fraxinus\|11v1\|SRR058827.100785_T1 | 10284 | 624 | 81.0 | glotblastn |
| 3570 | LYD482 kiwi\|gb166\|FG405195_P1 | 10285 | 624 | 80.8 | globlastp |
| 3571 | LYD482 orobanche\|10v1\|SRR023189S0025760_P1 | 10286 | 624 | 80.6 | globlastp |
| 3572 | LYD482 citrus\|gb166\|CF417110_P1 | 10287 | 624 | 80.2 | globlastp |
| 3573 | LYD482 clementine\|11v1\|CF417110_P1 | 10288 | 624 | 80.0 | globlastp |
| 3574 | LYD482 cacao\|10v1\|CF973747_P1 | 10289 | 624 | 80.0 | globlastp |
| 3575 | LYD484 solanum_phureja\|09v1\|SPHAW929870 | 10290 | 626 | 96.1 | globlastp |
| 3576 | LYD489 solanum_phureja\|09v1\|SPHBG131472 | 10291 | 628 | 93.7 | glotblastn |
| 3577 | LYD491 solanum_phureja\|09v1\|SPHCK273448 | 10292 | 629 | 98.8 | globlastp |
| 3578 | LYD491 cucumber\|09v1\|GD176541_P1 | 10293 | 629 | 83.1 | globlastp |
| 3579 | LYD491 grape\|11v1\|EC993942_P1 | 10294 | 629 | 83.0 | globlastp |
| 3580 | LYD491 grape\|11v1\|GSVPIV1T01030385001_P1 | 10294 | 629 | 83.0 | globlastp |
| 3581 | LYD491 watermelon\|11v1\|AM732921_P1 | 10295 | 629 | 82.8 | globlastp |
| 3582 | LYD491 prunus\|10v1\|CN930801 | 10296 | 629 | 82.8 | globlastp |
| 3583 | LYD491 apple\|11v1\|G0511707_P1 | 10297 | 629 | 82.7 | globlastp |
| 3584 | LYD491 apple\|11v1\|CN930801_T1 | 10298 | 629 | 82.1 | glotblastn |
| 3585 | LYD491 strawberry\|11v1\|SRR034884S0011354 | 10299 | 629 | 82.0 | glotblastn |
| 3586 | LYD491 castorbean\|11v1\|RCPRD038366_P1 | 10300 | 629 | 81.9 | globlastp |
| 3587 | LYD491 castorbean\|09v1\|XM002517901 | 10300 | 629 | 81.9 | globlastp |
| 3588 | LYD491 castorbean\|11v1\|XM_002517901_P1 | 10300 | 629 | 81.9 | globlastp |
| 3589 | LYD491 cassava\|09v1\|DV453570_P1 | 10301 | 629 | 81.6 | globlastp |
| 3590 | LYD491 cacao\|10v1\|CU469588_P1 | 10302 | 629 | 81.0 | globlastp |
| 3591 | LYD491 cotton\|10v2\|SRR032367S0422347_T1 | 10303 | 629 | 80.9 | glotblastn |
| 3592 | LYD491 apple\|11v1\|MDPRD026100_T1 | 10304 | 629 | 80.7 | glotblastn |
| 3593 | LYD491 monkeyflower\|10v1\|DV209830_P1 | 10305 | 629 | 80.5 | globlastp |
| 3594 | LYD491 soybean\|11v1\|GLYMA13G37420 | 10306 | 629 | 80.5 | globlastp |
| 3595 | LYD491 cotton\|10v2\|DW235393_T1 | 10307 | 629 | 80.5 | glotblastn |
| 3596 | LYD491 amsonia\|11v1\|SRR098688X117684_T1 | 10308 | 629 | 80.2 | glotblastn |
| 3597 | LYD491 lotus\|09v1\|CRPLJ030399_P1 | 10309 | 629 | 80.1 | globlastp |
| 3598 | LYD492 solanum_phureja\|09v1\|SPHDN587540 | 10310 | 630 | 96.7 | globlastp |
| 3599 | LYD492 pepper\|gb171\|GD055412_T1 | 10311 | 630 | 85.0 | glotblastn |
| 3600 | LYD492 tobacco\|gb162\|BP132794 | 10312 | 630 | 80.0 | glotblastn |
| 3601 | LYD495 wheat\|10v2\|BF202465 | 10313 | 631 | 98.8 | globlastp |
| 3602 | LYD495 wheat\|10v2\|SRR043335S0034386 | 10314 | 631 | 97.9 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 3603 | LYD495 leymus\|gb166\|CD809068_P1 | 10315 | 631 | 96.7 | globlastp |
| 3604 | LYD495 barley\|10v2\|BE437359_P1 | 10316 | 631 | 96.4 | globlastp |
| 3605 | LYD495 oat\|10v2\|GO591667 | 10317 | 631 | 93.4 | globlastp |
| 3606 | LYD495 oat\|11v1\|GO591667_P1 | 10317 | 631 | 93.4 | globlastp |
| 3607 | LYD495 pseudoroegneria\|gb167\|FF342268 | 10318 | 631 | 89.3 | globlastp |
| 3608 | LYD495 foxtail_millet\|11v3\|PHY7SI036516M_P1 | 10319 | 631 | 88.1 | globlastp |
| 3609 | LYD495 rice\|gb170\|OS10G06720 | 10320 | 631 | 87.8 | globlastp |
| 3610 | LYD495 millet\|10v1\|EVO454PM003140_P1 | 10321 | 631 | 87.5 | globlastp |
| 3611 | LYD495 switchgrass\|gb167\|DN150426 | 10322 | 631 | 86.9 | globlastp |
| 3612 | LYD495 switchgrass\|gb167\|FL957320 | 10323 | 631 | 86.6 | globlastp |
| 3613 | LYD495 brachypodium\|09v1\|DV468881_P1 | 10324 | 631 | 86.6 | globlastp |
| 3614 | LYD495 sorghum\|09v1\|SB01G025920 | 10325 | 631 | 85.2 | globlastp |
| 3615 | LYD495 sorghum\|11v1\|SB01G025920_P1 | 10325 | 631 | 85.2 | globlastp |
| 3616 | LYD495 maize\|10v1\|AI491469_P1 | 10326 | 631 | 83.9 | globlastp |
| 3617 | LYD497 fescue\|gb161\|DT679813_P1 | 10327 | 632 | 83.1 | globlastp |
| 3618 | LYD498 b_rapa\|gb162\|DY010348_P1 | 10328 | 633 | 98.1 | globlastp |
| 3619 | LYD498 canola\|10v1\|ES995187 | 10328 | 633 | 98.1 | globlastp |
| 3620 | LYD498 canola\|10v1\|H07784 | 10328 | 633 | 98.1 | globlastp |
| 3621 | LYD498 canola\|11v1\|EE452324_P1 | 10328 | 633 | 98.1 | globlastp |
| 3622 | LYD498 canola\|10v1\|CX196221 | 10329 | 633 | 97.7 | globlastp |
| 3623 | LYD498 canola\|11v1\|DW997891_P1 | 10329 | 633 | 97.7 | globlastp |
| 3624 | LYD498 b_oleracea\|gb161\|AM387391_P1 | 10330 | 633 | 96.7 | globlastp |
| 3625 | LYD498 radish\|gb164\|EV546792 | 10331 | 633 | 96.7 | globlastp |
| 3626 | LYD498 radish\|gb164\|EY940573 | 10331 | 633 | 96.7 | globlastp |
| 3627 | LYD498 thellungiella_parvulum\|11v1\|DN772758_P1 | 10332 | 633 | 96.3 | globlastp |
| 3628 | LYD498 b_juncea\|10v2\|E6ANDIZ01CH10Y_P1 | 10333 | 633 | 95.8 | globlastp |
| 3629 | LYD498 canola\|10v1\|CD834724 | 10333 | 633 | 95.8 | globlastp |
| 3630 | LYD498 canola\|11v1\|EE432581_P1 | 10333 | 633 | 95.8 | globlastp |
| 3631 | LYD498 b_oleracea\|gb161\|AM387038_P1 | 10334 | 633 | 95.3 | globlastp |
| 3632 | LYD498 b_rapa\|gb162\|CV433055_P1 | 10335 | 633 | 95.3 | globlastp |
| 3633 | LYD498 canola\|10v1\|H07800 | 10335 | 633 | 95.3 | globlastp |
| 3634 | LYD498 canola\|11v1\|H07784_P1 | 10336 | 633 | 95.3 | globlastp |
| 3635 | LYD498 radish\|gb164\|EX754447 | 10337 | 633 | 95.3 | globlastp |
| 3636 | LYD498 thellungiella_halophilum\|11v1\|DN772758_P1 | 10338 | 633 | 95.0 | globlastp |
| 3637 | LYD498 thellungiella\|gb167\|DN772758 | 10339 | 633 | 93.6 | globlastn |
| 3638 | LYD498 arabidopsis_lyrata\|09v1\|CRPALE013486_P1 | 10340 | 633 | 91.3 | globlastp |
| 3639 | LYD498 arabidopsis\|10v1\|AT4G29160_P1 | 10341 | 633 | 90.9 | globlastp |
| 3640 | LYD498 nasturtium\|10v1\|SRR032558S0111259 | 10342 | 633 | 90.8 | globlastp |
| 3641 | LYD498 euphorbia\|11v1\|BP958070_P1 | 10343 | 633 | 90.4 | globlastp |
| 3642 | LYD498 euphorbia\|11v1\|SRR098678X107861_P1 | 10344 | 633 | 89.4 | globlastp |
| 3643 | LYD498 tripterygium\|11v1\|SRR098677X109821_P1 | 10345 | 633 | 89.4 | globlastp |
| 3644 | LYD498 aristolochia\|10v1\|FD757653_P1 | 10346 | 633 | 89.4 | globlastp |
| 3645 | LYD498 solanum_phureja\|09v1\|SPHBG630642 | 10347 | 633 | 89.4 | globlastp |
| 3646 | LYD498 cannabis\|12v1\|JK493272_P1 | 10348 | 633 | 89.0 | globlastp |
| 3647 | LYD498 euphorbia\|11v1\|DV122707_P1 | 10349 | 633 | 89.0 | globlastp |
| 3648 | LYD498 humulus\|11v1\|EX517613_P1 | 10348 | 633 | 89.0 | globlastp |
| 3649 | LYD498 cleome_gynandra\|10v1\|SRR015532S0004956_P1 | 10350 | 633 | 89.0 | globlastp |
| 3650 | LYD498 peanut\|10v1\|GO267328_P1 | 10351 | 633 | 89.0 | globlastp |
| 3651 | LYD498 clementine\|11v1\|BQ623156_P1 | 10352 | 633 | 88.6 | globlastp |
| 3652 | LYD498 orange\|11v1\|BQ623156_P1 | 10352 | 633 | 88.6 | globlastp |
| 3653 | LYD498 citrus\|gb166\|BQ623156_P1 | 10352 | 633 | 88.6 | globlastp |
| 3654 | LYD498 watermelon\|11v1\|CO997378_P1 | 10353 | 633 | 88.5 | globlastp |
| 3655 | LYD498 cassava\|09v1\|DV457532_P1 | 10354 | 633 | 88.5 | globlastp |
| 3656 | LYD498 chestnut\|gb170\|SRR006295S0008037_P1 | 10355 | 633 | 88.5 | globlastp |
| 3657 | LYD498 melon\|10v1\|DV634841_P1 | 10356 | 633 | 88.5 | globlastp |
| 3658 | LYD498 cirsium\|11v1\|SRR346952.101098_P1 | 10357 | 633 | 88.1 | globlastp |
| 3659 | LYD498 cucurbita\|11v1\|SRR091276X133932_P1 | 10358 | 633 | 88.1 | globlastp |
| 3660 | LYD498 cucurbita\|11v1\|SRR091276X152857_P1 | 10359 | 633 | 88.1 | globlastp |
| 3661 | LYD498 tomato\|11v1\|BG630642_P1 | 10360 | 633 | 88.1 | globlastp |
| 3662 | LYD498 aristolochia\|10v1\|SRR039082S0235625_P1 | 10361 | 633 | 88.1 | globlastp |
| 3663 | LYD498 cacao\|10v1\|CF972750_P1 | 10362 | 633 | 88.1 | globlastp |
| 3664 | LYD498 castorbean\|09v1\|EG659045 | 10363 | 633 | 88.1 | globlastp |
| 3665 | LYD498 castorbean\|11v1\|EG659045_P1 | 10363 | 633 | 88.1 | globlastp |
| 3666 | LYD498 cichorium\|gb171\|EL353927_P1 | 10364 | 633 | 88.1 | globlastp |
| 3667 | LYD498 cucumber\|09v1\|CO997378_P1 | 10365 | 633 | 88.1 | globlastp |
| 3668 | LYD498 oil_palm\|gb166\|EL684259_P1 | 10366 | 633 | 88.1 | globlastp |
| 3669 | LYD498 papaya\|gb165\|EX267720_P1 | 10367 | 633 | 88.1 | globlastp |
| 3670 | LYD498 potato\|10v1\|BQ515666_P1 | 10368 | 633 | 88.1 | globlastp |
| 3671 | LYD498 spurge\|gb161\|DV122707 | 10369 | 633 | 88.1 | globlastp |
| 3672 | LYD498 tomato\|09v1\|BG630642 | 10360 | 633 | 88.1 | globlastp |
| 3673 | LYD498 eggplant\|10v1\|FS012070_P1 | 10370 | 633 | 88.0 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 3674 | LYD498 tobacco\|gb162\|EB425232 | 10371 | 633 | 88.0 | globlastp |
| 3675 | LYD498 tabernaemontana\|11v1\|SRR098689X100859_P1 | 10372 | 633 | 87.7 | globlastp |
| 3676 | LYD498 eucalyptus\|11v2\|CD669263_P1 | 10373 | 633 | 87.7 | globlastp |
| 3677 | LYD498 tragopogon\|10v1\|SRR020205S0020191 | 10374 | 633 | 87.6 | glotblastn |
| 3678 | LYD498 tomato\|11v1\|BG131629_P1 | 10375 | 633 | 87.6 | globlastp |
| 3679 | LYD498 cassava\|09v1\|CK652135_P1 | 10376 | 633 | 87.6 | globlastp |
| 3680 | LYD498 cotton\|10v2\|SRR032367S0013850_P1 | 10377 | 633 | 87.6 | globlastp |
| 3681 | LYD498 ipomoea_nil\|10v1\|BJ559968_P1 | 10378 | 633 | 87.6 | globlastp |
| 3682 | LYD498 lettuce\|10v1\|DW050260_P1 | 10379 | 633 | 87.6 | globlastp |
| 3683 | LYD498 lotus\|09v1\|AW720054_P1 | 10380 | 633 | 87.6 | globlastp |
| 3684 | LYD498 nicotiana_benthamiana\|gb162\|CK294844_P1 | 10381 | 633 | 87.6 | globlastp |
| 3685 | LYD498 potato\|10v1\|BI176571_P1 | 10382 | 633 | 87.6 | globlastp |
| 3686 | LYD498 prunus\|10v1\|BU040884 | 10383 | 633 | 87.6 | globlastp |
| 3687 | LYD498 tomato\|09v1\|BG131629 | 10375 | 633 | 87.6 | globlastp |
| 3688 | LYD498 cucurbita\|11v1\|SRR091276X123682_T1 | 10384 | 633 | 87.6 | glotblastn |
| 3689 | LYD498 grape\|11v1\|GSVIVT01035334001_P1 | 10385 | 633 | 87.5 | globlastp |
| 3690 | LYD498 grape\|gb160\|BQ796340 | 10385 | 633 | 87.5 | globlastp |
| 3691 | LYD498 chelidonium\|11v1\|SRR084752X102145_P1 | 10386 | 633 | 87.2 | globlastp |
| 3692 | LYD498 cirsium\|11v1\|SRR346952.1001619XX1_P1 | 10387 | 633 | 87.2 | globlastp |
| 3693 | LYD498 cirsium\|11v1\|SRR346952.104523_P1 | 10388 | 633 | 87.2 | globlastp |
| 3694 | LYD498 euonymus\|11v1\|SRR070038X243241_P1 | 10389 | 633 | 87.2 | globlastp |
| 3695 | LYD498 aquilegia\|10v2\|DR920918_P1 | 10390 | 633 | 87.2 | globlastp |
| 3696 | LYD498 centaurea\|gb166\|EH724024_P1 | 10387 | 633 | 87.2 | globlastp |
| 3697 | LYD498 cichorium\|gb171\|EH689078_P1 | 10391 | 633 | 87.2 | globlastp |
| 3698 | LYD498 cowpea\|gb166\|FF543405_P1 | 10392 | 633 | 87.2 | globlastp |
| 3699 | LYD498 cynara\|gb167\|GE586258_P1 | 10388 | 633 | 87.2 | globlastp |
| 3700 | LYD498 grape\|11v1\|GSVIVT01015258001_P1 | 10393 | 633 | 87.2 | globlastp |
| 3701 | LYD498 grape\|gb160\|BQ794273 | 10393 | 633 | 87.2 | globlastp |
| 3702 | LYD498 hevea\|10v1\|EC601525_P1 | 10394 | 633 | 87.2 | globlastp |
| 3703 | LYD498 ipomoea_batatas\|10v1\|BM878923_P1 | 10395 | 633 | 87.2 | globlastp |
| 3704 | LYD498 momordica\|10v1\|SRR071315S0004512_P1 | 10396 | 633 | 87.2 | globlastp |
| 3705 | LYD498 pigeonpea\|10v1\|SRR054580S0264395_P1 | 10397 | 633 | 87.2 | globlastp |
| 3706 | LYD498 poplar\|10v1\|AI164344_P1 | 10398 | 633 | 87.2 | globlastp |
| 3707 | LYD498 tobacco\|gb162\|EB428330 | 10399 | 633 | 87.2 | globlastp |
| 3708 | LYD498 tomato\|09v1\|BG139259 | 10400 | 633 | 87.2 | globlastp |
| 3709 | LYD498 dandelion\|10v1\|DY816316_P1 | 10401 | 633 | 87.1 | globlastp |
| 3710 | LYD498 kiwi\|gb166\|FG412421_P1 | 10402 | 633 | 87.1 | globlastp |
| 3711 | LYD498 oak\|10v1\|DB997543_P1 | 10403 | 633 | 87.1 | globlastp |
| 3712 | LYD498 b_juncea\|10v2\|DT317705_P1 | 10404 | 633 | 87.0 | globlastp |
| 3713 | LYD498 zostera\|10v1\|AM766035 | 10405 | 633 | 86.9 | globlastp |
| 3714 | LYD498 catharanthus\|11v1\|EG555002_P1 | 10406 | 633 | 86.8 | globlastp |
| 3715 | LYD498 euonymus\|11v1\|SRR070038X174944_P1 | 10407 | 633 | 86.8 | globlastp |
| 3716 | LYD498 cleome_spinosa\|10v1\|GR934055_P1 | 10408 | 633 | 86.8 | globlastp |
| 3717 | LYD498 coffea\|10v1\|DV673095_P1 | 10409 | 633 | 86.8 | globlastp |
| 3718 | LYD498 cotton\|10v2\|SRR032367S0536261_T1 | 10410 | 633 | 86.8 | glotblastn |
| 3719 | LYD498 ambrosia\|11v1\|SRR346935.110494_T1 | 10411 | 633 | 86.7 | glotblastn |
| 3720 | LYD498 ambrosia\|11v1\|SRR346935.174957_P1 | 10412 | 633 | 86.7 | globlastp |
| 3721 | LYD498 chelidonium\|11v1\|SRR084752X106647_P1 | 10413 | 633 | 86.7 | globlastp |
| 3722 | LYD498 tripterygium\|11v1\|SRR098677X10550_T1 | 10414 | 633 | 86.7 | glotblastn |
| 3723 | LYD498 bean\|gb167\|CA899612_P1 | 10415 | 633 | 86.7 | globlastp |
| 3724 | LYD498 cotton\|10v2\|EV486502_P1 | 10416 | 633 | 86.7 | globlastp |
| 3725 | LYD498 cynara\|gb167\|GE593845_P1 | 10417 | 633 | 86.7 | globlastp |
| 3726 | LYD498 ginger\|gb164\|DY359981_P1 | 10418 | 633 | 86.7 | globlastp |
| 3727 | LYD498 lettuce\|10v1\|DW066091_P1 | 10419 | 633 | 86.7 | globlastp |
| 3728 | LYD498 solanum_phureja\|09v1\|SPHBG139259 | 10420 | 633 | 86.7 | globlastp |
| 3729 | LYD498 tobacco\|gb162\|EB426267 | 10421 | 633 | 86.7 | globlastp |
| 3730 | LYD498 ambrosia\|11v1\|SRR346943.107087_T1 | 10422 | 633 | 86.6 | glotblastn |
| 3731 | LYD498 amorphophallus\|11v2\|SRR089351X101001_P1 | 10423 | 633 | 86.6 | globlastp |
| 3732 | LYD498 aquilegia\|10v2\|DT729628_P1 | 10424 | 633 | 86.6 | globlastp |
| 3733 | LYD498 amsonia\|11v1\|SRR098688X120656_P1 | 10425 | 633 | 86.4 | globlastp |
| 3734 | LYD498 vinca\|11v1\|SRR098690X119230_P1 | 10426 | 633 | 86.4 | globlastp |
| 3735 | LYD498 vinca\|11v1\|SRR098690X140128_P1 | 10427 | 633 | 86.4 | globlastp |
| 3736 | LYD498 medicago\|09v1\|LLAW692733_P1 | 10428 | 633 | 86.4 | globlastp |
| 3737 | LYD498 cotton\|10v2\|BQ408790_T1 | 10429 | 633 | 86.3 | glotblastn |
| 3738 | LYD498 lotus\|09v1\|CN825333_T1 | 10430 | 633 | 86.2 | glotblastn |
| 3739 | LYD498 arnica\|11v1\|SRR099034X108981_P1 | 10431 | 633 | 86.2 | globlastp |
| 3740 | LYD498 cirsium\|11v1\|SRR346952.100641_P1 | 10432 | 633 | 86.2 | globlastp |
| 3741 | LYD498 cirsium\|11v1\|SRR346952.1015762_P1 | 10433 | 633 | 86.2 | globlastp |
| 3742 | LYD498 cirsium\|11v1\|SRR346952.1030690XX2_P1 | 10434 | 633 | 86.2 | globlastp |
| 3743 | LYD498 phyla\|11v2\|SRR099035X13024_P1 | 10435 | 633 | 86.2 | globlastp |
| 3744 | LYD498 centaurea\|gb166\|EH714360_P1 | 10433 | 633 | 86.2 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 3745 | LYD498 cowpea\|gb166\|FF385514_P1 | 10436 | 633 | 86.2 | globlastp |
| 3746 | LYD498 cynara\|gb167\|GE594836_P1 | 10437 | 633 | 86.2 | globlastp |
| 3747 | LYD498 pigeonpea\|10v1\|SRR054580S0019564_P1 | 10438 | 633 | 86.2 | globlastp |
| 3748 | LYD498 poplar\|10v1\|AI165181_P1 | 10439 | 633 | 86.2 | globlastp |
| 3749 | LYD498 safflower\|gb162\|EL390343 | 10440 | 633 | 86.2 | globlastp |
| 3750 | LYD498 soybean\|11v1\|GLYMA01G00760 | 10441 | 633 | 86.2 | globlastp |
| 3751 | LYD498 soybean\|11v1\|GLYMA08G03510 | 10442 | 633 | 86.2 | globlastp |
| 3752 | LYD498 strawberry\|11v1\|CO381522 | 10443 | 633 | 86.2 | globlastp |
| 3753 | LYD498 sunflower\|10v1\|CX947788 | 10444 | 633 | 86.2 | globlastp |
| 3754 | LYD498 cirsium\|11v1\|SRR346952.1018140_P1 | 10445 | 633 | 85.8 | globlastp |
| 3755 | LYD498 phalaenopsis\|11v1\|CB032055_P1 | 10446 | 633 | 85.8 | globlastp |
| 3756 | LYD498 primula\|11v1\|SRR098679X138528_P1 | 10447 | 633 | 85.8 | globlastp |
| 3757 | LYD498 sarracenia\|11v1\|SRR192669.113388_P1 | 10448 | 633 | 85.8 | globlastp |
| 3758 | LYD498 valeriana\|11v1\|SRR099039X114490_P1 | 10449 | 633 | 85.8 | globlastp |
| 3759 | LYD498 centaurea\|gb166\|EH716094_P1 | 10450 | 633 | 85.8 | globlastp |
| 3760 | LYD498 melon\|10v1\|DV633130_P1 | 10451 | 633 | 85.8 | globlastp |
| 3761 | LYD498 thalictrum\|11v1\|SRR096787X101792_T1 | 10452 | 633 | 85.8 | glotblastn |
| 3762 | LYD498 antirrhinum\|gb166\|AJ568663_P1 | 10453 | 633 | 85.7 | globlastp |
| 3763 | LYD498 dandelion\|10v1\|DY831128_P1 | 10454 | 633 | 85.7 | globlastp |
| 3764 | LYD498 monkeyflower\|10v1\|G0961325_P1 | 10455 | 633 | 85.7 | globlastp |
| 3765 | LYD498 vinca\|11v1\|SRR098690X108929_P1 | 10456 | 633 | 85.5 | globlastp |
| 3766 | LYD498 vinca\|11v1\|SRR098690X120394_P1 | 10457 | 633 | 85.5 | globlastp |
| 3767 | LYD498 flaveria\|11v1\|SRR149229.455470_T1 | 10458 | 633 | 85.3 | glotblastn |
| 3768 | LYD498 sarracenia\|11v1\|SRR192669.107394_T1 | 10459 | 633 | 85.3 | glotblastn |
| 3769 | LYD498 flaveria\|11v1\|SRR149229.104495_P1 | 10460 | 633 | 85.3 | globlastp |
| 3770 | LYD498 flaveria\|11v1\|SRR149229.107943_P1 | 10461 | 633 | 85.3 | globlastp |
| 3771 | LYD498 flaveria\|11v1\|SRR149229.299520_P1 | 10461 | 633 | 85.3 | globlastp |
| 3772 | LYD498 flaveria\|11v1\|SRR149241.2984_P1 | 10462 | 633 | 85.3 | globlastp |
| 3773 | LYD498 flaveria\|11v1\|SRR149244.135283_P1 | 10463 | 633 | 85.3 | globlastp |
| 3774 | LYD498 watermelon\|11v1\|DV633130_P1 | 10464 | 633 | 85.3 | globlastp |
| 3775 | LYD498 arabidopsis\|10v1\|AT2G19830_P1 | 10465 | 633 | 85.3 | globlastp |
| 3776 | LYD498 cucumber\|09v1\|DV633130_P1 | 10466 | 633 | 85.3 | globlastp |
| 3777 | LYD498 peanut\|10v1\|EG030489_P1 | 10467 | 633 | 85.3 | globlastp |
| 3778 | LYD498 sunflower\|10v1\|DY915541 | 10468 | 633 | 85.3 | globlastp |
| 3779 | LYD498 ambrosia\|11v1\|SRR346935.112852_P1 | 10469 | 633 | 84.9 | globlastp |
| 3780 | LYD498 ambrosia\|11v1\|SRR346935.180633_P1 | 10470 | 633 | 84.9 | globlastp |
| 3781 | LYD498 flaveria\|11v1\|SRR149229.102288_P1 | 10471 | 633 | 84.9 | globlastp |
| 3782 | LYD498 flaveria\|11v1\|SRR149229.123427P | 10472 | 633 | 84.9 | globlastp |
| 3783 | LYD498 apple\|11v1\|CN492587_P1 | 10473 | 633 | 84.9 | globlastp |
| 3784 | LYD498 apple\|gb171\|CN492587 | 10473 | 633 | 84.9 | globlastp |
| 3785 | LYD498 apple\|11v1\|CN579625_P1 | 10474 | 633 | 84.9 | globlastp |
| 3786 | LYD498 apple\|gb171\|CN579625 | 10474 | 633 | 84.9 | globlastp |
| 3787 | LYD498 cotton\|10v2\|DW504788_P1 | 10475 | 633 | 84.9 | globlastp |
| 3788 | LYD498 nuphar\|gb166\|CO997293_P1 | 10476 | 633 | 84.9 | globlastp |
| 3789 | LYD498 sunflower\|10v1\|DY942504 | 10477 | 633 | 84.9 | globlastp |
| 3790 | LYD498 flaveria\|11v1\|SRR149229.153687_T1 | 10478 | 633 | 84.9 | glotblastn |
| 3791 | LYD498 flaveria\|11v1\|SRR149229.31446_T1 | 10479 | 633 | 84.9 | glotblastn |
| 3792 | LYD498 arabidopsis_lyrata\|09v1\|JGIAL012018_P1 | 10480 | 633 | 84.8 | globlastp |
| 3793 | LYD498 orobanche\|10v1\|SRR023189S0010565_P1 | 10481 | 633 | 84.8 | globlastp |
| 3794 | LYD498 salvia\|10v1\|CV166104 | 10482 | 633 | 84.8 | globlastp |
| 3795 | LYD498 thellungiella_halophilum\|11v1\|EHJGI11021098_P1 | 10483 | 633 | 84.7 | globlastp |
| 3796 | LYD498 thellungiella_parvulum\|11v1\|EPCRP011194_P1 | 10484 | 633 | 84.5 | globlastp |
| 3797 | LYD498 catharanthus\|gb166\|EG555002 | 10485 | 633 | 84.5 | globlastp |
| 3798 | LYD498 ambrosia\|11v1\|SRR346935.168773XX2_T1 | 10486 | 633 | 84.4 | glotblastn |
| 3799 | LYD498 flaveria\|11v1\|SRR149229.100485_T1 | 10487 | 633 | 84.4 | glotblastn |
| 3800 | LYD498 bean\|gb167\|CA899613_P1 | 10488 | 633 | 84.4 | globlastp |
| 3801 | LYD498 chestnut\|gb170\|SRR006295S0008625_P1 | 10489 | 633 | 84.4 | globlastp |
| 3802 | LYD498 oak\|10v1\|FP030345XX2_P1 | 10489 | 633 | 84.4 | globlastp |
| 3803 | LYD498 sunflower\|10v1\|DY952685 | 10490 | 633 | 84.4 | globlastp |
| 3804 | LYD498 walnuts\|gb166\|CB304326 | 10491 | 633 | 84.4 | globlastp |
| 3805 | LYD498 artemisia\|10v1\|EY045936_P1 | 10492 | 633 | 84.3 | globlastp |
| 3806 | LYD498 utricularia\|11v1\|SRR094438.103286_P1 | 10493 | 633 | 84.1 | globlastp |
| 3807 | LYD498 cichorium\|gb171\|EH686865_P1 | 10494 | 633 | 84.0 | globlastp |
| 3808 | LYD498 lettuce\|10v1\|DW054391_P1 | 10495 | 633 | 84.0 | globlastp |
| 3809 | LYD498 fagopyrum\|11v1\|SRR063689X136257_P1 | 10496 | 633 | 83.9 | globlastp |
| 3810 | LYD498 flaveria\|11v1\|SRR149229.119279_P1 | 10497 | 633 | 83.9 | globlastp |
| 3811 | LYD498 flaveria\|11v1\|SRR149229.286945_P1 | 10498 | 633 | 83.9 | globlastp |
| 3812 | LYD498 flaveria\|11v1\|SRR149241.105531_P1 | 10499 | 633 | 83.9 | globlastp |
| 3813 | LYD498 centaurea\|gb166\|EL930685_P1 | 10500 | 633 | 83.9 | globlastp |
| 3814 | LYD498 sequoia\|10v1\|SRR065044S0006484 | 10501 | 633 | 83.9 | globlastp |
| 3815 | LYD498 soybean\|11v1\|GLYMA05G36130 | 10502 | 633 | 83.9 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 3816 | LYD498 triphysaria\|10v1\|EX982490 | 10503 | 633 | 83.9 | globlastp |
| 3817 | LYD498 triphysaria\|10v1\|EY005747 | 10504 | 633 | 83.9 | globlastp |
| 3818 | LYD498 phyla\|11v2\|SRR099037X105809_T1 | 10505 | 633 | 83.9 | glotblastn |
| 3819 | LYD498 phyla\|11v2\|SRR099037X109786_T1 | 10506 | 633 | 83.9 | glotblastn |
| 3820 | LYD498 arnica\|11v1\|SRR099034X119194_P1 | 10507 | 633 | 83.5 | globlastp |
| 3821 | LYD498 guizotia\|10v1\|GE568246_T1 | 10508 | 633 | 83.5 | glotblastn |
| 3822 | LYD498 cephalotaxus\|11v1\|SRR064395X114707_P1 | 10509 | 633 | 83.4 | globlastp |
| 3823 | LYD498 distylium\|11v1\|SRR065077X103336_P1 | 10510 | 633 | 83.4 | globlastp |
| 3824 | LYD498 sciadopitys\|10v1\|SRR065035S0004910 | 10511 | 633 | 83.4 | globlastp |
| 3825 | LYD498 fagopyrum\|11v1\|SRR063703X108637_P1 | 10512 | 633 | 83.0 | globlastp |
| 3826 | LYD498 podocarpus\|10v1\|SRR065014S0002203_P1 | 10513 | 633 | 83.0 | globlastp |
| 3827 | LYD498 taxus\|10v1\|SRR032523S0022461 | 10514 | 633 | 83.0 | glotblastn |
| 3828 | LYD498 fagopyrum\|11v1\|SRR063689X109855_P1 | 10515 | 633 | 82.9 | globlastp |
| 3829 | LYD498 canola\|11v1\|EE470752_P1 | 10516 | 633 | 82.8 | globlastp |
| 3830 | LYD498 canola\|10v1\|AI352864 | 10516 | 633 | 82.8 | globlastp |
| 3831 | LYD498 canola\|11v1\|EV183065XX1_P1 | 10517 | 633 | 82.8 | globlastp |
| 3832 | LYD498 phyla\|11v2\|SRR099035X117261_P1 | 10518 | 633 | 82.6 | globlastp |
| 3833 | LYD498 cotton\|10v2\|CO108671_P1 | 10519 | 633 | 82.6 | globlastp |
| 3834 | LYD498 triphysaria\|10v1\|BM356736 | 10520 | 633 | 82.6 | globlastp |
| 3835 | LYD498 cryptomeria\|gb166\|BW995862_P1 | 10521 | 633 | 82.5 | globlastp |
| 3836 | LYD498 fagopyrum\|11v1\|SRR063689X113591_P1 | 10522 | 633 | 82.4 | globlastp |
| 3837 | LYD498 fagopyrum\|11v1\|SRR063689X127703_P1 | 10523 | 633 | 82.4 | globlastp |
| 3838 | LYD498 cycas\|gb166\|EX927010_P1 | 10524 | 633 | 82.4 | globlastp |
| 3839 | LYD498 ipomoea_nil\|10v1\|CJ746512_P1 | 10525 | 633 | 82.1 | globlastp |
| 3840 | LYD498 cucurbita\|11v1\|SRR091276X14686_T1 | 10526 | 633 | 81.9 | glotblastn |
| 3841 | LYD498 pteridium\|11v1\|SRR043594X108982_P1 | 10527 | 633 | 81.7 | globlastp |
| 3842 | LYD498 liquorice\|gb171\|FS240924_P1 | 10528 | 633 | 81.7 | globlastp |
| 3843 | LYD498 eucalyptus\|gb166\|CD669263 | 10529 | 633 | 81.5 | globlastp |
| 3844 | LYD498 radish\|gb164\|EV535191 | 10530 | 633 | 81.5 | globlastp |
| 3845 | LYD498 spruce\|gb162\|CO216024 | 10531 | 633 | 81.5 | globlastp |
| 3846 | LYD498 maritime_pine\|10v1\|BX252210_P1 | 10532 | 633 | 81.4 | globlastp |
| 3847 | LYD498 grape\|11v1\|GSVIVT01016913001_P1 | 10533 | 633 | 81.4 | globlastp |
| 3848 | LYD498 grape\|gb160\|BM436937 | 10533 | 633 | 81.4 | globlastp |
| 3849 | LYD498 cedrus\|11v1\|SRR065007X121874_P1 | 10534 | 633 | 81.3 | globlastp |
| 3850 | LYD498 silene\|11v1\|SRR096785X101704_P1 | 10535 | 633 | 81.3 | globlastp |
| 3851 | LYD498 cryptomeria\|gb166\|BP176690_P1 | 10536 | 633 | 81.1 | globlastp |
| 3852 | LYD498 abies\|11v2\|SRR098676X102221_P1 | 10537 | 633 | 81.0 | globlastp |
| 3853 | LYD498 pteridium\|11v1\|SRR043594X362552_T1 | 10538 | 633 | 81.0 | glotblastn |
| 3854 | LYD498 pine\|10v2\|AI920159_P1 | 10539 | 633 | 81.0 | globlastp |
| 3855 | LYD498 pseudotsuga\|10v1\|SRR065119S0010806 | 10540 | 633 | 81.0 | globlastp |
| 3856 | LYD498 banana\|10v1\|BBS657T3_T1 | 10541 | 633 | 80.9 | glotblastn |
| 3857 | LYD498 potato\|10v1\|BG890632_T1 | 10542 | 633 | 80.7 | glotblastn |
| 3858 | LYD498 cirsium\|11v1\|SRR346952.1021475_P1 | 10543 | 633 | 80.6 | globlastp |
| 3859 | LYD498 onion\|gb162\|CF438534_P1 | 10544 | 633 | 80.6 | globlastp |
| 3860 | LYD498 physcomitrella\|10v1\|BJ157643_P1 | 10545 | 633 | 80.6 | globlastp |
| 3861 | LYD498 acacia\|10v1\|FS590079_P1 | 10546 | 633 | 80.3 | globlastp |
| 3862 | LYD498 petunia\|gb171\|FN002441_P1 | 10547 | 633 | 80.2 | globlastp |
| 3863 | LYD498 marchantia\|gb166\|BJ840599_P1 | 10548 | 633 | 80.0 | globlastp |
| 3864 | LYD499 b_rapa\|gb162\|EX030739_P1 | 634 | 634 | 100.0 | globlastp |
| 3865 | LYD499 canola\|10v1\|CD828875 | 634 | 634 | 100.0 | globlastp |
| 3866 | LYD499 b_oleracea\|gb161\|EE534268_P1 | 10549 | 634 | 97.1 | globlastp |
| 3867 | LYD499 canola\|10v1\|EE430605 | 10550 | 634 | 97.1 | globlastp |
| 3868 | LYD499 radish\|gb164\|EV528245 | 10551 | 634 | 94.8 | globlastp |
| 3869 | LYD499 radish\|gb164\|EX887095 | 10552 | 634 | 92.1 | globlastp |
| 3870 | LYD499 b_rapa\|gb162\|EX039532_P1 | 10553 | 634 | 89.1 | globlastp |
| 3871 | LYD499 canola\|10v1\|EE430704 | 10553 | 634 | 89.1 | globlastp |
| 3872 | LYD499 radish\|gb164\|EV546649 | 10554 | 634 | 89.1 | glotblastn |
| 3873 | LYD499 thellungiella_parvulum\|11v1\|DN777906_P1 | 10555 | 634 | 88.8 | globlastp |
| 3874 | LYD499 arabidopsis\|10v1\|AT1G34000_P1 | 10556 | 634 | 88.7 | globlastp |
| 3875 | LYD499 canola\|11v1\|EE430704_T1 | 10557 | 634 | 88.0 | glotblastn |
| 3876 | LYD499 arabidopsis_lyrata\|09v1\|JGIAL003530_P1 | 10558 | 634 | 87.1 | globlastp |
| 3877 | LYD499 thellungiella_halophilum\|11v1\|DN777906_P1 | 10559 | 634 | 87.0 | globlastp |
| 3878 | LYD499 thellungiella\|gb167\|DN777906_P1 | 10559 | 634 | 87.0 | globlastp |
| 3879 | LYD500 canola\|11v1\|CD815130_P1 | 10560 | 635 | 98.2 | globlastp |
| 3880 | LYD500 thellungiella_parvulum\|11v1\|BY829606_P1 | 10561 | 635 | 81.9 | globlastp |
| 3881 | LYD500 b_rapa\|gb162\|EX017798_P1 | 10562 | 635 | 80.1 | globlastp |
| 3882 | LYD501 canola\|11v1\|SRR019556.25565_P1 | 10563 | 636 | 97.5 | globlastp |
| 3883 | LYD501 canola\|11v1\|SRR019556.19225_P1 | 10564 | 636 | 95.6 | globlastp |
| 3884 | LYD501 canola\|11v1\|EE434856_P1 | 10565 | 636 | 94.5 | globlastp |
| 3885 | LYD501 thellungiella_parvulum\|11v1\|DN774406_P1 | 10566 | 636 | 93.4 | globlastp |
| 3886 | LYD501 arabidopsis_lyrata\|09v1\|JGIAL014140_P1 | 10567 | 636 | 93.2 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 3887 | LYD501 thellungiella_halophilum\|11v1\|DN774406_P1 | 10568 | 636 | 92.9 | globlastp |
| 3888 | LYD501 radish\|gb164\|EX772185 | 10569 | 636 | 92.9 | globlastp |
| 3889 | LYD501 canola\|11v1\|EV126210XX1_P1 | 10570 | 636 | 92.1 | globlastp |
| 3890 | LYD501 canola\|10v1\|EV042598 | 10571 | 636 | 91.9 | globlastp |
| 3891 | LYD501 arabidopsis\|10v1\|AT2G30740_P1 | 10572 | 636 | 91.6 | globlastp |
| 3892 | LYD502 grape\|11v1\|GSVPIV1T01011412001_P1 | 10573 | 637 | 88.7 | globlastp |
| 3893 | LYD502 grape\|gb160\|CD012472 | 10573 | 637 | 88.7 | globlastp |
| 3894 | LYD502 euphorbia\|11v1\|AW862634_P1 | 10574 | 637 | 87.7 | globlastp |
| 3895 | LYD502 medicago\|09v1\|CA990105_P1 | 10575 | 637 | 86.0 | globlastp |
| 3896 | LYD502 peanut\|10v1\|DQ889532_P1 | 10576 | 637 | 86.0 | globlastp |
| 3897 | LYD502 pea\|11v1\|FG536378_P1 | 10577 | 637 | 84.1 | globlastp |
| 3898 | LYD502 primula\|11v1\|SRR098679X104124_P1 | 10578 | 637 | 83.0 | globlastp |
| 3899 | LYD502 cyamopsis\|10v1\|EG987384_T1 | 10579 | 637 | 82.2 | glotblastn |
| 3900 | LYD502 soybean\|11v1\|GLYMA19G02650 | 10580 | 637 | 81.8 | globlastp |
| 3901 | LYD502 prunus\|10v1\|CN491201 | 10581 | 637 | 80.2 | globlastp |
| 3902 | LYD503 sugarcane\|10v1\|BQ534608 | 10582 | 638 | 91.6 | glotblastn |
| 3903 | LYD503 maize\|10v1\|AA979951_P1 | 10583 | 638 | 91.4 | globlastp |
| 3904 | LYD503 sorghum\|09v1\|SB02G010190 | 10584 | 638 | 87.6 | globlastp |
| 3905 | LYD503 sorghum\|11v1\|SB02G010190_P1 | 10584 | 638 | 87.6 | globlastp |
| 3906 | LYD503 foxtail_millet\|11v3\|PHY7SI031265_M_P1 | 10585 | 638 | 87.3 | globlastp |
| 3907 | LYD503 foxtail_millet\|10v2\|SICRP010858 | 10585 | 638 | 87.3 | globlastp |
| 3908 | LYD503 millet\|10v1\|EB411088_P1 | 10586 | 638 | 87.3 | globlastp |
| 3909 | LYD503 cenchrus\|gb166\|BM084217_T1 | 10587 | 638 | 83.9 | glotblastn |
| 3910 | LYD504 trigonella\|11v1\|SRR066194X10801_P1 | 10588 | 639 | 98.1 | globlastp |
| 3911 | LYD504 chickpea\|09v2\|GR390741_P1 | 10589 | 639 | 91.7 | globlastp |
| 3912 | LYD504 cyamopsis\|10v1\|EG975658_P1 | 10590 | 639 | 88.5 | globlastp |
| 3913 | LYD504 soybean\|11v1\|GLYMA11G21480 | 10591 | 639 | 87.3 | globlastp |
| 3914 | LYD504 pigeonpea\|10v1\|SRR054580S0009230_P1 | 10592 | 639 | 86.0 | globlastp |
| 3915 | LYD504 peanut\|10v1\|CD038035_T1 | 10593 | 639 | 84.8 | glotblastn |
| 3916 | LYD504 lotus\|09v1\|LLBW629598_T1 | 10594 | 639 | 84.7 | glotblastn |
| 3917 | LYD504 cowpea\|gb166\|FC462094_P1 | 10595 | 639 | 84.1 | globlastp |
| 3918 | LYD504 bean\|gb167\|CA898550_P1 | 10596 | 639 | 83.4 | globlastp |
| 3919 | LYD504 bean\|gb167\|CA907680_P1 | 10596 | 639 | 83.4 | globlastp |
| 3920 | LYD505 trigonella\|11v1\|SRR066194X124780_P1 | 10597 | 640 | 93.9 | globlastp |
| 3921 | LYD505 lotus\|09v1\|LLAV774529_P1 | 10598 | 640 | 86.3 | globlastp |
| 3922 | LYD505 soybean\|11v1\|GLYMA15G38010 | 10599 | 640 | 86.0 | globlastp |
| 3923 | LYD505 cowpea\|gb166\|ES884208_P1 | 10600 | 640 | 85.1 | globlastp |
| 3924 | LYD505 soybean\|11v1\|GLYMA13G26960 | 10601 | 640 | 85.0 | globlastp |
| 3925 | LYD505 bean\|gb167\|CA907677_T1 | 10602 | 640 | 83.5 | glotblastn |
| 3926 | LYD506 trigonella\|11v1\|SRR066194X174735_P1 | 10603 | 641 | 93.7 | globlastp |
| 3927 | LYD506 soybean\|11v1\|GLYMA03G30030 | 10604 | 641 | 80.8 | globlastp |
| 3928 | LYD506 soybean\|11v1\|GLYMA03G30020 | 10605 | 641 | 80.5 | globlastp |
| 3929 | LYD506 soybean\|11v1\|GLYMA19G32910 | 10606 | 641 | 80.5 | globlastp |
| 3930 | LYD507 maize\|10v1\|BM335422_P1 | 10607 | 642 | 80.9 | globlastp |
| 3931 | LYD507 foxtail_millet\|11v3\|PHY7SI040097M_T1 | 10608 | 642 | 80.0 | glotblastn |
| 3932 | LYD508 sugarcane\|10v1\|CA071556 | 10609 | 643 | 98.5 | globlastp |
| 3933 | LYD508 maize\|10v1\|AI691903_P1 | 10610 | 643 | 95.4 | globlastp |
| 3934 | LYD508 rice\|gb170\|OS09G02284 | 10611 | 643 | 88.5 | globlastp |
| 3935 | LYD508 switchgrass\|gb167\|FE614098 | 10612 | 643 | 88.5 | globlastp |
| 3936 | LYD508 cenchrus\|gb166\|EB652688_P1 | 10613 | 643 | 88.1 | globlastp |
| 3937 | LYD508 millet\|10v1\|EVO454PM010396_P1 | 10614 | 643 | 87.8 | globlastp |
| 3938 | LYD508 foxtail_millet\|10v2\|FXTRMSLX00382068D1 | 10615 | 643 | 87.5 | globlastp |
| 3939 | LYD508 foxtail_millet\|11v3\|PHY7SI033113M_P1 | 10615 | 643 | 87.5 | globlastp |
| 3940 | LYD508 leymus\|gb166\|EG378054_P1 | 10616 | 643 | 85.2 | globlastp |
| 3941 | LYD508 wheat\|10v2\|BE443841 | 10617 | 643 | 84.3 | globlastp |
| 3942 | LYD508 barley\|10v2\|AW982792_P1 | 10618 | 643 | 83.4 | globlastp |
| 3943 | LYD508 brachypodium\|09v1\|DV473081_P1 | 10619 | 643 | 83.0 | globlastp |
| 3944 | LYD509 maize\|10v1\|BM380291_P1 | 10620 | 644 | 84.6 | globlastp |
| 3945 | LYD509 maize\|10v1\|ES701721_P1 | 10621 | 644 | 83.4 | globlastp |
| 3946 | LYD509 foxtail_millet\|11v3\|PHY7SI029614M_P1 | 10622 | 644 | 80.5 | globlastp |
| 3947 | LYD510 foxtail_millet\|11v3\|PHY7SI023676M_P1 | 10623 | 645 | 96.6 | globlastp |
| 3948 | LYD510 foxtail_millet\|10v2\|FXTSLX00242000D1 | 10623 | 645 | 96.6 | globlastp |
| 3949 | LYD510 maize\|10v1\|E511322_P1 | 10624 | 645 | 96.6 | globlastp |
| 3950 | LYD510 sugarcane\|10v1\|CA134051 | 10625 | 645 | 96.6 | globlastp |
| 3951 | LYD510 switchgrass\|gb167\|FL743200 | 10626 | 645 | 94.8 | globlastp |
| 3952 | LYD510 millet\|10v1\|EVO454PM025791_T1 | 10627 | 645 | 92.2 | glotblastn |
| 3953 | LYD510 rice\|gb170\|OS05G43680 | 10628 | 645 | 82.3 | globlastp |
| 3954 | LYD510 brachypodium\|09v1\|DV472501_T1 | 10629 | 645 | 80.2 | glotblastn |
| 3955 | LYD511 soybean\|11v1\|GLYMA08G02480 | 10630 | 646 | 91.5 | globlastp |
| 3956 | LYD511 pigeonpea\|10v1\|SRR054580S0293514_T1 | 10631 | 646 | 81.9 | glotblastn |
| 3957 | LYD512 cowpea\|gb166\|FC458039P1 |  | 647 | 647 | 100.0 globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 3958 | LYD512 cowpea\|gb166\|FC460613P1 | 647 | 647 | 100.0 | globlastp |
| 3959 | LYD512 cowpea\|gb166\|FF385728P1 | 647 | 647 | 100.0 | globlastp |
| 3960 | LYD512 bean\|gb167\|CA897309_P1 | 10632 | 647 | 98.5 | globlastp |
| 3961 | LYD512 bean\|gb167\|CA897313_P1 | 10632 | 647 | 98.5 | globlastp |
| 3962 | LYD512 cyamopsis\|10v1\|EG977272_P1 | 10633 | 647 | 98.5 | globlastp |
| 3963 | LYD512 liquorice\|gb171\|FS238732_P1 | 10634 | 647 | 98.5 | globlastp |
| 3964 | LYD512 liquorice\|gb171\|FS241431_P1 | 10634 | 647 | 98.5 | globlastp |
| 3965 | LYD512 pigeonpea\|10v1\|GW352356_P1 | 10634 | 647 | 98.5 | globlastp |
| 3966 | LYD512 pigeonpea\|10v1\|GW356722_P1 | 10634 | 647 | 98.5 | globlastp |
| 3967 | LYD512 cowpea\|gb166\|FF389530_T1 | 10635 | 647 | 98.5 | glotblastn |
| 3968 | LYD512 cucurbita\|11v1\|SRR091276X101745_P1 | 10636 | 647 | 96.9 | globlastp |
| 3969 | LYD512 cucurbita\|11v1\|SRR091276X104194_P1 | 10636 | 647 | 96.9 | globlastp |
| 3970 | LYD512 cucurbita\|11v1\|SRR091276X110453_P1 | 10636 | 647 | 96.9 | globlastp |
| 3971 | LYD512 trigonella\|11v1\|SRR066194X10487_P1 | 10637 | 647 | 96.9 | globlastp |
| 3972 | LYD512 bean\|gb167\|CA897315_P1 | 10638 | 647 | 96.9 | globlastp |
| 3973 | LYD512 chestnut\|gb170\|SRR006295S0001844_P1 | 10639 | 647 | 96.9 | globlastp |
| 3974 | LYD512 chickpea\|09v2\|GE213103_P1 | 10637 | 647 | 96.9 | globlastp |
| 3975 | LYD512 lotus\|09v1\|AW164064_P1 | 10640 | 647 | 96.9 | globlastp |
| 3976 | LYD512 lotus\|09v1\|GO005048_P1 | 10640 | 647 | 96.9 | globlastp |
| 3977 | LYD512 medicago\|09v1\|AW329043_P1 | 10637 | 647 | 96.9 | globlastp |
| 3978 | LYD512 medicago\|09v1\|LLCO512702_P1 | 10637 | 647 | 96.9 | globlastp |
| 3979 | LYD512 oak\|10v1\|AJ277600_P1 | 10639 | 647 | 96.9 | globlastp |
| 3980 | LYD512 oak\|10v1\|SRR006309S0008142_P1 | 10639 | 647 | 96.9 | globlastp |
| 3981 | LYD512 rose\|10v1\|EC586016 | 10641 | 647 | 96.9 | globlastp |
| 3982 | LYD512 strawberry\|11v1\|CO379241 | 10641 | 647 | 96.9 | globlastp |
| 3983 | LYD512 strawberry\|11v1\|CO381686 | 10641 | 647 | 96.9 | globlastp |
| 3984 | LYD512 walnuts\|gb166\|EL898181 | 10639 | 647 | 96.9 | globlastp |
| 3985 | LYD512 cucurbita\|11v1\|SRR091276X102492_P1 | 10642 | 647 | 95.4 | globlastp |
| 3986 | LYD512 cucurbita\|11v1\|SRR091276X103773_P1 | 10642 | 647 | 95.4 | globlastp |
| 3987 | LYD512 cucurbita\|11v1\|SRR091276X112166_P1 | 10642 | 647 | 95.4 | globlastp |
| 3988 | LYD512 cucurbita\|11v1\|SRR091276X163510_P1 | 10642 | 647 | 95.4 | globlastp |
| 3989 | LYD512 cucurbita\|11v1\|SRR091277X118300_P1 | 10642 | 647 | 95.4 | globlastp |
| 3990 | LYD512 fagopyrum\|11v1\|SRR063689X100344_P1 | 10643 | 647 | 95.4 | globlastp |
| 3991 | LYD512 fagopyrum\|11v1\|SRR063689X103955_P1 | 10643 | 647 | 95.4 | globlastp |
| 3992 | LYD512 fagopyrum\|11v1\|SRR063703X101467_P1 | 10643 | 647 | 95.4 | globlastp |
| 3993 | LYD512 fagopyrum\|11v1\|SRR063703X104553_P1 | 10643 | 647 | 95.4 | globlastp |
| 3994 | LYD512 fagopyrum\|11v1\|SRR063703X107234_P1 | 10643 | 647 | 95.4 | globlastp |
| 3995 | LYD512 flax\|11v1\|JG018952_P1 | 10644 | 647 | 95.4 | globlastp |
| 3996 | LYD512 humulus\|11v1\|1EX520567_P1 | 10645 | 647 | 95.4 | globlastp |
| 3997 | LYD512 tripterygium\|11v1\|SRR098677X100935_P1 | 10643 | 647 | 95.4 | globlastp |
| 3998 | LYD512 watermelon\|11v1\|DV632274_P1 | 10642 | 647 | 95.4 | globlastp |
| 3999 | LYD512 watermelon\|11v1\|DV632298_P1 | 10642 | 647 | 95.4 | globlastp |
| 4000 | LYD512 watermelon\|11v1\|SRR091276.104194_P1 | 10642 | 647 | 95.4 | globlastp |
| 4001 | LYD512 watermelon\|11v1\|VMEL00286303570595_P1 | 10642 | 647 | 95.4 | globlastp |
| 4002 | LYD512 watermelon\|11v1\|VMEL02965027672733_P1 | 10642 | 647 | 95.4 | globlastp |
| 4003 | LYD512 acacia\|10v1\|FS589645_P1 | 10646 | 647 | 95.4 | globlastp |
| 4004 | LYD512 cucumber\|09v1\|CK086170_P1 | 10642 | 647 | 95.4 | globlastp |
| 4005 | LYD512 cucumber\|09v1\|DV632274_P1 | 10642 | 647 | 95.4 | globlastp |
| 4006 | LYD512 cucumber\|09v1\|GD174009_P1 | 10642 | 647 | 95.4 | globlastp |
| 4007 | LYD512 ginseng\|10v1\|DV553922_P1 | 10647 | 647 | 95.4 | globlastp |
| 4008 | LYD512 lotus\|09v1\|CB828393_P1 | 10648 | 647 | 95.4 | globlastp |
| 4009 | LYD512 lotus\|09v1\|LLGO015051_P1 | 10649 | 647 | 95.4 | globlastp |
| 4010 | LYD512 melon\|10v1\|AM722796_P1 | 10642 | 647 | 95.4 | globlastp |
| 4011 | LYD512 melon\|10v1\|DV632274_P1 | 10642 | 647 | 95.4 | globlastp |
| 4012 | LYD512 momordica\|10v1\|SRR071315S0006351_P1 | 10642 | 647 | 95.4 | globlastp |
| 4013 | LYD512 momordica\|10v1\|SRR071315S0042009_P1 | 10642 | 647 | 95.4 | globlastp |
| 4014 | LYD512 grape\|11v1\|GSVPIV1T01033420001_P1 | 10650 | 647 | 95.4 | globlastp |
| 4015 | LYD512 cyamopsis\|10v1\|EG976339_T1 | 10651 | 647 | 95.4 | glotblastn |
| 4016 | LYD512 grape\|gb160\|CB973093 | 10652 | 647 | 95.4 | glotblastn |
| 4017 | LYD512 tripterygium\|11v1\|SRR098677X10933_T1 | — | 647 | 95.4 | glotblastn |
| 4018 | LYD512 bean\|gb167\|FG233896_P1 | 10653 | 647 | 94.1 | globlastp |
| 4019 | LYD512 ambrosia\|11v1\|GR935633_T1 | 10654 | 647 | 93.9 | glotblastn |
| 4020 | LYD512 bean\|gb167\|FG234354_T1 | 10655 | 647 | 93.9 | glotblastn |
| 4021 | LYD512 iceplant\|gb164\|MCU09194_T1 | 10656 | 647 | 93.9 | glotblastn |
| 4022 | LYD512 pigeonpea\|10v1\|GW359801_T1 | 10657 | 647 | 93.9 | glotblastn |
| 4023 | LYD512 ambrosia\|11v1\|SRR346943.10268_P1 | 10658 | 647 | 93.8 | globlastp |
| 4024 | LYD512 ambrosia\|11v1\|SRR346943.11293_P1 | 10658 | 647 | 93.8 | globlastp |
| 4025 | LYD512 ambrosia\|11v1\|SRR346943.186733_P1 | 10658 | 647 | 93.8 | globlastp |
| 4026 | LYD512 ambrosia\|11v1\|SRR346943.86054_P1 | 10658 | 647 | 93.8 | globlastp |
| 4027 | LYD512 amorphophallus\|11v2\|SRR089351X104367_P1 | 10659 | 647 | 93.8 | globlastp |
| 4028 | LYD512 amorphophallus\|11v2\|SRR089351X252922_P1 | 10659 | 647 | 93.8 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 4029 | LYD512 arnica\|11v1\|SRR099034X112842_P1 | 10658 | 647 | 93.8 | globlastp |
| 4030 | LYD512 cannabis\|12v1\|JK495592_P1 | 10660 | 647 | 93.8 | globlastp |
| 4031 | LYD512 cannabis\|12v1\|SOLX00008468_P1 | 10660 | 647 | 93.8 | globlastp |
| 4032 | LYD512 cirsium\|11v1\|SRR346952.1001225_P1 | 10658 | 647 | 93.8 | globlastp |
| 4033 | LYD512 cirsium\|11v1\|SRR346952.103566_P1 | 10658 | 647 | 93.8 | globlastp |
| 4034 | LYD512 cirsium\|11v1\|SRR346952.1145627_P1 | 10658 | 647 | 93.8 | globlastp |
| 4035 | LYD512 cirsium\|11v1\|SRR346952.385592_P1 | 10658 | 647 | 93.8 | globlastp |
| 4036 | LYD512 cirsium\|11v1\|SRR349641.117218_P1 | 10658 | 647 | 93.8 | globlastp |
| 4037 | LYD512 clementine\|11v1\|CB610765_P1 | 10661 | 647 | 93.8 | globlastp |
| 4038 | LYD512 cucurbita\|11v1\|SRR091276X110768_P1 | 10662 | 647 | 93.8 | globlastp |
| 4039 | LYD512 cucurbita\|11v1\|ISRR091276X2700_P1 | 10662 | 647 | 93.8 | globlastp |
| 4040 | LYD512 euonymus\|11v1\|SRR070038X103239_P1 | 10663 | 647 | 93.8 | globlastp |
| 4041 | LYD512 humulus\|11v1\|1EX515474_P1 | 10660 | 647 | 93.8 | globlastp |
| 4042 | LYD512 humulus\|11v1\|EX520211_P1 | 10660 | 647 | 93.8 | globlastp |
| 4043 | LYD512 humulus\|11v1\|SRR098683X83555_P1 | 10660 | 647 | 93.8 | globlastp |
| 4044 | LYD512 orange\|11v1\|CB610765_P1 | 10661 | 647 | 93.8 | globlastp |
| 4045 | LYD512 sarracenia\|11v1\|SRR192669.106226_P1 | 10664 | 647 | 93.8 | globlastp |
| 4046 | LYD512 sarracenia\|11v1\|SRR192669.10869_P1 | 10664 | 647 | 93.8 | globlastp |
| 4047 | LYD512 sarracenia\|11v1\|SRR192669.124981_P1 | 10664 | 647 | 93.8 | globlastp |
| 4048 | LYD512 sarracenia\|11v1\|SRR192669.126316_P1 | 10664 | 647 | 93.8 | globlastp |
| 4049 | LYD512 scabiosa\|11v1\|SRR063723X10141_P1 | 10665 | 647 | 93.8 | globlastp |
| 4050 | LYD512 scabiosa\|11v1\|SRR063723X101604_P1 | 10665 | 647 | 93.8 | globlastp |
| 4051 | LYD512 scabiosa\|11v1\|SRR063723X115084_P1 | 10665 | 647 | 93.8 | globlastp |
| 4052 | LYD512 valeriana\|11v1\|SRR099039X10965_P1 | 10665 | 647 | 93.8 | globlastp |
| 4053 | LYD512 artemisia\|10v1\|EY060633_P1 | 10658 | 647 | 93.8 | globlastp |
| 4054 | LYD512 b_juncea\|10v2\|BJ1SLX00504441_P1 | 10666 | 647 | 93.8 | globlastp |
| 4055 | LYD512 bean\|gb167\|FG233905_P1 | 10667 | 647 | 93.8 | globlastp |
| 4056 | LYD512 bean\|gb167\|FG233918_P1 | 10667 | 647 | 93.8 | globlastp |
| 4057 | LYD512 bean\|gb167\|FG234031_P1 | 10667 | 647 | 93.8 | globlastp |
| 4058 | LYD512 bean\|gb167\|FG234145_P1 | 10668 | 647 | 93.8 | globlastp |
| 4059 | LYD512 bean\|gb167\|FG234215_P1 | 10667 | 647 | 93.8 | globlastp |
| 4060 | LYD512 bean\|gb167\|FG234325_P1 | 10667 | 647 | 93.8 | globlastp |
| 4061 | LYD512 cacao\|10v1\|CU471657_P1 | 10666 | 647 | 93.8 | globlastp |
| 4062 | LYD512 centaurea\|gb166\|EH742423_P1 | 10658 | 647 | 93.8 | globlastp |
| 4063 | LYD512 centaurea\|gb166\|EH746092_P1 | 10658 | 647 | 93.8 | globlastp |
| 4064 | LYD512 cichorium\|gb171\|FL672664_P1 | 10658 | 647 | 93.8 | globlastp |
| 4065 | LYD512 citrus\|gb166\|CB610765_P1 | 10661 | 647 | 93.8 | globlastp |
| 4066 | LYD512 cynara\|gb167\|GE588251_P1 | 10658 | 647 | 93.8 | globlastp |
| 4067 | LYD512 dandelion\|10v1\|DR401370_P1 | 10658 | 647 | 93.8 | globlastp |
| 4068 | LYD512 dandelion\|10v1\|DY803766_P1 | 10658 | 647 | 93.8 | globlastp |
| 4069 | LYD512 gerbera\|09v1\|AJ752989_P1 | 10658 | 647 | 93.8 | globlastp |
| 4070 | LYD512 gerbera\|09v1\|AJ756810_P1 | 10658 | 647 | 93.8 | globlastp |
| 4071 | LYD512 gerbera\|09v1\|AJ758255_P1 | 10658 | 647 | 93.8 | globlastp |
| 4072 | LYD512 kiwi\|gb166\|FG501472_P1 | 10669 | 647 | 93.8 | globlastp |
| 4073 | LYD512 lettuce\|10v1\|DW048404_P1 | 10658 | 647 | 93.8 | globlastp |
| 4074 | LYD512 lettuce\|10v1\|DW053383_P1 | 10658 | 647 | 93.8 | globlastp |
| 4075 | LYD512 lettuce\|10v1\|DW057268_P1 | 10658 | 647 | 93.8 | globlastp |
| 4076 | LYD512 lettuce\|10v1\|DW077182_P1 | 10658 | 647 | 93.8 | globlastp |
| 4077 | LYD512 lettuce\|10v1\|DW080087_P1 | 10658 | 647 | 93.8 | globlastp |
| 4078 | LYD512 lettuce\|10v1\|DW085071_P1 | 10658 | 647 | 93.8 | globlastp |
| 4079 | LYD512 lettuce\|10v1\|DW103212_P1 | 10658 | 647 | 93.8 | globlastp |
| 4080 | LYD512 lettuce\|10v1\|DW105237_P1 | 10658 | 647 | 93.8 | globlastp |
| 4081 | LYD512 liriodendron\|gb166\|CK766794_P1 | 10659 | 647 | 93.8 | globlastp |
| 4082 | LYD512 liriodendron\|gb166\|FD495865_P1 | 10659 | 647 | 93.8 | globlastp |
| 4083 | LYD512 nuphar\|gb166\|CK744704_P1 | 10659 | 647 | 93.8 | globlastp |
| 4084 | LYD512 prunus\|10v1\|BU043749 | 10670 | 647 | 93.8 | globlastp |
| 4085 | LYD512 prunus\|10v1\|CN493550 | 10671 | 647 | 93.8 | globlastp |
| 4086 | LYD512 prunus\|10v1\|CV045040 | 10670 | 647 | 93.8 | globlastp |
| 4087 | LYD512 sunflower\|10v1\|BG734530 | 10658 | 647 | 93.8 | globlastp |
| 4088 | LYD512 sunflower\|10v1\|BU672107 | 10658 | 647 | 93.8 | globlastp |
| 4089 | LYD512 sunflower\|10v1\|CD846378 | 10658 | 647 | 93.8 | globlastp |
| 4090 | LYD512 sarracenia\|11v1\|SRR192669.129600_T1 | 10672 | 647 | 92.3 | glotblastn |
| 4091 | LYD512 bean\|gb167\|FG233907_T1 | 10673 | 647 | 92.3 | glotblastn |
| 4092 | LYD512 bean\|gb167\|FG234000_T1 | 10673 | 647 | 92.3 | glotblastn |
| 4093 | LYD512 bean\|gb167\|FG234020_T1 | 10674 | 647 | 92.3 | glotblastn |
| 4094 | LYD512 eschscholzia\|10v1\|CD477907 | 10675 | 647 | 92.3 | glotblastn |
| 4095 | LYD512 ginger\|gb164\|DY357985_T1 | 10676 | 647 | 92.3 | glotblastn |
| 4096 | LYD512 nicotiana_benthamiana\|gb162\|CK990201_T1 | 10677 | 647 | 92.3 | glotblastn |
| 4097 | LYD512 papaya\|gb165\|EX255081_T1 | 10678 | 647 | 92.3 | glotblastn |
| 4098 | LYD512 rice\|gb170\|OS03G07110 | 10679 | 647 | 92.3 | glotblastn |
| 4099 | LYD512 rye\|gb164\|BE494954 | 10680 | 647 | 92.3 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 4100 | LYD512 spurge\|gb161\|DV113063 | 10681 | 647 | 92.3 | glotblastn |
| 4101 | LYD512 wheat\|10v2\|CA598174 | 10682 | 647 | 92.3 | glotblastn |
| 4102 | LYD512 apple\|11v1\|MDCRP032659_P1 | 10683 | 647 | 92.3 | globlastp |
| 4103 | LYD512 arnica\|11v1\|SRR099034X13315_P1 | 10684 | 647 | 92.3 | globlastp |
| 4104 | LYD512 cannabis\|12v1\|EW701268_P1 | 10685 | 647 | 92.3 | globlastp |
| 4105 | LYD512 cannabis\|12v1\|SOLX00056818_P1 | 10685 | 647 | 92.3 | globlastp |
| 4106 | LYD512 castorbean\|11v1\|EV520036_P1 | 10686 | 647 | 92.3 | globlastp |
| 4107 | LYD512 euphorbia\|11v1\|BP954296_P1 | 10687 | 647 | 92.3 | globlastp |
| 4108 | LYD512 euphorbia\|11v1\|DV112391_P1 | 10687 | 647 | 92.3 | globlastp |
| 4109 | LYD512 euphorbia\|11v1\|DV113063_P1 | 10687 | 647 | 92.3 | globlastp |
| 4110 | LYD512 euphorbia\|11v1\|DV147404_P1 | 10688 | 647 | 92.3 | globlastp |
| 4111 | LYD512 euphorbia\|11v1\|SRR098678X1142_P1 | 10687 | 647 | 92.3 | globlastp |
| 4112 | LYD512 flaveria\|11v1\|SRR149229.135267_P1 | 10689 | 647 | 92.3 | globlastp |
| 4113 | LYD512 flaveria\|11v1\|SRR149229.366681XX1_P1 | 10689 | 647 | 92.3 | globlastp |
| 4114 | LYD512 flaveria\|11v1\|SRR149232.109123_P1 | 10689 | 647 | 92.3 | globlastp |
| 4115 | LYD512 flax\|11v1\|GW866471_P1 | 10690 | 647 | 92.3 | globlastp |
| 4116 | LYD512 foxtail_millet\|11v3\|EC613751_P1 | 10691 | 647 | 92.3 | globlastp |
| 4117 | LYD512 foxtail_millet\|11v3\|PHY7SI039832M_P1 | 10691 | 647 | 92.3 | globlastp |
| 4118 | LYD512 foxtail_millet\|11v3\|SICRP056006_P1 | 10691 | 647 | 92.3 | globlastp |
| 4119 | LYD512 grape\|11v1\|SRR010820X107901_P1 | 10692 | 647 | 92.3 | globlastp |
| 4120 | LYD512 oat\|11v1\|CN820781XX1_P1 | 10691 | 647 | 92.3 | globlastp |
| 4121 | LYD512 platanus\|11v1\|SRR096786X100883_P1 | 10693 | 647 | 92.3 | globlastp |
| 4122 | LYD512 platanus\|11v1\|SRR096786X102707_P1 | 10693 | 647 | 92.3 | globlastp |
| 4123 | LYD512 pteridium\|11v1\|SRR043594X224099_P1 | 10694 | 647 | 92.3 | globlastp |
| 4124 | LYD512 sorghum\|11v1\|BG411500_P1 | 10691 | 647 | 92.3 | globlastp |
| 4125 | LYD512 sorghum\|11v1\|SBCRP012633_P1 | 10691 | 647 | 92.3 | globlastp |
| 4126 | LYD512 vinca\|11v1\|SRR098690X133434_P1 | 10695 | 647 | 92.3 | globlastp |
| 4127 | LYD512 amborella\|gb166\|CK757356_P1 | 10696 | 647 | 92.3 | globlastp |
| 4128 | LYD512 antirrhinum\|gb166\|AJ788801_P1 | 10697 | 647 | 92.3 | globlastp |
| 4129 | LYD512 apple\|11v1\|CN493550_P1 | 10683 | 647 | 92.3 | globlastp |
| 4130 | LYD512 apple\|gb171\|CN493550 | 10683 | 647 | 92.3 | globlastp |
| 4131 | LYD512 artemisia\|10v1\|EX980208_P1 | 10698 | 647 | 92.3 | globlastp |
| 4132 | LYD512 avocado\|10v1\|FD502514_P1 | 10691 | 647 | 92.3 | globlastp |
| 4133 | LYD512 barley\|10v2\|BE411645_P1 | 10691 | 647 | 92.3 | globlastp |
| 4134 | LYD512 bean\|gb167\|FG233928_P1 | 10699 | 647 | 92.3 | globlastp |
| 4135 | LYD512 bean\|gb167\|FG233958_P1 | 10700 | 647 | 92.3 | globlastp |
| 4136 | LYD512 bean\|gb167\|FG234344_P1 | 10701 | 647 | 92.3 | globlastp |
| 4137 | LYD512 bean\|gb167\|FG234444_P1 | 10702 | 647 | 92.3 | globlastp |
| 4138 | LYD512 bean\|gb167\|FG234466_P1 | 10703 | 647 | 92.3 | globlastp |
| 4139 | LYD512 beet\|gb162\|BE590310_P1 | 10704 | 647 | 92.3 | globlastp |
| 4140 | LYD512 beet\|gb162\|BI543735_P1 | 10704 | 647 | 92.3 | globlastp |
| 4141 | LYD512 bruguiera\|gb166\|BP947364_P1 | 10705 | 647 | 92.3 | globlastp |
| 4142 | LYD512 castorbean\|09v1\|CF981315 | 10686 | 647 | 92.3 | globlastp |
| 4143 | LYD512 castorbean\|11v1\|CF981315_P1 | 10686 | 647 | 92.3 | globlastp |
| 4144 | LYD512 castorbean\|09v1\|XM002520742 | 10686 | 647 | 92.3 | globlastp |
| 4145 | LYD512 castorbean\|11v1\|XM_002520742_P1 | 10686 | 647 | 92.3 | globlastp |
| 4146 | LYD512 coffea\|10v1\|DV689839_P1 | 10686 | 647 | 92.3 | globlastp |
| 4147 | LYD512 cyamopsis\|10v1\|EG976863_P1 | 10706 | 647 | 92.3 | globlastp |
| 4148 | LYD512 cynodon\|10v1\|ES294749_P1 | 10691 | 647 | 92.3 | globlastp |
| 4149 | LYD512 eggplant\|10v1\|FS001805_P1 | 10707 | 647 | 92.3 | globlastp |
| 4150 | LYD512 flax\|09v1\|EU828803 | 10690 | 647 | 92.3 | globlastp |
| 4151 | LYD512 flax\|11v1\|EU828803_P1 | 10690 | 647 | 92.3 | globlastp |
| 4152 | LYD512 foxtail_millet\|10v2\|SICRP023444 | 10691 | 647 | 92.3 | globlastp |
| 4153 | LYD512 ginger\|gb164\|DY352028_P1 | 10708 | 647 | 92.3 | globlastp |
| 4154 | LYD512 grape\|11v1\|GSVIVT01033421001_P1 | 10709 | 647 | 92.3 | globlastp |
| 4155 | LYD512 grape\|gb160\|BQ798496 | 10709 | 647 | 92.3 | globlastp |
| 4156 | LYD512 heritiera\|10v1\|SRR005795S0046631_P1 | 10710 | 647 | 92.3 | globlastp |
| 4157 | LYD512 hevea\|10v1\|EC600148_P1 | 10686 | 647 | 92.3 | globlastp |
| 4158 | LYD512 hevea\|10v1\|EC604272_P1 | 10686 | 647 | 92.3 | globlastp |
| 4159 | LYD512 iceplant\|gb164\|BE034112_P1 | 10704 | 647 | 92.3 | globlastp |
| 4160 | LYD512 ipomoea_batatas\|10v1\|CB330617_P1 | 10711 | 647 | 92.3 | globlastp |
| 4161 | LYD512 ipomoea_batatas\|10v1\|EE875241_P1 | 10711 | 647 | 92.3 | globlastp |
| 4162 | LYD512 ipomoea_nil\|10v1\|BJ567448_P1 | 10711 | 647 | 92.3 | globlastp |
| 4163 | LYD512 ipomoea_nil\|10v1\|CJ741650_P1 | 10711 | 647 | 92.3 | globlastp |
| 4164 | LYD512 jatropha\|09v1\|GO246632_P1 | 10686 | 647 | 92.3 | globlastp |
| 4165 | LYD512 kiwi\|gb166\|FG502716_P1 | 10712 | 647 | 92.3 | globlastp |
| 4166 | LYD512 leymus\|gb166\|CN465789_P1 | 10691 | 647 | 92.3 | globlastp |
| 4167 | LYD512 liriodendron\|gb166\|CK757694_P1 | 10691 | 647 | 92.3 | globlastp |
| 4168 | LYD512 lolium\|10v1\|AU246272_P1 | 10691 | 647 | 92.3 | globlastp |
| 4169 | LYD512 lolium\|10v1\|SRR029314S0005569_P1 | 10691 | 647 | 92.3 | globlastp |
| 4170 | LYD512 lovegrass\|gb167\|EH193296_P1 | 10713 | 647 | 92.3 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 4171 | LYD512 maize\|10v1\|AI396175_P1 | 10691 | 647 | 92.3 | globlastp |
| 4172 | LYD512 maize\|10v1\|AW288648_P1 | 10691 | 647 | 92.3 | globlastp |
| 4173 | LYD512 maize\|10v1\|T18654_P1 | 10691 | 647 | 92.3 | globlastp |
| 4174 | LYD512 millet\|10v1\|CD726094_P1 | 10691 | 647 | 92.3 | globlastp |
| 4175 | LYD512 millet\|10v1\|EVO454PM003734_P1 | 10691 | 647 | 92.3 | globlastp |
| 4176 | LYD512 millet\|10v1\|EVO454PM063491_P1 | 10691 | 647 | 92.3 | globlastp |
| 4177 | LYD512 monkeyflower\|10v1\|CV519455_P1 | 10697 | 647 | 92.3 | globlastp |
| 4178 | LYD512 monkeyflower\|10v1\|DV206077_P1 | 10697 | 647 | 92.3 | globlastp |
| 4179 | LYD512 monkeyflower\|10v1\|DV207931_P1 | 10697 | 647 | 92.3 | globlastp |
| 4180 | LYD512 monkeyflower\|10v1\|DV209664_P1 | 10697 | 647 | 92.3 | globlastp |
| 4181 | LYD512 nicotiana_benthamiana\|gb162\|CN741435_P1 | 10714 | 647 | 92.3 | globlastp |
| 4182 | LYD512 nicotiana_benthamiana\|gb162\|ES885119_P1 | 10714 | 647 | 92.3 | globlastp |
| 4183 | LYD512 nuphar\|gb166\|FD383820_P1 | 10691 | 647 | 92.3 | globlastp |
| 4184 | LYD512 oat\|10v2\|CN821628 | 10691 | 647 | 92.3 | globlastp |
| 4185 | LYD512 oat\|10v2\|GO583896 | 10691 | 647 | 92.3 | globlastp |
| 4186 | LYD512 oat\|11v1\|GO583896_P1 | 10691 | 647 | 92.3 | globlastp |
| 4187 | LYD512 oat\|10v2\|GO585073 | 10691 | 647 | 92.3 | globlastp |
| 4188 | LYD512 oat\|11v1\|GO585073_P1 | 10691 | 647 | 92.3 | globlastp |
| 4189 | LYD512 oat\|10v2\|GO587378 | 10691 | 647 | 92.3 | globlastp |
| 4190 | LYD512 oat\|11v1\|GO587378_P1 | 10691 | 647 | 92.3 | globlastp |
| 4191 | LYD512 oat\|10v2\|SRR020741S0026729 | 10691 | 647 | 92.3 | globlastp |
| 4192 | LYD512 oat\|11v1\|GR342871_P1 | 10691 | 647 | 92.3 | globlastp |
| 4193 | LYD512 orobanche\|10v1\|SRR02349550039628_P1 | 10714 | 647 | 92.3 | globlastp |
| 4194 | LYD512 orobanche\|10v1\|SRR02349550069297_P1 | 10714 | 647 | 92.3 | globlastp |
| 4195 | LYD512 peanut\|10v1\|CD038141_P1 | 10715 | 647 | 92.3 | globlastp |
| 4196 | LYD512 peanut\|10v1\|CD038379_P1 | 10715 | 647 | 92.3 | globlastp |
| 4197 | LYD512 pepper\|gb171\|BM065338_P1 | 10716 | 647 | 92.3 | globlastp |
| 4198 | LYD512 pineapple\|10v1\|DV190712_P1 | 10713 | 647 | 92.3 | globlastp |
| 4199 | LYD512 podocarpus\|10v1\|SRR065014S0024252_P1 | 10717 | 647 | 92.3 | globlastp |
| 4200 | LYD512 podocarpus\|10v1\|SRR065014S0038461_P1 | 10717 | 647 | 92.3 | globlastp |
| 4201 | LYD512 podocarpus\|10v1\|SRR065014S0059317_P1 | 10717 | 647 | 92.3 | globlastp |
| 4202 | LYD512 prunus\|10v1\|CB818382 | 10718 | 647 | 92.3 | globlastp |
| 4203 | LYD512 pseudoroegneria\|gb167\|FF340312 | 10691 | 647 | 92.3 | globlastp |
| 4204 | LYD512 pseudoroegneria\|gb167\|FF352214 | 10691 | 647 | 92.3 | globlastp |
| 4205 | LYD512 rhizophora\|10v1\|SRR005793S0017882 | 10705 | 647 | 92.3 | globlastp |
| 4206 | LYD512 rice\|gb170\|CF291634 | 10691 | 647 | 92.3 | globlastp |
| 4207 | LYD512 rice\|gb170\|OS10G27174 | 10691 | 647 | 92.3 | globlastp |
| 4208 | LYD512 safflower\|gb162\|EL410796 | 10719 | 647 | 92.3 | globlastp |
| 4209 | LYD512 salvia\|10v1\|CV166059 | 10697 | 647 | 92.3 | globlastp |
| 4210 | LYD512 salvia\|10v1\|CV169895 | 10720 | 647 | 92.3 | globlastp |
| 4211 | LYD512 salvia\|10v1\|FE536283 | 10697 | 647 | 92.3 | globlastp |
| 4212 | LYD512 senecio\|gb170\|SRR006592S0002849 | 10721 | 647 | 92.3 | globlastp |
| 4213 | LYD512 solanum_phureja\|09v1\|SPHBG123654 | 10722 | 647 | 92.3 | globlastp |
| 4214 | LYD512 sorghum\|09v1\|SB01G038040 | 10691 | 647 | 92.3 | globlastp |
| 4215 | LYD512 sorghum\|11v1\|SB01G038040_P1 | 10691 | 647 | 92.3 | globlastp |
| 4216 | LYD512 sorghum\|09v1\|SB01G046070 | 10691 | 647 | 92.3 | globlastp |
| 4217 | LYD512 sorghum\|11v1\|SB01G046070_P1 | 10691 | 647 | 92.3 | globlastp |
| 4218 | LYD512 spurge\|gb161\|DV147404 | 10688 | 647 | 92.3 | globlastp |
| 4219 | LYD512 sugarcane\|10v1\|BQ535635 | 10691 | 647 | 92.3 | globlastp |
| 4220 | LYD512 sunflower\|10v1\|DY955911 | 10723 | 647 | 92.3 | globlastp |
| 4221 | LYD512 switchgrass\|gb167\|DN142123 | 10691 | 647 | 92.3 | globlastp |
| 4222 | LYD512 switchgrass\|gb167\|FE601372 | 10691 | 647 | 92.3 | globlastp |
| 4223 | LYD512 switchgrass\|gb167\|FE604013 | 10691 | 647 | 92.3 | globlastp |
| 4224 | LYD512 switchgrass\|gb167\|FE611374 | 10691 | 647 | 92.3 | globlastp |
| 4225 | LYD512 switchgrass\|gb167\|FE615672 | 10691 | 647 | 92.3 | globlastp |
| 4226 | LYD512 tea\|10v1\|CV014096 | 10711 | 647 | 92.3 | globlastp |
| 4227 | LYD512 tea\|10v1\|FE861592 | 10711 | 647 | 92.3 | globlastp |
| 4228 | LYD512 tobacco\|gb162\|BQ842950 | 10714 | 647 | 92.3 | globlastp |
| 4229 | LYD512 tobacco\|gb162\|CV015915 | 10714 | 647 | 92.3 | globlastp |
| 4230 | LYD512 tobacco\|gb162\|CV016915 | 10714 | 647 | 92.3 | globlastp |
| 4231 | LYD512 tobacco\|gb162\|CV018015 | 10714 | 647 | 92.3 | globlastp |
| 4232 | LYD512 tragopogon\|10v1\|SRR020205S0093929 | 10724 | 647 | 92.3 | globlastp |
| 4233 | LYD512 tragopogon\|10v1\|SRR020205S0127629 | 10724 | 647 | 92.3 | globlastp |
| 4234 | LYD512 wheat\|10v2\|AJ615357 | 10691 | 647 | 92.3 | globlastp |
| 4235 | LYD512 wheat\|10v2\|BE423756 | 10691 | 647 | 92.3 | globlastp |
| 4236 | LYD512 wheat\|10v2\|BE491999 | 10691 | 647 | 92.3 | globlastp |
| 4237 | LYD512 wheat\|10v2\|BF291756 | 10691 | 647 | 92.3 | globlastp |
| 4238 | LYD512 wheat\|10v2\|CA485457 | 10691 | 647 | 92.3 | globlastp |
| 4239 | LYD512 wheat\|10v2\|CA635178 | 10691 | 647 | 92.3 | globlastp |
| 4240 | LYD512 wheat\|10v2\|CD892035 | 10691 | 647 | 92.3 | globlastp |
| 4241 | LYD512 flax\|11v1\|EH792097_P1 | 10690 | 647 | 92.3 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 4242 | LYD512 aquilegia|10v2|DT738899_P1 | 10725 | 647 | 92.3 | globlastp |
| 4243 | LYD512 aquilegia|10v2|DT738899 | — | 647 | 92.3 | globlastp |
| 4244 | LYD512 papaya|gb165|EX279085_P1 | 10726 | 647 | 90.9 | globlastp |
| 4245 | LYD512 amsonia|11v1|SRR098688X123009_P1 | 10727 | 647 | 90.8 | globlastp |
| 4246 | LYD512 amsonia|11v1|SRR098688X238562_P1 | 10727 | 647 | 90.8 | globlastp |
| 4247 | LYD512 apple|11v1|MDCRP029240_P1 | 10728 | 647 | 90.8 | globlastp |
| 4248 | LYD512 apple|11v1|MDCRP032863_P1 | 10728 | 647 | 90.8 | globlastp |
| 4249 | LYD512 catharanthus|11v1|EG557054_P1 | 10727 | 647 | 90.8 | globlastp |
| 4250 | LYD512 catharanthus|11v1|EG559238_P1 | 10727 | 647 | 90.8 | globlastp |
| 4251 | LYD512 distylium|11v1|SRR065077X106870_P1 | 10729 | 647 | 90.8 | globlastp |
| 4252 | LYD512 eucalyptus|11v2|CU394512_P1 | 10730 | 647 | 90.8 | globlastp |
| 4253 | LYD512 flaveria|11v1|SRR149229.160224_P1 | 10731 | 647 | 90.8 | globlastp |
| 4254 | LYD512 flaveria|11v1|SRR149232.317546_P1 | 10731 | 647 | 90.8 | globlastp |
| 4255 | LYD512 flaveria|11v1|SRR149241.125082_P1 | 10731 | 647 | 90.8 | globlastp |
| 4256 | LYD512 phalaenopsis|11v1|SRR125771.1005582_P1 | 10732 | 647 | 90.8 | globlastp |
| 4257 | LYD512 phalaenopsis|11v1|SRR125771.1009932_P1 | 10732 | 647 | 90.8 | globlastp |
| 4258 | LYD512 phalaenopsis|11v1|SRR125771.1045870_P1 | 10732 | 647 | 90.8 | globlastp |
| 4259 | LYD512 phyla|11v2|SRR099035X16238_P1 | 10727 | 647 | 90.8 | globlastp |
| 4260 | LYD512 phyla|11v2|SRR099035X37513_P1 | 10733 | 647 | 90.8 | globlastp |
| 4261 | LYD512 phyla|11v2|SRR099037X100392_P1 | 10734 | 647 | 90.8 | globlastp |
| 4262 | LYD512 phyla|11v2|SRR099037X105459_P1 | 10734 | 647 | 90.8 | globlastp |
| 4263 | LYD512 platanus|11v1|SRR096786X120365_P1 | 10735 | 647 | 90.8 | globlastp |
| 4264 | LYD512 silene|11v1|SRR096785X118399_P1 | 10736 | 647 | 90.8 | globlastp |
| 4265 | LYD512 tabernaemontana|11v1|SRR098689X103459_P1 | 10727 | 647 | 90.8 | globlastp |
| 4266 | LYD512 tabernaemontana|11v1|SRR098689X103799_P1 | 10727 | 647 | 90.8 | globlastp |
| 4267 | LYD512 tomato|11v1|BG129356_P1 | 10737 | 647 | 90.8 | globlastp |
| 4268 | LYD512 utricularia|11v1|SRR094438.10025_P1 | 10738 | 647 | 90.8 | globlastp |
| 4269 | LYD512 utricularia|11v1|SRR094438.19335_P1 | 10738 | 647 | 90.8 | globlastp |
| 4270 | LYD512 antirrhinum|gb166|AJ558324_P1 | 10739 | 647 | 90.8 | globlastp |
| 4271 | LYD512 antirrhinum|gb166|AJ788631_P1 | 10739 | 647 | 90.8 | globlastp |
| 4272 | LYD512 apple|gb171|CN488836 | 10728 | 647 | 90.8 | globlastp |
| 4273 | LYD512 apple|gb171|CN492778 | 10728 | 647 | 90.8 | globlastp |
| 4274 | LYD512 apple|11v1|CN489200_P1 | 10728 | 647 | 90.8 | globlastp |
| 4275 | LYD512 apple|gb171|CN903314 | 10728 | 647 | 90.8 | globlastp |
| 4276 | LYD512 banana|10v1|DN239597_P1 | 10740 | 647 | 90.8 | globlastp |
| 4277 | LYD512 banana|10v1|FF558846_P1 | 10741 | 647 | 90.8 | globlastp |
| 4278 | LYD512 banana|10v1|FF561910_P1 | 10741 | 647 | 90.8 | globlastp |
| 4279 | LYD512 banana|10v1|FL657436_P1 | 10741 | 647 | 90.8 | globlastp |
| 4280 | LYD512 bean|gb167|FG233922_P1 | 10742 | 647 | 90.8 | globlastp |
| 4281 | LYD512 bean|gb167|FG233944_P1 | 10743 | 647 | 90.8 | globlastp |
| 4282 | LYD512 bean|gb167|FG233954_P1 | 10744 | 647 | 90.8 | globlastp |
| 4283 | LYD512 bean|gb167|FG233980_P1 | 10745 | 647 | 90.8 | globlastp |
| 4284 | LYD512 bean|gb167|FG233984_P1 | 10745 | 647 | 90.8 | globlastp |
| 4285 | LYD512 bean|gb167|FG234048_P1 | 10746 | 647 | 90.8 | globlastp |
| 4286 | LYD512 bean|gb167|FG234259_P1 | 10745 | 647 | 90.8 | globlastp |
| 4287 | LYD512 bean|gb167|FG234334_P1 | 10747 | 647 | 90.8 | globlastp |
| 4288 | LYD512 brachypodium|09v1|DV469351_P1 | 10748 | 647 | 90.8 | globlastp |
| 4289 | LYD512 brachypodium|09v1|DV473284_P1 | 10748 | 647 | 90.8 | globlastp |
| 4290 | LYD512 brachypodium|09v1|GT762582_P1 | 10748 | 647 | 90.8 | globlastp |
| 4291 | LYD512 bruguiera|gb166|BP938755_P1 | 10749 | 647 | 90.8 | globlastp |
| 4292 | LYD512 cassava|09v1|CK645311_P1 | 10750 | 647 | 90.8 | globlastp |
| 4293 | LYD512 cassava|09v1|CK651521_P1 | 10750 | 647 | 90.8 | globlastp |
| 4294 | LYD512 cassava|09v1| DV454666_P1 | 10751 | 647 | 90.8 | globlastp |
| 4295 | LYD512 catharanthus|gb166|EG557054 | 10727 | 647 | 90.8 | globlastp |
| 4296 | LYD512 catharanthus|gb166|EG559238 | 10727 | 647 | 90.8 | globlastp |
| 4297 | LYD512 cotton|10v2|BG440579_P1 | 10752 | 647 | 90.8 | globlastp |
| 4298 | LYD512 cotton|10v2|DT053340_P1 | 10752 | 647 | 90.8 | globlastp |
| 4299 | LYD512 cotton|10v2|SRR032367S0060293_P1 | 10752 | 647 | 90.8 | globlastp |
| 4300 | LYD512 cotton|10v2|SRR032878S0078188_P1 | 10752 | 647 | 90.8 | globlastp |
| 4301 | LYD512 eucalyptus|11v2|CT981374_P1 | 10730 | 647 | 90.8 | globlastp |
| 4302 | LYD512 eucalyptus|gb166|CT981374 | 10730 | 647 | 90.8 | globlastp |
| 4303 | LYD512 eucalyptus|11v2|CU399026_P1 | 10753 | 647 | 90.8 | globlastp |
| 4304 | LYD512 eucalyptus|gb166|CU399026 | 10754 | 647 | 90.8 | globlastp |
| 4305 | LYD512 flax|09v1|EH792097 | 10755 | 647 | 90.8 | globlastp |
| 4306 | LYD512 gnetum|10v1|SRRP0164399S0107325_P1 | 10756 | 647 | 90.8 | globlastp |
| 4307 | LYD512 jatropha|09v1|GH295591_P1 | 10757 | 647 | 90.8 | globlastp |
| 4308 | LYD512 marchantia|gb166|AU082043_P1 | 10758 | 647 | 90.8 | globlastp |
| 4309 | LYD512 monkeyflower|10v1|DV208958_P1 | 10739 | 647 | 90.8 | globlastp |
| 4310 | LYD512 monkeyflower|10v1|SRR037228S0094987_P1 | 10759 | 647 | 90.8 | globlastp |
| 4311 | LYD512 nasturtium|10v1|GH171232 | 10760 | 647 | 90.8 | globlastp |
| 4312 | LYD512 oil_palm|gb166|EL608946_P1 | 10761 | 647 | 90.8 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 4313 | LYD512 peanut\|10v1\|EE127578_P1 | 10762 | 647 | 90.8 | globlastp |
| 4314 | LYD512 peanut\|10v1\|ES717260_P1 | 10762 | 647 | 90.8 | globlastp |
| 4315 | LYD512 petunia\|gb171\|CV293879_P1 | 10763 | 647 | 90.8 | globlastp |
| 4316 | LYD512 petunia\|gb171\|DY395623_P1 | 10763 | 647 | 90.8 | globlastp |
| 4317 | LYD512 poplar\|10v1\|AI166801_P1 | 10764 | 647 | 90.8 | globlastp |
| 4318 | LYD512 poplar\|10v1\|BI120216_P1 | 10764 | 647 | 90.8 | globlastp |
| 4319 | LYD512 poppy\|gb166\|FE968115_P1 | 10765 | 647 | 90.8 | globlastp |
| 4320 | LYD512 salvia\|10v1\|SRR014553S0000068 | 10739 | 647 | 90.8 | globlastp |
| 4321 | LYD512 salvia\|10v1\|SRR014553S0001112 | 10734 | 647 | 90.8 | globlastp |
| 4322 | LYD512 senecio\|gb170\|SRR006592S0021285 | 10766 | 647 | 90.8 | globlastp |
| 4323 | LYD512 solanum_phureja\|09v1\|SPHBG129356 | 10737 | 647 | 90.8 | globlastp |
| 4324 | LYD512 sugarcane\|10v1\|BQ529658 | 10767 | 647 | 90.8 | globlastp |
| 4325 | LYD512 tea\|10v1\|FE861346 | 10768 | 647 | 90.8 | globlastp |
| 4326 | LYD512 tomato\|09v1\|BG129356 | 10737 | 647 | 90.8 | globlastp |
| 4327 | LYD512 zostera\|10v1\|AM772996 | 10769 | 647 | 90.8 | globlastp |
| 4328 | LYD512 utricularia\|11v1\|SRR094438.104599_T1 | 10770 | 647 | 90.8 | glotblastn |
| 4329 | LYD512 apple\|11v1\|CN488836_T1 | 10771 | 647 | 90.8 | glotblastn |
| 4330 | LYD512 bean\|gb167\|FG233897_T1 | 10673 | 647 | 90.8 | glotblastn |
| 4331 | LYD512 bean\|gb167\|FG233936_T1 | 10772 | 647 | 90.8 | glotblastn |
| 4332 | LYD512 bean\|gb167\|FG234167_T1 | 10773 | 647 | 90.8 | glotblastn |
| 4333 | LYD512 bean\|gb167\|FG234195_T1 | 10774 | 647 | 90.8 | glotblastn |
| 4334 | LYD512 bean\|gb167\|FG234289_T1 | 10775 | 647 | 90.8 | glotblastn |
| 4335 | LYD512 bean\|gb167\|FG234297_T1 | 10772 | 647 | 90.8 | glotblastn |
| 4336 | LYD512 cichorium\|gb171\|EH702681_T1 | 10776 | 647 | 90.8 | glotblastn |
| 4337 | LYD512 millet\|10v1\|EVO454PM036750_T1 | 10777 | 647 | 90.8 | glotblastn |
| 4338 | LYD512 oil_palm\|gb166\|ES273939_T1 | 10778 | 647 | 90.8 | glotblastn |
| 4339 | LYD512 cichorium\|gb171\|FL681407_T1 | — | 647 | 90.8 | glotblastn |
| 4340 | LYD512 pteridium\|11v1\|SRR043594X104518_T1 | 10779 | 647 | 89.2 | glotblastn |
| 4341 | LYD512 sarracenia\|11v1\|SRR192669.424846_T1 | 10780 | 647 | 89.2 | glotblastn |
| 4342 | LYD512 bean\|gb167\|FG233854_T1 | 10781 | 647 | 89.2 | glotblastn |
| 4343 | LYD512 bean\|gb167\|FG234018_T1 | 10782 | 647 | 89.2 | glotblastn |
| 4344 | LYD512 bean\|gb167\|FG234474_T1 | 10783 | 647 | 89.2 | glotblastn |
| 4345 | LYD512 papaya\|gb165\|EX288740_T1 | 10784 | 647 | 89.2 | glotblastn |
| 4346 | LYD512 thalictrum\|11v1\|SRR096787X101011_T1 | — | 647 | 89.2 | glotblastn |
| 4347 | LYD512 thalictrum\|11v1\|SRR096787X101305_T1 | — | 647 | 89.2 | glotblastn |
| 4348 | LYD512 catharanthus\|11v1\|EG559177_P1 | 10785 | 647 | 89.2 | globlastp |
| 4349 | LYD512 cephalotaxus\|11v1\|SRR064395X112971_P1 | 10786 | 647 | 89.2 | globlastp |
| 4350 | LYD512 cephalotaxus\|11v1\|SRR064395X146406_P1 | 10786 | 647 | 89.2 | globlastp |
| 4351 | LYD512 fraxinus\|11v1\|SRR058827.108765_P1 | 10787 | 647 | 89.2 | globlastp |
| 4352 | LYD512 fraxinus\|11v1\|SRR058827.113258_P1 | 10787 | 647 | 89.2 | globlastp |
| 4353 | LYD512 fraxinus\|11v1\|SRR058827.11700_P1 | 10787 | 647 | 89.2 | globlastp |
| 4354 | LYD512 fraxinus\|11v1\|SRR058827.144119_P1 | 10787 | 647 | 89.2 | globlastp |
| 4355 | LYD512 fraxinus\|11v1\|SRR058827.162531_P1 | 10787 | 647 | 89.2 | globlastp |
| 4356 | LYD512 fraxinus\|11v1\|SRR058827.24084_P1 | 10787 | 647 | 89.2 | globlastp |
| 4357 | LYD512 olea\|11v1\|SRR014464.22806_P1 | 10787 | 647 | 89.2 | globlastp |
| 4358 | LYD512 primula\|11v1\|SRR098679X101655_P1 | 10788 | 647 | 89.2 | globlastp |
| 4359 | LYD512 primula\|11v1\|SRR098679X125030_P1 | 10788 | 647 | 89.2 | globlastp |
| 4360 | LYD512 primula\|11v1\|SRR098679X136794_P1 | 10788 | 647 | 89.2 | globlastp |
| 4361 | LYD512 primula\|11v1\|SRRP0198679X187414_P1 | 10788 | 647 | 89.2 | globlastp |
| 4362 | LYD512 silene\|11v1\|SRR096785X123206_P1 | 10789 | 647 | 89.2 | globlastp |
| 4363 | LYD512 trigonella\|11v1\|SRR066194X111163_P1 | 10790 | 647 | 89.2 | globlastp |
| 4364 | LYD512 vinca\|11v1\|SRR098690X12826_P1 | 10791 | 647 | 89.2 | globlastp |
| 4365 | LYD512 vinca\|11v1\|SRR098690X131404_P1 | 10792 | 647 | 89.2 | globlastp |
| 4366 | LYD512 aristolochia\|10v1\|SRR039083S0089926_P1 | 10793 | 647 | 89.2 | globlastp |
| 4367 | LYD512 banana\|10v1\|FF558706_P1 | 10794 | 647 | 89.2 | globlastp |
| 4368 | LYD512 bean\|gb167\|FG233895_P1 | 10795 | 647 | 89.2 | globlastp |
| 4369 | LYD512 bean\|gb167\|FG234253_P1 | 10796 | 647 | 89.2 | globlastp |
| 4370 | LYD512 bean\|gb167\|FG234255_P1 | 10797 | 647 | 89.2 | globlastp |
| 4371 | LYD512 bean\|gb167\|FG234309_P1 | 10798 | 647 | 89.2 | globlastp |
| 4372 | LYD512 bean\|gb167\|FG234440_P1 | 10799 | 647 | 89.2 | globlastp |
| 4373 | LYD512 ceratodon\|10v1\|SRR074890S0001398_P1 | 10800 | 647 | 89.2 | globlastp |
| 4374 | LYD512 cryptomeria\|gb166\|BW992478_P1 | 10801 | 647 | 89.2 | globlastp |
| 4375 | LYD512 cycas\|gb166\|DR062568_P1 | 10802 | 647 | 89.2 | globlastp |
| 4376 | LYD512 cycas\|gb166\|EX921162_P1 | 10802 | 647 | 89.2 | globlastp |
| 4377 | LYD512 eggplant\|10v1\|FS000481_P1 | 10803 | 647 | 89.2 | globlastp |
| 4378 | LYD512 eggplant\|10v1\|FS009241_P1 | 10804 | 647 | 89.2 | globlastp |
| 4379 | LYD512 fern\|gb171\|DK943628_P1 | 10805 | 647 | 89.2 | globlastp |
| 4380 | LYD512 monkeyflower\|10v1\|CRPMG022776_P1 | 10806 | 647 | 89.2 | globlastp |
| 4381 | LYD512 nasturtium\|10v1\|GH171790 | 10807 | 647 | 89.2 | globlastp |
| 4382 | LYD512 pepper\|gb171\|CA518060_P1 | 10808 | 647 | 89.2 | globlastp |
| 4383 | LYD512 physcomitrella\|10v1\|AW145617_P1 | 10800 | 647 | 89.2 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 4384 | LYD512 physcomitrella\|10v1\|AW509882_P1 | 10800 | 647 | 89.2 | globlastp |
| 4385 | LYD512 physcomitrella\|10v1\|BG362532_P1 | 10800 | 647 | 89.2 | globlastp |
| 4386 | LYD512 sciadopitys\|10v1\|SRR065035S0001902 | 10809 | 647 | 89.2 | globlastp |
| 4387 | LYD512 sciadopitys\|10v1\|SRR065035S0010668 | 10809 | 647 | 89.2 | globlastp |
| 4388 | LYD512 senecio\|gb170\|SRR006592S0003943 | 10810 | 647 | 89.2 | globlastp |
| 4389 | LYD512 tamarix\|gb166\|CF199299 | 10811 | 647 | 89.2 | globlastp |
| 4390 | LYD512 taxus\|10v1\|SRR032523S0023730 | 10812 | 647 | 89.2 | globlastp |
| 4391 | LYD512 taxus\|10v1\|SRR065067S0012236 | 10786 | 647 | 89.2 | globlastp |
| 4392 | LYD512 wheat\|10v2\|CA656149 | 10813 | 647 | 89.2 | globlastp |
| 4393 | LYD512 zamia\|gb166\|DY033734 | 10814 | 647 | 89.2 | globlastp |
| 4394 | LYD512 zostera\|10v1\|SRR057351S0008141 | 10815 | 647 | 89.2 | globlastp |
| 4395 | LYD512 abies\|11v2\|SRR098676X15713_P1 | 10816 | 647 | 87.7 | globlastp |
| 4396 | LYD512 canola\|11v1\|CN730151_P1 | 10817 | 647 | 87.7 | globlastp |
| 4397 | LYD512 canola\|11v1\|EE451330_P1 | 10817 | 647 | 87.7 | globlastp |
| 4398 | LYD512 canola\|11v1\|EE452234_P1 | 10817 | 647 | 87.7 | globlastp |
| 4399 | LYD512 canola\|11v1\|SRR019556.29018_P1 | 10817 | 647 | 87.7 | globlastp |
| 4400 | LYD512 canola\|11v1\|SRR329674.394963_P1 | 10818 | 647 | 87.7 | globlastp |
| 4401 | LYD512 cedrus\|11v1\|SRR065007X10175_P1 | 10819 | 647 | 87.7 | globlastp |
| 4402 | LYD512 cedrus\|11v1\|SRR065007X120542_P1 | 10819 | 647 | 87.7 | globlastp |
| 4403 | LYD512 maritime_pine\|10v1\|AL749710_P1 | 10819 | 647 | 87.7 | globlastp |
| 4404 | LYD512 maritime_pine\|10v1\|BX249765_P1 | 10819 | 647 | 87.7 | globlastp |
| 4405 | LYD512 plantago\|11v1\|SRR066373X100013_P1 | 10820 | 647 | 87.7 | globlastp |
| 4406 | LYD512 plantago\|11v1\|SRRP1066373X103996_P1 | 10820 | 647 | 87.7 | globlastp |
| 4407 | LYD512 plantago\|11v1\|SRRP1066373X111155_P1 | 10820 | 647 | 87.7 | globlastp |
| 4408 | LYD512 pteridium\|11v1\|SRR043594X103046_P1 | 10821 | 647 | 87.7 | globlastp |
| 4409 | LYD512 thellungiella_halophilum\|11v1\|EC599152_P1 | 10817 | 647 | 87.7 | globlastp |
| 4410 | LYD512 thellungiella_halophilum\|11v1\|EHCRP007876_P1 | 10817 | 647 | 87.7 | globlastp |
| 4411 | LYD512 thellungiella_halophilum\|11v1\|EHCRP042937_P1 | 10817 | 647 | 87.7 | globlastp |
| 4412 | LYD512 thellungiella_halophilum\|11v1\|EHJGI11017827_P1 | 10817 | 647 | 87.7 | globlastp |
| 4413 | LYD512 thellungiella_parvulum\|11v1\|EPCRP006143_P1 | 10817 | 647 | 87.7 | globlastp |
| 4414 | LYD512 thellungiella_parvulum\|11v1\|EPCRP026792_P1 | 10817 | 647 | 87.7 | globlastp |
| 4415 | LYD512 arabidopsis_lyrata\|09v1\|BQ834531_P1 | 10818 | 647 | 87.7 | globlastp |
| 4416 | LYD512 arabidopsis_lyrata\|09v1\|JGIAL006510_P1 | 10818 | 647 | 87.7 | globlastp |
| 4417 | LYD512 arabidopsis_lyrata\|09v1\|JGIAL009424_P1 | 10818 | 647 | 87.7 | globlastp |
| 4418 | LYD512 arabidopsis_lyrata\|09v1\|JGIAL020026_P1 | 10818 | 647 | 87.7 | globlastp |
| 4419 | LYD512 arabidopsis_lyrata\|09v1\|JGIAL031084_P1 | 10818 | 647 | 87.7 | globlastp |
| 4420 | LYD512 arabidopsis\|10v1\|AT3G10090_P1 | 10818 | 647 | 87.7 | globlastp |
| 4421 | LYD512 arabidopsis\|10v1\|AT5G03850_P1 | 10818 | 647 | 87.7 | globlastp |
| 4422 | LYD512 b_juncea\|10v2\|BJ1SLX00016868D1_P1 | 10817 | 647 | 87.7 | globlastp |
| 4423 | LYD512 b_juncea\|10v2\|E6ANDIZ01A1L7C_P1 | 10817 | 647 | 87.7 | globlastp |
| 4424 | LYD512 b_juncea\|10v2\|E6ANDIZ01A3MZ4_P1 | 10818 | 647 | 87.7 | globlastp |
| 4425 | LYD512 b_juncea\|10v2\|E6ANDIZ01A5CNE_P1 | 10818 | 647 | 87.7 | globlastp |
| 4426 | LYD512 b_juncea\|10v2\|E6ANDIZ01AGZHD_P1 | 10818 | 647 | 87.7 | globlastp |
| 4427 | LYD512 b_juncea\|10v2\|E6ANDIZ01AP5N3_P1 | 10817 | 647 | 87.7 | globlastp |
| 4428 | LYD512 b_juncea\|10v2\|E6ANDIZ01AXXOZ_P1 | 10817 | 647 | 87.7 | globlastp |
| 4429 | LYD512 b_juncea\|10v2\|E6ANDIZ01BDAJ2_P1 | 10818 | 647 | 87.7 | globlastp |
| 4430 | LYD512 b_juncea\|10v2\|E6ANDIZ01BYY46_P1 | 10818 | 647 | 87.7 | globlastp |
| 4431 | LYD512 b_juncea\|10v2\|E6ANDIZ01CH5EY_P1 | 10817 | 647 | 87.7 | globlastp |
| 4432 | LYD512 b_juncea\|10v2\|E6ANDIZ01CLNTO_P1 | 10818 | 647 | 87.7 | globlastp |
| 4433 | LYD512 b_juncea\|10v2\|E6ANDIZ01D2EJZ_P1 | 10818 | 647 | 87.7 | globlastp |
| 4434 | LYD512 b_juncea\|10v2\|E6ANDIZ01D5ENC_P1 | 10817 | 647 | 87.7 | globlastp |
| 4435 | LYD512 b_juncea\|10v2\|E6ANDIZ02HHV0U_P1 | 10817 | 647 | 87.7 | globlastp |
| 4436 | LYD512 b_juncea\|10v2\|E6ANDIZ02HMQ03_P1 | 10818 | 647 | 87.7 | globlastp |
| 4437 | LYD512 b_juncea\|10v2\|E7FJ1I303C57S6_P1 | 10818 | 647 | 87.7 | globlastp |
| 4438 | LYD512 b_oleracea\|gb161\|AM056573_P1 | 10817 | 647 | 87.7 | globlastp |
| 4439 | LYD512 b_oleracea\|gb161\|DY027567_P1 | 10818 | 647 | 87.7 | globlastp |
| 4440 | LYD512 b_rapa\|gb162\|CV432660_P1 | 10817 | 647 | 87.7 | globlastp |
| 4441 | LYD512 b_rapa\|gb162\|CX266005_P1 | 10817 | 647 | 87.7 | globlastp |
| 4442 | LYD512 b_rapa\|gb162\|CX271643_P1 | 10818 | 647 | 87.7 | globlastp |
| 4443 | LYD512 b_rapa\|gb162\|L33648_P1 | 10817 | 647 | 87.7 | globlastp |
| 4444 | LYD512 bean\|gb167\|FG233952_P1 | 10822 | 647 | 87.7 | globlastp |
| 4445 | LYD512 bean\|gb167\|FG234313_P1 | 10823 | 647 | 87.7 | globlastp |
| 4446 | LYD512 canola\|10v1\|CD812262 | 10817 | 647 | 87.7 | globlastp |
| 4447 | LYD512 canola\|11v1\|CN735683_P1 | 10817 | 647 | 87.7 | globlastp |
| 4448 | LYD512 canola\|10v1\|CD812803 | 10818 | 647 | 87.7 | globlastp |
| 4449 | LYD512 canola\|11v1\|EG019380_P1 | 10818 | 647 | 87.7 | globlastp |
| 4450 | LYD512 canola\|10v1\|CD814488 | 10817 | 647 | 87.7 | globlastp |
| 4451 | LYD512 canola\|10v1\|CD816398 | 10817 | 647 | 87.7 | globlastp |
| 4452 | LYD512 canola\|10v1\|CN732039 | 10817 | 647 | 87.7 | globlastp |
| 4453 | LYD512 canola\|11v1\|CN732039_P1 | 10817 | 647 | 87.7 | globlastp |
| 4454 | LYD512 canola\|10v1\|CN732436 | 10818 | 647 | 87.7 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 4455 | LYD512 canola\|11v1\|CN732436_P1 | 10818 | 647 | 87.7 | globlastp |
| 4456 | LYD512 canola\|10v1\|CX195298 | 10817 | 647 | 87.7 | globlastp |
| 4457 | LYD512 canola\|10v1\|CX281671 | 10817 | 647 | 87.7 | globlastp |
| 4458 | LYD512 canola\|10v1\|EE442320 | 10817 | 647 | 87.7 | globlastp |
| 4459 | LYD512 canola\|10v1\|EE475415 | 10818 | 647 | 87.7 | globlastp |
| 4460 | LYD512 canola\|11v1\|EE475415_P1 | 10818 | 647 | 87.7 | globlastp |
| 4461 | LYD512 ceratodon\|10v1\|AW086783_P1 | 10824 | 647 | 87.7 | globlastp |
| 4462 | LYD512 ceratodon\|10v1\|SRR074890S0014896_P1 | 10824 | 647 | 87.7 | globlastp |
| 4463 | LYD512 ceratodon\|10v1\|SRR074890S0032828_P1 | 10825 | 647 | 87.7 | globlastp |
| 4464 | LYD512 cleome_gynandra\|10v1\|SRR015532S0004679_P1 | 10818 | 647 | 87.7 | globlastp |
| 4465 | LYD512 cleome_gynandra\|10v1\|SRR015532S0070640_P1 | 10818 | 647 | 87.7 | globlastp |
| 4466 | LYD512 cleome_gynandra\|10v1\|SRR015532S0108616_P1 | 10818 | 647 | 87.7 | globlastp |
| 4467 | LYD512 medicago\|09v1\|BG453970_P1 | 10826 | 647 | 87.7 | globlastp |
| 4468 | LYD512 mesostigma\|gb166\|DN254281_P1 | 10827 | 647 | 87.7 | globlastp |
| 4469 | LYD512 mesostigma\|gb166\|EC726970_P1 | 10827 | 647 | 87.7 | globlastp |
| 4470 | LYD512 orobanche\|10v1\|SRR023189S0004283_P1 | 10828 | 647 | 87.7 | globlastp |
| 4471 | LYD512 physcomitrella\|10v1\|AW145131_P1 | 10824 | 647 | 87.7 | globlastp |
| 4472 | LYD512 physcomitrella\|10v1\|AW497065_P1 | 10824 | 647 | 87.7 | globlastp |
| 4473 | LYD512 pine\|10v2\|BE662643_P1 | 10819 | 647 | 87.7 | globlastp |
| 4474 | LYD512 poplar\|10v1\|BI127311_P1 | 10829 | 647 | 87.7 | globlastp |
| 4475 | LYD512 pseudotsuga\|10v1\|SRR065119S0006202 | 10819 | 647 | 87.7 | globlastp |
| 4476 | LYD512 radish\|gb164\|EV528488 | 10817 | 647 | 87.7 | globlastp |
| 4477 | LYD512 radish\|gb164\|EV535786 | 10818 | 647 | 87.7 | globlastp |
| 4478 | LYD512 radish\|gb164\|EW715704 | 10818 | 647 | 87.7 | globlastp |
| 4479 | LYD512 radish\|gb164\|EW723424 | 10817 | 647 | 87.7 | globlastp |
| 4480 | LYD512 radish\|gb164\|EX777355 | 10817 | 647 | 87.7 | globlastp |
| 4481 | LYD512 spruce\|gb162\|CO215686 | 10819 | 647 | 87.7 | globlastp |
| 4482 | LYD512 spruce\|gb162\|CO218766 | 10819 | 647 | 87.7 | globlastp |
| 4483 | LYD512 spruce\|gb162\|CO244278 | 10819 | 647 | 87.7 | globlastp |
| 4484 | LYD512 strawberry\|11v1\|CRPFV023807 | 10830 | 647 | 87.7 | globlastp |
| 4485 | LYD512 thellungiella\|gb167\|EC599152 | 10817 | 647 | 87.7 | globlastp |
| 4486 | LYD512 triphysaria\|10v1\|BM357464 | 10831 | 647 | 87.7 | globlastp |
| 4487 | LYD512 triphysaria\|10v1\|DR175565 | 10831 | 647 | 87.7 | globlastp |
| 4488 | LYD512 canola\|11v1\|DW998697_P1 | 10817 | 647 | 87.7 | globlastp |
| 4489 | LYD512 sarracenia\|11v1\|SRR192669.149258_T1 | 10832 | 647 | 87.7 | glotblastn |
| 4490 | LYD512 b_juncea\|10v2\|E6ANDIZ01AOUMW_T1 | 10833 | 647 | 87.7 | glotblastn |
| 4491 | LYD512 b_juncea\|10v2\|E6ANDIZ01CSHE8_T1 | 10834 | 647 | 87.7 | glotblastn |
| 4492 | LYD512 b_oleracea\|gb161\|AM056827_T1 | 10835 | 647 | 87.7 | glotblastn |
| 4493 | LYD512 b_rapa\|gb162\|CA992109_T1 | 10836 | 647 | 87.7 | glotblastn |
| 4494 | LYD512 b_rapa\|gb162\|CO749582_T1 | 10837 | 647 | 87.7 | glotblastn |
| 4495 | LYD512 b_rapa\|gb162\|L47858_T1 | 10838 | 647 | 87.7 | glotblastn |
| 4496 | LYD512 bean\|gb167\|FG233996_T1 | 10839 | 647 | 87.7 | glotblastn |
| 4497 | LYD512 bean\|gb167\|FG234221_T1 | 10840 | 647 | 87.7 | glotblastn |
| 4498 | LYD512 bean\|gb167\|FG234271_T1 | 10841 | 647 | 87.7 | glotblastn |
| 4499 | LYD512 bean\|gb167\|FG234438_T1 | 10842 | 647 | 87.7 | glotblastn |
| 4500 | LYD512 potato\|10v1\|BG594649_T1 | 10843 | 647 | 87.7 | glotblastn |
| 4501 | LYD512 radish\|gb164\|EV545800 | 10844 | 647 | 87.7 | glotblastn |
| 4502 | LYD512 radish\|gb164\|EV552271 | 10845 | 647 | 87.7 | glotblastn |
| 4503 | LYD512 radish\|gb164\|EY894218 | 10845 | 647 | 87.7 | glotblastn |
| 4504 | LYD512 radish\|gb164\|EY903338 | 10846 | 647 | 87.7 | glotblastn |
| 4505 | LYD512 radish\|gb164\|FD576341 | 10847 | 647 | 87.7 | glotblastn |
| 4506 | LYD512 rye\|gb164\|BE704623 | 10848 | 647 | 87.7 | glotblastn |
| 4507 | LYD512 spruce\|gb162\|CO232485 | 10849 | 647 | 87.7 | glotblastn |
| 4508 | LYD512 bean\|gb167\|FG234012_T1 | — | 647 | 87.7 | glotblastn |
| 4509 | LYD512 potato\|10v1\|BM111525_T1 | — | 647 | 87.7 | glotblastn |
| 4510 | LYD512 bean\|gb167\|FG233943_P1 | 10850 | 647 | 86.8 | globlastp |
| 4511 | LYD512 abies\|11v2\|SRR098676X123656_P1 | 10851 | 647 | 86.2 | globlastp |
| 4512 | LYD512 apple\|11v1\|MDCRP053770_P1 | 10852 | 647 | 86.2 | globlastp |
| 4513 | LYD512 apple\|11v1\|MDP0000803797_P1 | 10852 | 647 | 86.2 | globlastp |
| 4514 | LYD512 chelidonium\|11v1\|SRR084752X126116_P1 | 10853 | 647 | 86.2 | globlastp |
| 4515 | LYD512 primula\|11v1\|FS231641_P1 | 10854 | 647 | 86.2 | globlastp |
| 4516 | LYD512 primula\|11v1\|SRRP0198679X124782_P1 | 10855 | 647 | 86.2 | globlastp |
| 4517 | LYD512 silene\|11v1\|GH293985_P1 | 10856 | 647 | 86.2 | globlastp |
| 4518 | LYD512 silene\|11v1\|SRR096785X402407_P1 | 10857 | 647 | 86.2 | globlastp |
| 4519 | LYD512 thellungiella_parvulum\|11v1\|EPCRP024263_P1 | 10858 | 647 | 86.2 | globlastp |
| 4520 | LYD512 arabidopsis\|10v1\|AT5G64140_P1 | 10859 | 647 | 86.2 | globlastp |
| 4521 | LYD512 artemisia\|10v1\|EY041125_P1 | 10860 | 647 | 86.2 | globlastp |
| 4522 | LYD512 b_juncea\|10v2\|E6ANDIZ02I04Q9_P1 | 10861 | 647 | 86.2 | globlastp |
| 4523 | LYD512 chlamydomonas\|gb162\|AV640073_P1 | 10862 | 647 | 86.2 | globlastp |
| 4524 | LYD512 cleome_spinosa\|10v1\|GR935009_P1 | 10863 | 647 | 86.2 | globlastp |
| 4525 | LYD512 cleome_spinosa\|10v1\|SRR015531S0012112_P1 | 10863 | 647 | 86.2 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name  cluster name | Polyp. SEQ ID NO: | Hom to SEQ ID NO: | % glob. iden. | Algor. |
|---|---|---|---|---|---|
| 4526 | LYD512 cleome_spinosa\|10v1\|SRR015531S0013955_P1 | 10863 | 647 | 86.2 | globlastp |
| 4527 | LYD512 cleome_spinosa\|10v1\|SRR015531S0016798_P1 | 10863 | 647 | 86.2 | globlastp |
| 4528 | LYD512 cryptomeria\|gb166\|AU299590_P1 | 10864 | 647 | 86.2 | globlastp |
| 4529 | LYD512 orobanche\|10v1\|SRR023189S0002252_P1 | 10865 | 647 | 86.2 | globlastp |
| 4530 | LYD512 orobanche\|10v1\|SRR023189S0002404_P1 | 10865 | 647 | 86.2 | globlastp |
| 4531 | LYD512 orobanche\|10v1\|SRR023189S0007404_P1 | 10865 | 647 | 86.2 | globlastp |
| 4532 | LYD512 pine\|10v2\|H75162_P1 | 10866 | 647 | 86.2 | globlastp |
| 4533 | LYD512 spikemoss\|gb165\|DN838953 | 10867 | 647 | 86.2 | globlastp |
| 4534 | LYD512 spikemoss\|gb165\|DN839150 | 10867 | 647 | 86.2 | globlastp |
| 4535 | LYD512 triphysaria\|10v1\|BM357152 | 10868 | 647 | 86.2 | globlastp |
| 4536 | LYD512 triphysaria\|10v1\|EX988149 | 10868 | 647 | 86.2 | globlastp |
| 4537 | LYD512 volvox\|gb162\|AW651985 | 10862 | 647 | 86.2 | globlastp |
| 4538 | LYD512 bean\|gb167\|FG233926_T1 | 10869 | 647 | 86.2 | glotblastn |
| 4539 | LYD512 bean\|gb167\|FG233946_T1 | 10870 | 647 | 86.2 | glotblastn |
| 4540 | LYD512 bean\|gb167\|FG233986_T1 | — | 647 | 86.2 | glotblastn |
| 4541 | LYD512 potato\|10v1\|BE920319_T1 | — | 647 | 86.2 | glotblastn |
| 4542 | LYD512 bean\|gb167\|FG234342_T1 | 10871 | 647 | 84.6 | glotblastn |
| 4543 | LYD512 onion\|gb162\|BI095549_T1 | 10872 | 647 | 84.6 | glotblastn |
| 4544 | LYD512 radish\|gb164\|EX771975 | 10873 | 647 | 84.6 | glotblastn |
| 4545 | LYD512 wheat\|10v2\|CA594088 | 10874 | 647 | 84.6 | glotblastn |
| 4546 | LYD512 bean\|gb167\|FG233903_T1 | — | 647 | 84.6 | glotblastn |
| 4547 | LYD512 bean\|gb167\|FG233911_T1 | — | 647 | 84.6 | glotblastn |
| 4548 | LYD512 potato\|10v1\|BG889630_T1 | — | 647 | 84.6 | glotblastn |
| 4549 | LYD512 aristolochia\|10v1\|SRR039082S0145919_P1 | 10875 | 647 | 84.6 | globlastp |
| 4550 | LYD512 basilicum\|10v1\|DY336454_P1 | 10876 | 647 | 84.6 | globlastp |
| 4551 | LYD512 nasturtium\|10v1\|SRR032558S0002107 | 10877 | 647 | 84.6 | globlastp |
| 4552 | LYD512 oak\|10v1\|DN949801_P1 | 10878 | 647 | 84.6 | globlastp |
| 4553 | LYD512 oak\|10v1\|DN950886_P1 | 10878 | 647 | 84.6 | globlastp |
| 4554 | LYD512 sequoia\|10v1\|SRR065044S0012925 | 10879 | 647 | 84.6 | globlastp |
| 4555 | LYD512 wheat\|10v2\|CJ507187 | 10880 | 647 | 84.6 | globlastp |
| 4556 | LYD512 trigonella\|11v1\|SRR066194X110700_P1 | 10881 | 647 | 83.1 | globlastp |
| 4557 | LYD512 chickpea\|09v2\|DY475499_P1 | 10882 | 647 | 83.1 | globlastp |
| 4558 | LYD512 ipomoea_batatas\|10v1\|DV037504_P1 | 10883 | 647 | 83.1 | globlastp |
| 4559 | LYD512 rose\|10v1\|EC586279 | 10884 | 647 | 83.1 | globlastp |
| 4560 | LYD512 sunflower\|10v1\|SFSLX01822194D1 | 10885 | 647 | 83.1 | globlastp |
| 4561 | LYD512 sarracenia\|11v1\|SRR192671.251185_T1 | 10886 | 647 | 83.1 | glotblastn |
| 4562 | LYD512 tea\|10v1\|FE861348 | 10887 | 647 | 83.1 | glotblastn |
| 4563 | LYD512 flaveria\|11v1\|SRR149244.183097_T1 | — | 647 | 83.1 | glotblastn |
| 4564 | LYD512 fraxinus\|11v1\|SRR058827.120236_T1 | — | 647 | 83.1 | glotblastn |
| 4565 | LYD512 basilicum\|10v1\|DY337263_T1 | — | 647 | 83.1 | glotblastn |
| 4566 | LYD512 fraxinus\|11v1\|SRR058827.13807_T1 | 10888 | 647 | 81.5 | glotblastn |
| 4567 | LYD512 bean\|gb167\|FG230120_T1 | 10889 | 647 | 81.5 | glotblastn |
| 4568 | LYD512 bean\|gb167\|FG233978_T1 | 10890 | 647 | 81.5 | glotblastn |
| 4569 | LYD512 canola\|11v1\|ES268647_T1 | — | 647 | 81.5 | glotblastn |
| 4570 | LYD512 pea\|11v1\|FG530409_T1 | — | 647 | 81.5 | glotblastn |
| 4571 | LYD512 primula\|11v1\|FS228883_P1 | 10891 | 647 | 81.5 | globlastp |
| 4572 | LYD512 aquilegia\|10v2\|CRPAC012415_P1 | 10892 | 647 | 81.5 | globlastp |
| 4573 | LYD512 ostreococcus\|gb162\|XM001416346_P1 | 10893 | 647 | 81.5 | globlastp |
| 4574 | LYD512 salvia\|10v1\|SRR014553S0007711 | 10894 | 647 | 81.5 | globlastp |
| 4575 | LYD512 pine\|10v2\|SRR063941S0003740_P1 | 10895 | 647 | 80.3 | globlastp |
| 4576 | LYD512 arabidopsis_lyrata\|09v1\|TMPLEY903338T1_P1 | 10896 | 647 | 80.0 | globlastp |
| 4577 | LYD512 cacao\|10v1\|CGD0018598_P1 | 10897 | 647 | 80.0 | globlastp |
| 4578 | LYD512 medicago\|09v1\|GFXAC147482X42_P1 | 10898 | 647 | 80.0 | globlastp |
| 4579 | LYD512 spurge\|gb161\|DV112391 | 10899 | 647 | 80.0 | globlastp |
| 4580 | LYD512 wheat\|10v2\|CA719059 | 10900 | 647 | 80.0 | globlastp |
| 4581 | LYD512 cleome_gynandra\|10v1\|SRR015532S0221618_T1 | — | 647 | 80.0 | glotblastn |
| 4582 | LYD513 soybean\|11v1\|GLYMA19G42090 | 10901 | 648 | 96.8 | globlastp |
| 4583 | LYD513 cowpea\|gb166\|FF383089_P1 | 10902 | 648 | 96.0 | globlastp |
| 4584 | LYD513 pigeonpea\|10v1\|EE595417_P1 | 10903 | 648 | 96.0 | globlastp |
| 4585 | LYD513 bean\|gb167\|CA904335_P1 | 10904 | 648 | 95.2 | globlastp |
| 4586 | LYD513 liquorice\|gb171\|FS239664_P1 | 10905 | 648 | 95.2 | globlastp |
| 4587 | LYD513 pigeonpea\|10v1\|SRR054580S0032264_P1 | 10906 | 648 | 94.4 | globlastp |
| 4588 | LYD513 soybean\|11v1\|GLYMA10G29200 | 10907 | 648 | 94.4 | globlastp |
| 4589 | LYD513 clementine\|11v1\|CB290340_P1 | 10908 | 648 | 93.6 | globlastp |
| 4590 | LYD513 orange\|11v1\|CB290340_P1 | 10908 | 648 | 93.6 | globlastp |
| 4591 | LYD513 citrus\|gb166\|CB290341_P1 | 10908 | 648 | 93.6 | globlastp |
| 4592 | LYD513 cannabis\|12v1\|JK499537_P1 | 10909 | 648 | 93.5 | globlastp |
| 4593 | LYD513 cannabis\|12v1\|SOLX00014292_P1 | 10909 | 648 | 93.5 | globlastp |
| 4594 | LYD513 cannabis\|12v1\|SOLX00031802_P1 | 10909 | 648 | 93.5 | globlastp |
| 4595 | LYD513 cotton\|10v2\|BF269423_P1 | 10910 | 648 | 93.5 | globlastp |
| 4596 | LYD513 medicago\|09v1\|AL365796_P1 | 10911 | 648 | 93.5 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 4597 | LYD513 soybean\|11v1\|GLYMA20G38080 | 10912 | 648 | 93.5 | globlastp |
| 4598 | LYD513 cannabis\|12v1\|JK495661_P1 | 10913 | 648 | 92.8 | globlastp |
| 4599 | LYD513 cannabis\|12v1\|SOLX00040861_P1 | 10913 | 648 | 92.8 | globlastp |
| 4600 | LYD513 humulus\|11v1\|SRR098684X105260_T1 | 10914 | 648 | 92.7 | glotblastn |
| 4601 | LYD513 euphorbia\|11v1\|BP955767_P1 | 10915 | 648 | 92.7 | globlastp |
| 4602 | LYD513 humulus\|11v1\|EX515441_P1 | 10916 | 648 | 92.7 | globlastp |
| 4603 | LYD513 humulus\|11v1\|FG346186_P1 | 10916 | 648 | 92.7 | globlastp |
| 4604 | LYD513 trigonella\|11v1\|SRR066194X107510_P1 | 10917 | 648 | 92.7 | globlastp |
| 4605 | LYD513 cowpea\|gb166\|FF389703_P1 | 10918 | 648 | 92.7 | globlastp |
| 4606 | LYD513 peanut\|10v1\|CD038704_P1 | 10919 | 648 | 92.7 | globlastp |
| 4607 | LYD513 castorbean\|09v1\|EG658084 | 10920 | 648 | 92.0 | globlastp |
| 4608 | LYD513 castorbean\|11v1\|EE255893_T1 | 10921 | 648 | 92.0 | glotblastn |
| 4609 | LYD513 humulus\|11v1\|SRR098683X44395_P1 | 10922 | 648 | 91.9 | globlastp |
| 4610 | LYD513 platanus\|11v1\|SRR096786X103370_P1 | 10923 | 648 | 91.9 | globlastp |
| 4611 | LYD513 tripterygium\|11v1\|SRR098677X108844_P1 | 10924 | 648 | 91.9 | globlastp |
| 4612 | LYD513 cassava\|09v1\|DV444762_P1 | 10925 | 648 | 91.9 | globlastp |
| 4613 | LYD513 cotton\|10v2\|SRR032367S0174241_P1 | 10926 | 648 | 91.9 | globlastp |
| 4614 | LYD513 grape\|11v1\|GSVIVT01031130001_P1 | 10927 | 648 | 91.9 | globlastp |
| 4615 | LYD513 grape\|gb160\|CB009183 | 10927 | 648 | 91.9 | globlastp |
| 4616 | LYD513 grape\|11v1\|GSVIVT01031158001_P1 | 10928 | 648 | 91.9 | globlastp |
| 4617 | LYD513 grape\|gb160\|CF372581 | 10928 | 648 | 91.9 | globlastp |
| 4618 | LYD513 poplar\|10v1\|AI162142_P1 | 10929 | 648 | 91.9 | globlastp |
| 4619 | LYD513 spurge\|gb161\|DV116672 | 10930 | 648 | 91.9 | globlastp |
| 4620 | LYD513 walnuts\|gb166\|EL895554 | 10931 | 648 | 91.9 | globlastp |
| 4621 | LYD513 flax\|11v1\|EU830901_P1 | 10932 | 648 | 91.3 | globlastp |
| 4622 | LYD513 apple\|11v1\|CN488470_P1 | 10933 | 648 | 91.2 | globlastp |
| 4623 | LYD513 apple\|gb171\|CN489770 | 10933 | 648 | 91.2 | globlastp |
| 4624 | LYD513 cassava\|09v1\|DV445154_P1 | 10934 | 648 | 91.1 | globlastp |
| 4625 | LYD513 chestnut\|gb170\|SRR006295S0000545_P1 | 10935 | 648 | 91.1 | globlastp |
| 4626 | LYD513 lotus\|09v1\|GO006827_P1 | 10936 | 648 | 91.1 | globlastp |
| 4627 | LYD513 flax\|11v1\|JG018398_P1 | 10937 | 648 | 90.6 | globlastp |
| 4628 | LYD513 citrus\|gb166\|DN795749_P1 | 10938 | 648 | 90.6 | globlastp |
| 4629 | LYD513 scabiosa\|11v1\|SRR063723X13165_P1 | 10939 | 648 | 90.5 | globlastp |
| 4630 | LYD513 castorbean\|09v1\|EG693531 | 10940 | 648 | 90.5 | globlastp |
| 4631 | LYD513 castorbean\|11v1\|EG693531_P1 | 10940 | 648 | 90.5 | globlastp |
| 4632 | LYD513 beet\|gb162\|BF011209_P1 | 10941 | 648 | 90.4 | globlastp |
| 4633 | LYD513 bruguiera\|gb166\|BP944609_P1 | 10942 | 648 | 90.4 | globlastp |
| 4634 | LYD513 euonymus\|11v1\|SRR070038X102758_P1 | 10943 | 648 | 90.3 | globlastp |
| 4635 | LYD513 platanus\|11v1\|SRR096786X100019_P1 | 10944 | 648 | 90.3 | globlastp |
| 4636 | LYD513 cucumber\|09v1\|CK085538_P1 | 10945 | 648 | 90.3 | globlastp |
| 4637 | LYD513 cyamopsis\|10v1\|EG976392_P1 | 10946 | 648 | 90.3 | globlastp |
| 4638 | LYD513 melon\|10v1\|AM714057_P1 | 10945 | 648 | 90.3 | globlastp |
| 4639 | LYD513 poplar\|10v1P3U827971_P1 | 10947 | 648 | 90.3 | globlastp |
| 4640 | LYD513 prunus\|10v1\|CB822690 | 10948 | 648 | 90.3 | globlastp |
| 4641 | LYD513 prunus\|10v1\|CN444931 | 10949 | 648 | 90.3 | globlastp |
| 4642 | LYD513 castorbean\|09v1\|EV520818 | 10950 | 648 | 89.8 | globlastp |
| 4643 | LYD513 castorbean\|11v1\|EE255561_T1 | 10951 | 648 | 89.8 | glotblastn |
| 4644 | LYD513 valeriana\|11v1\|SRR099039X111653_P1 | 10952 | 648 | 89.7 | globlastp |
| 4645 | LYD513 vinca\|11v1\|SRR098690X106030_P1 | 10953 | 648 | 89.6 | globlastp |
| 4646 | LYD513 apple\|gb171\|CN488470 | 10954 | 648 | 89.6 | globlastp |
| 4647 | LYD513 apple\|gb171\|CN493487 | 10955 | 648 | 89.6 | globlastp |
| 4648 | LYD513 cacao\|10v1\|CU571486_P1 | 10956 | 648 | 89.6 | globlastp |
| 4649 | LYD513 walnuts\|gb166\|CB303799 | 10957 | 648 | 89.6 | globlastp |
| 4650 | LYD513 chelidonium\|11v1\|SRR084752X106078_P1 | 10958 | 648 | 89.5 | globlastp |
| 4651 | LYD513 cucurbita\|11v1\|SRR091276X101050_P1 | 10959 | 648 | 89.5 | globlastp |
| 4652 | LYD513 cucurbita\|11v1\|SRR091276X118267_P1 | 10960 | 648 | 89.5 | globlastp |
| 4653 | LYD513 fagopyrum\|11v1\|SRR063689X100555_P1 | 10961 | 648 | 89.5 | globlastp |
| 4654 | LYD513 watermelon\|11v1\|CO997628_P1 | 10960 | 648 | 89.5 | globlastp |
| 4655 | LYD513 apple\|11v1\|CN444931_P1 | 10962 | 648 | 89.5 | globlastp |
| 4656 | LYD513 apple\|gb171\|CN444931 | 10962 | 648 | 89.5 | globlastp |
| 4657 | LYD513 cacao\|10v1\|CU473875_P1 | 10963 | 648 | 89.5 | globlastp |
| 4658 | LYD513 cotton\|10v2\|SRR032367S0128689_P1 | 10964 | 648 | 89.5 | globlastp |
| 4659 | LYD513 iceplant\|gb164\|BE037240_P1 | 10965 | 648 | 89.5 | globlastp |
| 4660 | LYD513 jatropha\|09v1\|FM896181_P1 | 10966 | 648 | 89.5 | globlastp |
| 4661 | LYD513 lotus\|09v1\|LLBW594540_P1 | 10967 | 648 | 89.5 | globlastp |
| 4662 | LYD513 momordica\|10v1\|SRR071315S0002588_P1 | 10960 | 648 | 89.5 | globlastp |
| 4663 | LYD513 rose\|10v1\|BI978990 | 10968 | 648 | 89.5 | globlastp |
| 4664 | LYD513 sarracenia\|11v1\|SRR192669.103226_P1 | 10969 | 648 | 89.0 | globlastp |
| 4665 | LYD513 cassava\|09v1\|FF535437_P1 | 10970 | 648 | 89.0 | globlastp |
| 4666 | LYD513 amsonia\|11v1\|SRR098688X110818_P1 | 10971 | 648 | 88.9 | globlastp |
| 4667 | LYD513 tabernaemontana\|11v1\|SRR098689X10926_P1 | 10972 | 648 | 88.9 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 4668 | LYD513 fagopyrum\|11v1\|SRR063689X16772_P1 | 10973 | 648 | 88.8 | globlastp |
| 4669 | LYD513 grape\|11v1\|GSVIVT01035141001_P1 | 10974 | 648 | 88.8 | globlastp |
| 4670 | LYD513 grape\|gb160\|BQ796866 | 10974 | 648 | 88.8 | globlastp |
| 4671 | LYD513 peanut\|10v1\|ES719337_P1 | 10975 | 648 | 88.8 | globlastp |
| 4672 | LYD513 poplar\|10v1\|BU828110_P1 | 10976 | 648 | 88.8 | globlastp |
| 4673 | LYD513 rhizophora\|10v1\|SRR005793S0012970 | 10977 | 648 | 88.8 | globlastp |
| 4674 | LYD513 grape\|11v1\|EE071280_P1 | 10978 | 648 | 88.7 | globlastp |
| 4675 | LYD513 tripterygium\|11v1\|SRR098677X116948_P1 | 10979 | 648 | 88.7 | globlastp |
| 4676 | LYD513 acacia\|10v1\|GR481725_P1 | 10980 | 648 | 88.7 | globlastp |
| 4677 | LYD513 bean\|gb167\|CA897727_P1 | 10981 | 648 | 88.7 | globlastp |
| 4678 | LYD513 grape\|11v1\|GSVIVT01028021001_P1 | 10978 | 648 | 88.7 | globlastp |
| 4679 | LYD513 grape\|gb160\|BQ798950 | 10978 | 648 | 88.7 | globlastp |
| 4680 | LYD513 hevea\|10v1\|EC600964_P1 | 10982 | 648 | 88.7 | globlastp |
| 4681 | LYD513 pea\|09v1\|FG533744 | 10983 | 648 | 88.7 | globlastp |
| 4682 | LYD513 pea\|11v1\|FG533744_P1 | 10983 | 648 | 88.7 | globlastp |
| 4683 | LYD513 kiwi\|gb166\|FG402715_P1 | 10984 | 648 | 88.3 | globlastp |
| 4684 | LYD513 sarracenia\|11v1\|SRR192669.10545XX1_P1 | 10985 | 648 | 88.2 | globlastp |
| 4685 | LYD513 cucurbita\|11v1\|FG227191_P1 | 10986 | 648 | 88.1 | globlastp |
| 4686 | LYD513 vinca\|11v1\|SRR098690X109230_P1 | 10987 | 648 | 88.1 | globlastp |
| 4687 | LYD513 watermelon\|11v1\|AM713876_P1 | 10986 | 648 | 88.1 | globlastp |
| 4688 | LYD513 cucumber\|09v1\|EB714648_P | 10986 | 648 | 88.1 | globlastp |
| 4689 | LYD513 cynara\|gb167\|GE586491_P1 | 10988 | 648 | 88.1 | globlastp |
| 4690 | LYD513 ginseng\|10v1\|CN846478_P1 | 10989 | 648 | 88.1 | globlastp |
| 4691 | LYD513 kiwi\|gb166\|FG483390_P1 | 10990 | 648 | 88.1 | globlastp |
| 4692 | LYD513 melon\|10v1\|EB714648_P1 | 10986 | 648 | 88.1 | globlastp |
| 4693 | LYD513 momordica\|10v1\|SRR071315S0000738_P1 | 10986 | 648 | 88.1 | globlastp |
| 4694 | LYD513 safflower\|gb162\|EL372581 | 10988 | 648 | 88.1 | globlastp |
| 4695 | LYD513 euphorbia\|11v1\|DV120709_P1 | 10991 | 648 | 88.0 | globlastp |
| 4696 | LYD513 fagopyrum\|11v1\|SRR063689X101804_P1 | 10992 | 648 | 88.0 | globlastp |
| 4697 | LYD513 fagopyrum\|11v1\|SRR063689X137119_P1 | 10993 | 648 | 88.0 | globlastp |
| 4698 | LYD513 silene\|11v1\|GH291720_P1 | 10994 | 648 | 88.0 | globlastp |
| 4699 | LYD513 tripterygium\|11v1\|SRR098677X207639_T1 | 10995 | 648 | 88.0 | glotblastn |
| 4700 | LYD513 medicago\|09v1\|AW299173_P1 | 10996 | 648 | 88.0 | globlastp |
| 4701 | LYD513 oat\|11v1\|GR356969_P1 | 10997 | 648 | 88.0 | globlastp |
| 4702 | LYD513 spurge\|gb161\|DV112552 | 10991 | 648 | 88.0 | globlastp |
| 4703 | LYD513 euonymus\|11v1\|SRR070038X102818_P1 | 10998 | 648 | 87.9 | globlastp |
| 4704 | LYD513 sarracenia\|11v1\|SRR192669.115897_P1 | 10999 | 648 | 87.9 | globlastp |
| 4705 | LYD513 sarracenia\|11v1\|SRR192669.117513_P1 | 11000 | 648 | 87.9 | globlastp |
| 4706 | LYD513 tripterygium\|11v1\|SRR098677X117669_P1 | 11001 | 648 | 87.9 | globlastp |
| 4707 | LYD513 avocado\|10v1\|CK754165_P1 | 11002 | 648 | 87.9 | globlastp |
| 4708 | LYD513 chestnut\|gb170\|SRR006295S0002446_P1 | 11003 | 648 | 87.9 | globlastp |
| 4709 | LYD513 gerbera\|09v1\|AJ750965_P1 | 11004 | 648 | 87.9 | globlastp |
| 4710 | LYD513 jatropha\|09v1\|FM888130_T1 | 11005 | 648 | 87.9 | glotblastn |
| 4711 | LYD513 nasturtium\|10v1\|GH163748 | 11006 | 648 | 87.9 | globlastp |
| 4712 | LYD513 poplar\|10v1\|AI161664_P1 | 11007 | 648 | 87.9 | globlastp |
| 4713 | LYD513 banana\|10v1\|ES433384_P1 | 11008 | 648 | 87.5 | globlastp |
| 4714 | LYD513 oak\|10v1\|FP033752_P1 | 11009 | 648 | 87.5 | globlastp |
| 4715 | LYD513 monkeyflower\|10v1\|DV209288_P1 | 11010 | 648 | 87.4 | globlastp |
| 4716 | LYD513 catharanthus\|11v1\|EG561933_P1 | 11011 | 648 | 87.3 | globlastp |
| 4717 | LYD513 cirsium\|11v1\|SRR346952.1011320_P1 | 11012 | 648 | 87.3 | globlastp |
| 4718 | LYD513 cirsium\|11v1\|SRR346952.1308_P1 | 11013 | 648 | 87.3 | globlastp |
| 4719 | LYD513 cucurbita\|11v1\|SRR091276X108522_P1 | 11014 | 648 | 87.3 | globlastp |
| 4720 | LYD513 flaveria\|11v1\|SRR149229.116069_P1 | 11015 | 648 | 87.3 | globlastp |
| 4721 | LYD513 flaveria\|11v1\|SRR149229.205952_P1 | 11015 | 648 | 87.3 | globlastp |
| 4722 | LYD513 catharanthus\|gb166\|EG561933 | 11011 | 648 | 87.3 | globlastp |
| 4723 | LYD513 centaurea\|gb166\|EH738083_P1 | 11012 | 648 | 87.3 | globlastp |
| 4724 | LYD513 cichorium\|gb171\|DT211682_P1 | 11016 | 648 | 87.3 | globlastp |
| 4725 | LYD513 cichorium\|gb171\|EH681294_P1 | 11017 | 648 | 87.3 | globlastp |
| 4726 | LYD513 triphysaria\|10v1\|EY009373 | 11018 | 648 | 87.3 | globlastp |
| 4727 | LYD513 euphorbia\|11v1\|SRR098678X101584_P1 | 11019 | 648 | 87.2 | globlastp |
| 4728 | LYD513 phyla\|11v2\|SRR099035X139220_P1 | 11020 | 648 | 87.2 | globlastp |
| 4729 | LYD513 trigonella\|11v1\|SRR066194X101552_P1 | 11021 | 648 | 87.2 | globlastp |
| 4730 | LYD513 lettuce\|10v1\|DW045182_P1 | 11022 | 648 | 87.2 | globlastp |
| 4731 | LYD513 lettuce\|10v1\|DW074978_P1 | 11022 | 648 | 87.2 | globlastp |
| 4732 | LYD513 lettuce\|10v1\|DW104390_P1 | 11022 | 648 | 87.2 | globlastp |
| 4733 | LYD513 lettuce\|10v1\|DW146249_P1 | 11022 | 648 | 87.2 | globlastp |
| 4734 | LYD513 canola\|11v1\|CN726806_P1 | 11023 | 648 | 87.1 | globlastp |
| 4735 | LYD513 canola\|11v1\|ES923924_P1 | 11023 | 648 | 87.1 | globlastp |
| 4736 | LYD513 euphorbia\|11v1\|DV116672_P1 | 11024 | 648 | 87.1 | globlastp |
| 4737 | LYD513 valeriana\|11v1\|SRR099039X13207_P1 | 11025 | 648 | 87.1 | globlastp |
| 4738 | LYD513 arabidopsis_lyrata\|09v1\|JGIAL008934_P1 | 11026 | 648 | 87.1 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name  cluster name | Polyp. SEQ ID NO: | Hom to SEQ ID NO: | % glob. iden. | Algor. |
|---|---|---|---|---|---|
| 4739 | LYD513 arabidopsis\|10v1\|AT3G05560_P1 | 11027 | 648 | 87.1 | globlastp |
| 4740 | LYD513 aristolochia\|10v1\|SRR039082S0099630_P1 | 11028 | 648 | 87.1 | globlastp |
| 4741 | LYD513 b_juncea\|10v2\|E6ANDIZ01A2VUK_P1 | 11023 | 648 | 87.1 | globlastp |
| 4742 | LYD513 b_juncea\|10v2\|E6ANDIZ01B6F55_P1 | 11023 | 648 | 87.1 | globlastp |
| 4743 | LYD513 b_rapa\|gb162\|BG544185_P1 | 11023 | 648 | 87.1 | globlastp |
| 4744 | LYD513 b_rapa\|gb164\|L33600_P1 | 11023 | 648 | 87.1 | globlastp |
| 4745 | LYD513 canola\|10v1\|CD814674 | 11023 | 648 | 87.1 | globlastp |
| 4746 | LYD513 chickpea\|09v2\|GR392656_P1 | 11029 | 648 | 87.1 | globlastp |
| 4747 | LYD513 cleome_gynandra\|10v1\|SRR015532S0010453_P1 | 11030 | 648 | 87.1 | globlastp |
| 4748 | LYD513 cleome_spinosa\|10v1\|GR933127_P1 | 11031 | 648 | 87.1 | globlastp |
| 4749 | LYD513 heritiera\|10v1\|SRR005795S0043155_P1 | 11032 | 648 | 87.1 | globlastp |
| 4750 | LYD513 oak\|10v1\|FP042437_P1 | 11033 | 648 | 87.1 | globlastp |
| 4751 | LYD513 oak\|10v1\|FP048829_P1 | 11033 | 648 | 87.1 | globlastp |
| 4752 | LYD513 radish\|gb164\|EV539292 | 11023 | 648 | 87.1 | globlastp |
| 4753 | LYD513 radish\|gb164\|EW715331 | 11023 | 648 | 87.1 | globlastp |
| 4754 | LYD513 radish\|gb164\|EX749668 | 11023 | 648 | 87.1 | globlastp |
| 4755 | LYD513 radish\|gb164\|EY896443 | 11023 | 648 | 87.1 | globlastp |
| 4756 | LYD513 safflower\|gb162\|EL412119 | 11034 | 648 | 87.1 | globlastp |
| 4757 | LYD513 strawberry\|11v1\|CO379765 | 11035 | 648 | 87.1 | globlastp |
| 4758 | LYD513 grape\|11v1\|CB910723_T1 | 11036 | 648 | 86.7 | glotblastn |
| 4759 | LYD513 cirsium\|11v1\|SRR346952.1013899_P1 | 11037 | 648 | 86.6 | globlastp |
| 4760 | LYD513 cleome_spinosa\|10v1\|GR931755_P1 | 11038 | 648 | 86.6 | globlastp |
| 4761 | LYD513 eucalyptus\|gb166\|AJ627684 | 11039 | 648 | 86.6 | globlastp |
| 4762 | LYD513 oil_palm\|gb166\|EL683006_P1 | 11040 | 648 | 86.6 | globlastp |
| 4763 | LYD513 poplar\|10v1\|BU884271_P1 | 11041 | 648 | 86.6 | globlastp |
| 4764 | LYD513 vinca\|11v1\|SRR098690X101672_P1 | 11042 | 648 | 86.5 | globlastp |
| 4765 | LYD513 cichorium\|gb171\|EH699592_P1 | 11043 | 648 | 86.5 | globlastp |
| 4766 | LYD513 triphysaria\|10v1\|BM357592 | 11044 | 648 | 86.5 | globlastp |
| 4767 | LYD513 valeriana\|11v1\|SRR099039X103182_P1 | 11045 | 648 | 86.4 | globlastp |
| 4768 | LYD513 dandelion\|10v1\|DR401320_P1 | 11046 | 648 | 86.4 | globlastp |
| 4769 | LYD513 tragopogon\|10v1\|SRR020205S0002082 | 11047 | 648 | 86.4 | globlastp |
| 4770 | LYD513 triphysaria\|10v1\|BM356849 | 11048 | 648 | 86.4 | glotblastn |
| 4771 | LYD513 triphysaria\|10v1\|EY010714 | 11049 | 648 | 86.4 | globlastp |
| 4772 | LYD513 cirsium\|11v1\|SRR346952.1000538XX2_P1 | 11050 | 648 | 86.3 | globlastp |
| 4773 | LYD513 euonymus\|11v1\|SRR070038X183713_P1 | 11051 | 648 | 86.3 | globlastp |
| 4774 | LYD513 thellungiella_halophilum\|11v1\|DN775739_P1 | 11052 | 648 | 86.3 | globlastp |
| 4775 | LYD513 thellungiella_parvulum\|11v1\|EC598950_P1 | 11053 | 648 | 86.3 | globlastp |
| 4776 | LYD513 tripterygium\|11v1\|SRR098677X120515_P1 | 11054 | 648 | 86.3 | globlastp |
| 4777 | LYD513 b_juncea\|10v2\|E6ANDIZ01A9KGR2_P1 | 11055 | 648 | 86.3 | globlastp |
| 4778 | LYD513 b_oleracea\|gb161\|DY025774_P1 | 11055 | 648 | 86.3 | globlastp |
| 4779 | LYD513 b_oleracea\|gb161\|DY027332_P1 | 11056 | 648 | 86.3 | globlastp |
| 4780 | LYD513 b_rapa\|gb162\|BQ791532_P1 | 11055 | 648 | 86.3 | globlastp |
| 4781 | LYD513 b_rapa\|gb162\|CA991981_P1 | 11055 | 648 | 86.3 | globlastp |
| 4782 | LYD513 b_rapa\|gb162\|CX270100_P1 | 11055 | 648 | 86.3 | globlastp |
| 4783 | LYD513 bean\|gb167\|CA897526_P1 | 11057 | 648 | 86.3 | globlastp |
| 4784 | LYD513 canola\|10v1\|CD818310 | 11055 | 648 | 86.3 | globlastp |
| 4785 | LYD513 canola\|11v1\|CN730374_P1 | 11055 | 648 | 86.3 | globlastp |
| 4786 | LYD513 canola\|10v1\|CD819566 | 11055 | 648 | 86.3 | globlastp |
| 4787 | LYD513 canola\|10v1\|CD820104 | 11055 | 648 | 86.3 | globlastp |
| 4788 | LYD513 canola\|10v1\|CN733264 | 11055 | 648 | 86.3 | globlastp |
| 4789 | LYD513 centaurea\|gb166\|EH733393_P1 | 11050 | 648 | 86.3 | globlastp |
| 4790 | LYD513 cotton\|10v2\|DT456488_P1 | 11058 | 648 | 86.3 | globlastp |
| 4791 | LYD513 eschscholzia\|10v1\|SRR014116S0000884 | 11059 | 648 | 86.3 | globlastp |
| 4792 | LYD513 kiwi\|gb166\|FG497891_P1 | 11060 | 648 | 86.3 | globlastp |
| 4793 | LYD513 liquorice\|gb171\|FS242310_P1 | 11061 | 648 | 86.3 | globlastp |
| 4794 | LYD513 petunia\|gb171\|CV299644_P1 | 11062 | 648 | 86.3 | globlastp |
| 4795 | LYD513 radish\|gb164\|EV526770 | 11055 | 648 | 86.3 | globlastp |
| 4796 | LYD513 radish\|gb164\|EV537012 | 11055 | 648 | 86.3 | globlastp |
| 4797 | LYD513 radish\|gb164\|EV537498 | 11055 | 648 | 86.3 | globlastp |
| 4798 | LYD513 radish\|gb164\|EV544085 | 11055 | 648 | 86.3 | globlastp |
| 4799 | LYD513 radish\|gb164\|EV545505 | 11055 | 648 | 86.3 | globlastp |
| 4800 | LYD513 radish\|gb164\|EV546676 | 11055 | 648 | 86.3 | globlastp |
| 4801 | LYD513 radish\|gb164\|EW714839 | 11055 | 648 | 86.3 | globlastp |
| 4802 | LYD513 radish\|gb164\|EW715509 | 11055 | 648 | 86.3 | globlastp |
| 4803 | LYD513 radish\|gb164\|EW725328 | 11055 | 648 | 86.3 | globlastp |
| 4804 | LYD513 rose\|10v1\|B1978841 | 11063 | 648 | 86.3 | globlastp |
| 4805 | LYD513 soybean\|11v1\|GLYMA10G02270 | 11064 | 648 | 86.3 | globlastp |
| 4806 | LYD513 thellungiella\|gb167\|DN775739 | 11052 | 648 | 86.3 | globlastp |
| 4807 | LYD513 canola\|11v1\|CN733264_P1 | 11055 | 648 | 86.3 | globlastp |
| 4808 | LYD513 oil_palm\|gb166\|CN600309_P1 | 11065 | 648 | 85.9 | globlastp |
| 4809 | LYD513 cassava\|09v1\|DV453183_P1 | 11066 | 648 | 85.8 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 4810 | LYD513 ambrosia\|11v1\|SRR346935.123036_P1 | 11067 | 648 | 85.7 | globlastp |
| 4811 | LYD513 cirsium\|11v1\|SRR346952.100262_P1 | 11068 | 648 | 85.7 | globlastp |
| 4812 | LYD513 cucurbita\|11v1\|SRR091276X100174_P1 | 11069 | 648 | 85.7 | globlastp |
| 4813 | LYD513 flaveria\|11v1\|SRR149232.112266_P1 | 11070 | 648 | 85.7 | globlastp |
| 4814 | LYD513 silene\|11v1\|GH294013_P1 | 11071 | 648 | 85.7 | globlastp |
| 4815 | LYD513 silene\|11v1\|SRR096785X107257_P1 | 11072 | 648 | 85.7 | globlastp |
| 4816 | LYD513 dandelion\|10v1\|DR400419_P1 | 11073 | 648 | 85.7 | globlastp |
| 4817 | LYD513 monkeyflower\|10v1\|DV210787_P1 | 11074 | 648 | 85.7 | globlastp |
| 4818 | LYD513 ambrosia\|11v1\|SRR346943.107981_P1 | 11075 | 648 | 85.6 | globlastp |
| 4819 | LYD513 euonymus\|11v1\|SRR070038X167266_P1 | 11076 | 648 | 85.6 | globlastp |
| 4820 | LYD513 artemisia\|10v1\|EY034618_P1 | 11077 | 648 | 85.6 | globlastp |
| 4821 | LYD513 ipomoea_batatas\|10v1\|BU690301_P1 | 11078 | 648 | 85.6 | globlastp |
| 4822 | LYD513 ipomoea_nil\|10v1\|BJ553701_P1 | 11079 | 648 | 85.6 | globlastp |
| 4823 | LYD513 poppy\|gb166\|FE964142_T1 | 11080 | 648 | 85.6 | glotblastn |
| 4824 | LYD513 canola\|11v1\|CN731617_P1 | 11081 | 648 | 85.5 | globlastp |
| 4825 | LYD513 euphorbia\|11v1\|SRR098678X108946_P1 | 11082 | 648 | 85.5 | globlastp |
| 4826 | LYD513 primula\|11v1\|SRR098679X101049_P1 | 11083 | 648 | 85.5 | globlastp |
| 4827 | LYD513 thellungiella_halophilum\|11v1\|DN773945_P1 | 11084 | 648 | 85.5 | globlastp |
| 4828 | LYD513 trigonella\|11v1\|SRR066194X107369_P1 | 11085 | 648 | 85.5 | globlastp |
| 4829 | LYD513 acacia\|10v1\|FS589355_P1 | 11086 | 648 | 85.5 | globlastp |
| 4830 | LYD513 arabidopsis_lyrata\|09v1\|JGIAL022456_P1 | 11087 | 648 | 85.5 | globlastp |
| 4831 | LYD513 arabidopsis\|10v1\|AT5G27770_P1 | 11088 | 648 | 85.5 | globlastp |
| 4832 | LYD513 artemisia\|10v1\|EY043319_P1 | 11089 | 648 | 85.5 | globlastp |
| 4833 | LYD513 b_juncea\|10v2\|E6ANDIZ01B7ZG3_P1 | 11090 | 648 | 85.5 | globlastp |
| 4834 | LYD513 b_oleracea\|gb161\|AM057350_P1 | 11081 | 648 | 85.5 | globlastp |
| 4835 | LYD513 canola\|10v1\|CD820346 | 11081 | 648 | 85.5 | globlastp |
| 4836 | LYD513 canola\|10v1\|CD842102 | 11091 | 648 | 85.5 | globlastp |
| 4837 | LYD513 liriodendron\|gb166\|FD500754_P1 | 11092 | 648 | 85.5 | globlastp |
| 4838 | LYD513 lotus\|09v1\|CN825035_P1 | 11093 | 648 | 85.5 | globlastp |
| 4839 | LYD513 medicago\|09v1\|AW686909_P1 | 11094 | 648 | 85.5 | globlastp |
| 4840 | LYD513 nasturtium\|10v1\|GH163533 | 11095 | 648 | 85.5 | globlastp |
| 4841 | LYD513 orobanche\|10v1\|SRR023189S0004713_P1 | 11096 | 648 | 85.5 | globlastp |
| 4842 | LYD513 petunia\|gb171\|DW717169_P1 | 11096 | 648 | 85.5 | globlastp |
| 4843 | LYD513 radish\|gb164\|FD537267 | 11098 | 648 | 85.5 | globlastp |
| 4844 | LYD513 soybean\|11v1\|GLYMA02G02140 | 11099 | 648 | 85.5 | globlastp |
| 4845 | LYD513 strawberry\|11v1\|CO817747 | 11100 | 648 | 85.5 | globlastp |
| 4846 | LYD513 sunflower\|10v1\|CX947850 | 11101 | 648 | 85.5 | globlastp |
| 4847 | LYD513 thellungiella\|gb167\|DN773945 | 11084 | 648 | 85.5 | globlastp |
| 4848 | LYD513 triphysaria\|10v1\|EX992272 | 11102 | 648 | 85.5 | globlastp |
| 4849 | LYD513 canola\|11v1\|CN737195_P1 | 11091 | 648 | 85.5 | globlastp |
| 4850 | LYD513 platanus\|11v1\|SRR096786X103173_T1 | 11103 | 648 | 85.5 | glotblastn |
| 4851 | LYD513 amorphophallus\|11v2\|SRR089351X105406_P1 | 11104 | 648 | 85.3 | globlastp |
| 4852 | LYD513 eucalyptus\|11v2\|AJ627684_P1 | 11105 | 648 | 85.2 | globlastp |
| 4853 | LYD513 orobanche\|10v1\|SRR023189S0046512_P1 | 11106 | 648 | 85.2 | globlastp |
| 4854 | LYD513 ipomoea_nil\|10v1\|BJ558924_P1 | 11107 | 648 | 85.0 | globlastp |
| 4855 | LYD513 tobacco\|gb162\|DW004847 | 11108 | 648 | 85.0 | globlastp |
| 4856 | LYD513 humulus\|11v1\|SRR098683X107472_T1 | 11109 | 648 | 84.9 | glotblastn |
| 4857 | LYD513 flaveria\|11v1\|SRR149229.11765_P1 | 11110 | 648 | 84.9 | globlastp |
| 4858 | LYD513 flaveria\|11v1\|SRR149229.381866_P1 | 11110 | 648 | 84.9 | globlastp |
| 4859 | LYD513 flaveria\|11v1\|SRR149232.123700_P1 | 11110 | 648 | 84.9 | globlastp |
| 4860 | LYD513 flaveria\|11v1\|SRR149241.109921_P1 | 11110 | 648 | 84.9 | globlastp |
| 4861 | LYD513 basilicum\|10v1\|DY340275_P1 | 11111 | 648 | 84.9 | globlastp |
| 4862 | LYD513 dandelion\|10v1\|GO663210_P1 | 11112 | 648 | 84.9 | globlastp |
| 4863 | LYD513 gerbera\|09v1\|AJ754474_P1 | 11113 | 648 | 84.9 | globlastp |
| 4864 | LYD513 guizotia\|10v1\|GE554678_P1 | 11114 | 648 | 84.9 | globlastp |
| 4865 | LYD513 lettuce\|10v1\|DW078767_P1 | 11115 | 648 | 84.9 | globlastp |
| 4866 | LYD513 salvia\|10v1\|CV163820 | 11116 | 648 | 84.9 | globlastp |
| 4867 | LYD513 zinnia\|gb171\|AU285493 | 11117 | 648 | 84.9 | globlastp |
| 4868 | LYD513 ginseng\|10v1\|GR873119_P1 | 11118 | 648 | 84.8 | globlastp |
| 4869 | LYD513 tamarix\|gb166\|EB187196 | 11119 | 648 | 84.8 | globlastp |
| 4870 | LYD513 arnica\|11v1\|SRR099034X186262_P1 | 11120 | 648 | 84.7 | globlastp |
| 4871 | LYD513 flaveria\|11v1\|SRR149244.12975_P1 | 11121 | 648 | 84.7 | globlastp |
| 4872 | LYD513 aristolochia\|10v1\|SRR039082S0078402_P1 | 11122 | 648 | 84.7 | globlastp |
| 4873 | LYD513 nuphar\|gb166\|CD472395_P1 | 11123 | 648 | 84.7 | globlastp |
| 4874 | LYD513 sunflower\|10v1\|CD853275 | 11124 | 648 | 84.7 | globlastp |
| 4875 | LYD513 tobacco\|gb162\|BQ842942 | 11125 | 648 | 84.7 | globlastp |
| 4876 | LYD513 triphysaria\|10v1\|EY142731 | 11126 | 648 | 84.7 | globlastp |
| 4877 | LYD513 lettuce\|10v1\|DW110372_T1 | 11127 | 648 | 84.7 | glotblastn |
| 4878 | LYD513 flax\|09v1\|EH792319 | 11128 | 648 | 84.4 | globlastp |
| 4879 | LYD513 flax\|11v1\|EH792319_P1 | 11128 | 648 | 84.4 | globlastp |
| 4880 | LYD513 plantago\|11v1\|SRR066373X104296_T1 | 11129 | 648 | 84.3 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 4881 | LYD513 lettuce\|10v1\|DW062884_T1 | 11130 | 648 | 84.1 | glotblastn |
| 4882 | LYD513 flaveria\|11v1\|SRR149229.120812_P1 | 11131 | 648 | 84.1 | globlastp |
| 4883 | LYD513 phyla\|11v2\|SRR099037X103352_P1 | 11132 | 648 | 84.1 | globlastp |
| 4884 | LYD513 aquilegia\|10v2\|DT734083_P1 | 11133 | 648 | 84.1 | globlastp |
| 4885 | LYD513 euonymus\|11v1\|SRR070038X106335_P1 | 11134 | 648 | 84.0 | globlastp |
| 4886 | LYD513 tomato\|11v1\|BG123154_P1 | 11135 | 648 | 84.0 | globlastp |
| 4887 | LYD513 basilicum\|10v1\|DY339120_P1 | 11135 | 648 | 84.0 | globlastp |
| 4888 | LYD513 cleome_gynandra\|10v1\|SRR015532S0013901_P1 | 11136 | 648 | 84.0 | globlastp |
| 4889 | LYD513 cleome_spinosa\|10v1\|GR933436_P1 | 11137 | 648 | 84.0 | globlastp |
| 4890 | LYD513 nicotiana_benthamiana\|gb162\|CN746206_P1 | 11138 | 648 | 84.0 | globlastp |
| 4891 | LYD513 solanum_phureja\|09v1\|SPHBG123154 | 11135 | 648 | 84.0 | globlastp |
| 4892 | LYD513 sunflower\|10v1\|CD851298 | 11139 | 648 | 84.0 | globlastp |
| 4893 | LYD513 tobacco\|gb162\|BP192546 | 11138 | 648 | 84.0 | globlastp |
| 4894 | LYD513 tomato\|09v1\|BG123154 | 11135 | 648 | 84.0 | globlastp |
| 4895 | LYD513 euphorbia\|11v1\|BP957759_P1 | 11140 | 648 | 83.9 | globlastp |
| 4896 | LYD513 platanus\|11v1\|SRR096786X116699_P1 | 11141 | 648 | 83.9 | globlastp |
| 4897 | LYD513 thellungiella_parvulum\|11v1\|DN775739_P1 | 11142 | 648 | 83.9 | globlastp |
| 4898 | LYD513 eucalyptus\|11v2\|ES591058_P1 | 11143 | 648 | 83.9 | globlastp |
| 4899 | LYD513 eucalyptus\|gb166\|ES591058 | 11143 | 648 | 83.9 | globlastp |
| 4900 | LYD513 sunflower\|10v1\|CD845654 | 11144 | 648 | 83.9 | globlastp |
| 4901 | LYD513 sunflower\|10v1\|CD849620 | 11145 | 648 | 83.9 | globlastp |
| 4902 | LYD513 triphysaria\|10v1\|BM356487 | 11146 | 648 | 83.9 | globlastp |
| 4903 | LYD513 triphysaria\|10v1\|DR175698 | 11146 | 648 | 83.9 | globlastp |
| 4904 | LYD513 euonymus\|11v1\|SRR070038X339241_T1 | 11147 | 648 | 83.9 | glotblastn |
| 4905 | LYD513 sarracenia\|11v1\|SRR192669.318604_T1 | 11148 | 648 | 83.9 | glotblastn |
| 4906 | LYD513 ambrosia\|11v1\|SRR346935.208559_T1 | — | 648 | 83.9 | glotblastn |
| 4907 | LYD513 flax\|11v1\|JG030757_P1 | 11149 | 648 | 83.6 | globlastp |
| 4908 | LYD513 oat\|11v1\|CN814675_P1 | 11150 | 648 | 83.6 | globlastp |
| 4909 | LYD513 foxtail_millet\|11v3\|SIPRD089234_T1 | 11151 | 648 | 83.6 | glotblastn |
| 4910 | LYD513 plantago\|11v1\|SRR066373X107650_P1 | 11152 | 648 | 83.5 | globlastp |
| 4911 | LYD513 thalictrum\|11v1\|SRR096787X142953_P1 | 11153 | 648 | 83.5 | globlastp |
| 4912 | LYD513 nicotiana_benthamiana\|gb162\|ES884410_P1 | 11154 | 648 | 83.5 | globlastp |
| 4913 | LYD513 phyla\|11v2\|SRR099037X164099_T1 | 11155 | 648 | 83.3 | glotblastn |
| 4914 | LYD513 foxtail_millet\|10v2\|OXFXTRMSLX01026417D1T1 | 11156 | 648 | 83.3 | glotblastn |
| 4915 | LYD513 sorghum\|09v1\|SB02G042710 | 11157 | 648 | 83.3 | glotblastn |
| 4916 | LYD513 sorghum\|11v1\|SB02G042710_T1 | 11157 | 648 | 83.3 | glotblastn |
| 4917 | LYD513 tabernaemontana\|11v1\|SRR098689X109700_P1 | 11158 | 648 | 83.3 | globlastp |
| 4918 | LYD513 chickpea\|09v2\|EH058965_P1 | 11159 | 648 | 83.3 | globlastp |
| 4919 | LYD513 utricularia\|11v1\|SRR094438.102262_P1 | 11160 | 648 | 83.2 | globlastp |
| 4920 | LYD513 senecio\|gb170\|DY659748 | 11161 | 648 | 83.2 | globlastp |
| 4921 | LYD513 ambrosia\|11v1\|SRR346943.136934_P1 | 11162 | 648 | 83.1 | globlastp |
| 4922 | LYD513 canola\|11v1\|EG019879_P1 | 11163 | 648 | 83.1 | globlastp |
| 4923 | LYD513 euphorbia\|11v1\|DV112552_P1 | 11164 | 648 | 83.1 | globlastp |
| 4924 | LYD513 artemisia\|10v1\|SRR019254S0007751_P1 | 11165 | 648 | 83.1 | globlastp |
| 4925 | LYD513 b_rapa\|gb162\|EX116552_P1 | 11166 | 648 | 83.1 | globlastp |
| 4926 | LYD513 canola\|10v1\|EE472617 | 11166 | 648 | 83.1 | globlastp |
| 4927 | LYD513 ginger\|gb164\|DY357661_P1 | 11167 | 648 | 83.1 | globlastp |
| 4928 | LYD513 liriodendron\|gb166\|FD498270_P1 | 11168 | 648 | 83.1 | globlastp |
| 4929 | LYD513 papaya\|gb165\|EX274892_P1 | 11169 | 648 | 83.1 | globlastp |
| 4930 | LYD513 switchgrass\|gb167\|FE635043 | 11170 | 648 | 83.1 | globlastp |
| 4931 | LYD513 castorbean\|11v1\|RCPRD041500_T1 | 11171 | 648 | 83.1 | glotblastn |
| 4932 | LYD513 sarracenia\|11v1\|SRR192669.110146_T1 | 11172 | 648 | 83.1 | glotblastn |
| 4933 | LYD513 b_juncea\|10v2\|E6ANDIZ01DRJIF_T1 | 11173 | 648 | 83.1 | glotblastn |
| 4934 | LYD513 cacao\|10v1\|CU492790_T1 | 11174 | 648 | 83.1 | glotblastn |
| 4935 | LYD513 phalaenopsis\|11v1\|CB034569_P1 | 11175 | 648 | 82.9 | globlastp |
| 4936 | LYD513 fescue\|gb161\|CK801857_P1 | 11176 | 648 | 82.9 | globlastp |
| 4937 | LYD513 oat\|10v2\|CN814675 | 11177 | 648 | 82.9 | globlastp |
| 4938 | LYD513 oat\|11v1\|CN814914_P1 | 11177 | 648 | 82.9 | globlastp |
| 4939 | LYD513 flax\|11v1\|JG032172_P1 | 11178 | 648 | 82.8 | globlastp |
| 4940 | LYD513 flax\|11v1\|JG036696_P1 | 11178 | 648 | 82.8 | globlastp |
| 4941 | LYD513 tea\|10v1\|CV013672 | 11179 | 648 | 82.7 | globlastp |
| 4942 | LYD513 phyla\|11v2\|SRR099037X100949_P1 | 11180 | 648 | 82.5 | globlastp |
| 4943 | LYD513 silene\|11v1\|SRR096785X108457_P1 | 11181 | 648 | 82.5 | globlastp |
| 4944 | LYD513 radish\|gb164\|EV565633 | 11182 | 648 | 82.5 | globlastp |
| 4945 | LYD513 utricularia\|11v1\|SRR094438.104017_T1 | 11183 | 648 | 82.4 | glotblastn |
| 4946 | LYD513 antirrhinum\|gb166\|AJ560256_P1 | 11184 | 648 | 82.4 | globlastp |
| 4947 | LYD513 foxtail_millet\|10v2\|SICRP010615 | 11185 | 648 | 82.4 | globlastp |
| 4948 | LYD513 foxtail_millet\|11v3\|EC612466_P1 | 11185 | 648 | 82.4 | globlastp |
| 4949 | LYD513 pepper\|gb171\|BM062566_P1 | 11186 | 648 | 82.4 | globlastp |
| 4950 | LYD513 salvia\|10v1\|SRR014553S0000183 | 11187 | 648 | 82.4 | globlastp |
| 4951 | LYD513 nuphar\|gb166\|CK759983_P1 | 11188 | 648 | 82.3 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 4952 | LYD513 rice\|gb170\|OS07G47710 | 11189 | 648 | 82.3 | globlastp |
| 4953 | LYD513 arnica\|11v1\|SRR099034X286991_T1 | 11190 | 648 | 82.3 | glotblastn |
| 4954 | LYD513 phalaenopsis\|11v1\|SRR125771.1017052_P1 | 11191 | 648 | 82.2 | globlastp |
| 4955 | LYD513 barley\|10v2\|BE413243_P1 | 11192 | 648 | 82.2 | globlastp |
| 4956 | LYD513 pseudoroegneria\|gb167\|FF361979 | 11193 | 648 | 82.2 | globlastp |
| 4957 | LYD513 wheat\|10v2\|BE438494 | 11194 | 648 | 82.2 | globlastp |
| 4958 | LYD513 pigeonpea\|10v1\|SRR054580S0109025_P1 | 11195 | 648 | 82.1 | globlastp |
| 4959 | LYD513 sorghum\|11v1\|SBPRD033047_T1 | 11196 | 648 | 82.0 | glotblastn |
| 4960 | LYD513 flax\|11v1\|JG020520_P1 | 11197 | 648 | 82.0 | globlastp |
| 4961 | LYD513 fraxinus\|11v1\|FR640720_P1 | 11198 | 648 | 82.0 | globlastp |
| 4962 | LYD513 fraxinus\|11v1\|SRR058827.104308_P1 | 11198 | 648 | 82.0 | globlastp |
| 4963 | LYD513 primula\|11v1\|SRR098679X100264_P1 | 11199 | 648 | 81.9 | globlastp |
| 4964 | LYD513 ipomoea_batatas\|10v1\|BU692408_P1 | 11200 | 648 | 81.9 | globlastp |
| 4965 | LYD513 sorghum\|09v1\|SB01G035740 | 11201 | 648 | 81.8 | globlastp |
| 4966 | LYD513 sorghum\|11v1\|SB01G035740_P1 | 11201 | 648 | 81.8 | globlastp |
| 4967 | LYD513 oat\|11v1\|GO586090_T1 | 11202 | 648 | 81.8 | glotblastn |
| 4968 | LYD513 amsonia\|11v1\|SRR098688X105388_P1 | 11203 | 648 | 81.7 | globlastp |
| 4969 | LYD513 millet\|10v1\|CD725800_P1 | 11204 | 648 | 81.7 | globlastp |
| 4970 | LYD513 rice\|gb170\|OS03G22340 | 11205 | 648 | 81.7 | globlastp |
| 4971 | LYD513 tomato\|11v1\|BG127881_P1 | 11206 | 648 | 81.6 | globlastp |
| 4972 | LYD513 cleome_gynandra\|10v1\|SRR015532S0002104_P1 | 11207 | 648 | 81.6 | globlastp |
| 4973 | LYD513 potato\|10v1\|BI405294_P1 | 11208 | 648 | 81.6 | globlastp |
| 4974 | LYD513 tobacco\|gb162\|DW002267 | 11209 | 648 | 81.6 | globlastp |
| 4975 | LYD513 tobacco\|gb162\|DW004318 | 11210 | 648 | 81.6 | globlastp |
| 4976 | LYD513 eggplant\|10v1\|FS005422_P1 | 11211 | 648 | 81.5 | globlastp |
| 4977 | LYD513 gerbera\|09v1\|AJ758281_P1 | 11212 | 648 | 81.5 | globlastp |
| 4978 | LYD513 fraxinus\|11v1\|SRR058827.109256_P1 | 11213 | 648 | 81.2 | globlastp |
| 4979 | LYD513 fraxinus\|11v1\|SRR058827.130491_P1 | 11214 | 648 | 81.2 | globlastp |
| 4980 | LYD513 phalaenopsis\|11v1\|SRR125771.1852735_P1 | 11215 | 648 | 81.2 | globlastp |
| 4981 | LYD513 cleome_gynandra\|10v1\|SRR015532S0035353_P1 | 11216 | 648 | 81.2 | globlastp |
| 4982 | LYD513 ipomoea_nil\|10v1\|BJ554710_P1 | 11217 | 648 | 81.2 | globlastp |
| 4983 | LYD513 fagopyrum\|11v1\|SRR063703X132889_P1 | 11218 | 648 | 81.1 | globlastp |
| 4984 | LYD513 vinca\|11v1\|SRR098690X103207XX2_P1 | 11219 | 648 | 81.1 | globlastp |
| 4985 | LYD513 foxtail_millet\|11v3\|PHY7SI031166M_P1 | 11220 | 648 | 81.1 | globlastp |
| 4986 | LYD513 sugarcane\|10v1\|BQ537517 | 11221 | 648 | 81.1 | glotblastn |
| 4987 | LYD513 scabiosa\|11v1\|SRR063723X104698_P1 | 11222 | 648 | 81.0 | globlastp |
| 4988 | LYD513 maize\|10v1\|AI586735_T1 | 11223 | 648 | 81.0 | glotblastn |
| 4989 | LYD513 wheat\|10v2\|CA625957 | 11224 | 648 | 81.0 | glotblastn |
| 4990 | LYD513 brachypodium\|09v1\|DV479913_P1 | 11225 | 648 | 80.9 | globlastp |
| 4991 | LYD513 cowpea\|gb166\|FC458088_P1 | 11226 | 648 | 80.9 | globlastp |
| 4992 | LYD513 fescue\|gb161\|DT704464_P1 | 11227 | 648 | 80.9 | globlastp |
| 4993 | LYD513 switchgrass\|gb167\|DN152088 | 11228 | 648 | 80.9 | globlastp |
| 4994 | LYD513 switchgrass\|gb167\|FE607604 | 11228 | 648 | 80.9 | globlastp |
| 4995 | LYD513 wheat\|10v2\|BE419847 | 11227 | 648 | 80.9 | globlastp |
| 4996 | LYD513 wheat\|10v2\|CA703682 | 11227 | 648 | 80.9 | globlastp |
| 4997 | LYD513 utricularia\|11v1\|SRR094438.102360_P1 | 11229 | 648 | 80.8 | globlastp |
| 4998 | LYD513 antirrhinum\|gb166\|AJ787272_P1 | 11230 | 648 | 80.8 | globlastp |
| 4999 | LYD513 eggplant\|10v1\|FS001420_P1 | 11231 | 648 | 80.8 | globlastp |
| 5000 | LYD513 eggplant\|10v1\|FS001889_P1 | 11232 | 648 | 80.8 | globlastp |
| 5001 | LYD513 pepper\|gb171\|BM062891_P1 | 11233 | 648 | 80.8 | globlastp |
| 5002 | LYD513 podocarpus\|10v1\|SRR065014S0004051_T1 | 11234 | 648 | 80.8 | glotblastn |
| 5003 | LYD513 potato\|10v1\|BG589386_P1 | 11235 | 648 | 80.8 | globlastp |
| 5004 | LYD513 potato\|10v1\|CV473538_P1 | 11236 | 648 | 80.8 | globlastp |
| 5005 | LYD513 solanum_phureja\|09v1\|SPHBG127881 | 11235 | 648 | 80.8 | globlastp |
| 5006 | LYD513 sugarcane\|10v1\|CA076925 | 11237 | 648 | 80.8 | glotblastn |
| 5007 | LYD513 maritime_pine\|10v1\|BX251669_T1 | 11238 | 648 | 80.7 | glotblastn |
| 5008 | LYD513 b_juncea\|10v2\|OXBJ1SLX00006068T1_T1 | 11239 | 648 | 80.7 | glotblastn |
| 5009 | LYD513 pine\|10v2\|AI920012_T1 | 11240 | 648 | 80.7 | glotblastn |
| 5010 | LYD513 pine\|10v2\|BG039375_T1 | 11240 | 648 | 80.7 | glotblastn |
| 5011 | LYD513 ambrosia\|11v1\|SRR346949.173596_P1 | 11241 | 648 | 80.6 | globlastp |
| 5012 | LYD513 amborella\|gb166\|CK764554_P1 | 11242 | 648 | 80.6 | globlastp |
| 5013 | LYD513 b_juncea\|10v2\|E6ANDIZ01A6MR5_P1 | 11243 | 648 | 80.6 | globlastp |
| 5014 | LYD513 curcuma\|10v1\|DY395181_P1 | 11244 | 648 | 80.6 | globlastp |
| 5015 | LYD513 tomato\|09v1\|BG127881 | 11245 | 648 | 80.6 | globlastp |
| 5016 | LYD513 antirrhinum\|gb166\|AJ558298_P1 | 11246 | 648 | 80.5 | globlastp |
| 5017 | LYD513 eucalyptus\|11v2\|SRR001659X114529_T1 | 11247 | 648 | 80.5 | glotblastn |
| 5018 | LYD513 olea\|11v1\|SRR014463.29613_P1 | 11248 | 648 | 80.3 | globlastp |
| 5019 | LYD513 cleome_spinosa\|10v1\|GR933371_P1 | 11249 | 648 | 80.3 | globlastp |
| 5020 | LYD513 millet\|10v1\|CD726035_P1 | 11250 | 648 | 80.3 | globlastp |
| 5021 | LYD513 onion\|gb162\|CF437957_T1 | 11251 | 648 | 80.2 | glotblastn |
| 5022 | LYD513 barley\|10v2\|BG300003XX1_T1 | 11252 | 648 | 80.2 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5023 | LYD513 wheat\|10v2\|BE492748 | 11253 | 648 | 80.2 | glotblastn |
| 5024 | LYD515 soybean\|11v1\|GLYMA17G03590 | 11254 | 650 | 88.5 | globlastp |
| 5025 | LYD516 soybean\|11v1\|GLYMA07G32560 | 11255 | 651 | 99.2 | globlastp |
| 5026 | LYD516 pigeonpea\|10v1\|SRR054580S0031019_P1 | 11256 | 651 | 98.4 | globlastp |
| 5027 | LYD516 trigonella\|11v1\|SRR066194X204873_P1 | 11257 | 651 | 93.8 | globlastp |
| 5028 | LYD516 peanut\|10v1\|SRR042413S0063230_P1 | 11258 | 651 | 92.2 | globlastp |
| 5029 | LYD516 medicago\|09v1\|CX530843_P1 | 11259 | 651 | 90.9 | globlastp |
| 5030 | LYD516 heritiera\|10v1\|SRR005795S0009199_T1 | 11260 | 651 | 90.5 | glotblastn |
| 5031 | LYD516 oak\|10v1\|FP025273_P1 | 11261 | 651 | 90.5 | globlastp |
| 5032 | LYD516 poplar\|10v1\|AI165993_P1 | 11262 | 651 | 90.1 | globlastp |
| 5033 | LYD516 cacao\|10v1\|CU508547_P1 | 11263 | 651 | 89.3 | globlastp |
| 5034 | LYD516 cassava\|09v1\|DV446232_P1 | 11264 | 651 | 89.3 | globlastp |
| 5035 | LYD516 grape\|11v1\|GSVIVT01008672001_P1 | 11265 | 651 | 89.3 | globlastp |
| 5036 | LYD516 grape\|gb160\|CB970785 | 11265 | 651 | 89.3 | globlastp |
| 5037 | LYD516 eucalyptus\|11v2\|SRR001658X12485_P1 | 11266 | 651 | 89.0 | globlastp |
| 5038 | LYD516 sarracenia\|11v1\|SRR192669.104550_T1 | 11267 | 651 | 88.9 | glotblastn |
| 5039 | LYD516 euonymus\|11v1\|SRR070038X536114_P1 | 11268 | 651 | 88.9 | globlastp |
| 5040 | LYD516 aquilegia\|10v2\|JGIAC016826_P1 | 11269 | 651 | 88.9 | globlastp |
| 5041 | LYD516 castorbean\|09v1\|EE260562 | 11270 | 651 | 88.9 | globlastp |
| 5042 | LYD516 citrus\|gb166\|CF507311_P1 | 11271 | 651 | 88.9 | globlastp |
| 5043 | LYD516 castorbean\|11v1\|EE260562_T1 | 11272 | 651 | 88.9 | glotblastn |
| 5044 | LYD516 cirsium\|11v1\|SRR346952.1009815_P1 | 11273 | 651 | 88.5 | globlastp |
| 5045 | LYD516 clementine\|11v1\|CF507311_P1 | 11274 | 651 | 88.5 | globlastp |
| 5046 | LYD516 orange\|11v1\|CF507311_P1 | 11274 | 651 | 88.5 | globlastp |
| 5047 | LYD516 cotton\|10v2\|DW518809_P1 | 11275 | 651 | 88.5 | globlastp |
| 5048 | LYD516 poplar\|10v1\|CA823401_P1 | 11276 | 651 | 88.5 | globlastp |
| 5049 | LYD516 strawberry\|11v1\|DV438628 | 11277 | 651 | 88.5 | globlastp |
| 5050 | LYD516 sunflower\|10v1\|CD853568 | 11278 | 651 | 88.5 | globlastp |
| 5051 | LYD516 cannabis\|12v1\|SOLX00016295_P1 | 11279 | 651 | 88.1 | globlastp |
| 5052 | LYD516 cannabis\|12v1\|SOLX00022534_P1 | 11279 | 651 | 88.1 | globlastp |
| 5053 | LYD516 cirsium\|11v1\|SRR346952.1053287_P1 | 11280 | 651 | 88.1 | globlastp |
| 5054 | LYD516 tripterygium\|11v1\|SRR098677X167643_P1 | 11281 | 651 | 88.1 | globlastp |
| 5055 | LYD516 watermelon\|11v1\|AM721327_P1 | 11282 | 651 | 88.1 | globlastp |
| 5056 | LYD516 antirrhinum\|gb166\|AJ558491_P1 | 11283 | 651 | 88.1 | globlastp |
| 5057 | LYD516 eggplant\|10v1\|FS043100_P1 | 11284 | 651 | 88.1 | globlastp |
| 5058 | LYD516 nasturtium\|10v1\|SRR032558S0020529 | 11285 | 651 | 88.1 | globlastp |
| 5059 | LYD516 triphysaria\|10v1\|EY135917 | 11286 | 651 | 88.1 | globlastp |
| 5060 | LYD516 lotus\|09v1\|LLGO008293_T1 | 11287 | 651 | 88.1 | glotblastn |
| 5061 | LYD516 flaveria\|11v1\|SRR149229.125238_P1 | 11288 | 651 | 87.7 | globlastp |
| 5062 | LYD516 humulus\|11v1\|EX520638_P1 | 11289 | 651 | 87.7 | globlastp |
| 5063 | LYD516 phyla\|11v2\|SRR0199035X138404_P1 | 11290 | 651 | 87.7 | globlastp |
| 5064 | LYD516 valeriana\|11v1\|SRR099039X126752_P1 | 11291 | 651 | 87.7 | globlastp |
| 5065 | LYD516 monkeyflower\|10v1\|GO989970_P1 | 11292 | 651 | 87.7 | globlastp |
| 5066 | LYD516 potato\|10v1\|BQ518483_P1 | 11293 | 651 | 87.7 | globlastp |
| 5067 | LYD516 solanum_phureja\|09v1\|SPHBG133348 | 11293 | 651 | 87.7 | globlastp |
| 5068 | LYD516 amsonia\|11v1\|SRR098688X127436_T1 | 11294 | 651 | 87.5 | glotblastn |
| 5069 | LYD516 euphorbia\|11v1\|DV132990_P1 | 11295 | 651 | 87.3 | globlastp |
| 5070 | LYD516 tomato\|11v1\|BG133348_P1 | 11296 | 651 | 87.3 | globlastp |
| 5071 | LYD516 flaveria\|11v1\|SRR149232.166080_P1 | 11297 | 651 | 87.2 | globlastp |
| 5072 | LYD516 apple\|11v1\|CN581445_P1 | 11298 | 651 | 87.2 | globlastp |
| 5073 | LYD516 apple\|gb171\|CN581445 | 11298 | 651 | 87.2 | globlastp |
| 5074 | LYD516 pepper\|gb171\|BM064603_P1 | 11299 | 651 | 87.2 | globlastp |
| 5075 | LYD516 tragopogon\|10v1\|SRR020205S0056237 | 11300 | 651 | 87.2 | globlastp |
| 5076 | LYD516 ambrosia\|11v1\|SRR346935.211093_P1 | 11301 | 651 | 86.9 | globlastp |
| 5077 | LYD516 ipomoea_nil\|10v1\|CJ750723_P1 | 11302 | 651 | 86.9 | globlastp |
| 5078 | LYD516 ambrosia\|11v1\|SRR346935.107584_P1 | 11303 | 651 | 86.8 | globlastp |
| 5079 | LYD516 arnica\|11v1\|SRR099034X166025_P1 | 11304 | 651 | 86.8 | globlastp |
| 5080 | LYD516 phyla\|11v2\|SRR099037X123707_P1 | 11305 | 651 | 86.8 | globlastp |
| 5081 | LYD516 fagopyrum\|11v1\|SRR063689X100235_P1 | 11306 | 651 | 86.4 | globlastp |
| 5082 | LYD516 cichorium\|gb171\|EH686475_P1 | 11307 | 651 | 86.4 | globlastp |
| 5083 | LYD516 cucumber\|09v1\|AM721327_P1 | 11308 | 651 | 86.4 | globlastp |
| 5084 | LYD516 dandelion\|10v1\|DY816266_P1 | 11309 | 651 | 86.4 | globlastp |
| 5085 | LYD516 foxtail_millet\|10v2\|SICRP000764 | 11310 | 651 | 86.4 | globlastp |
| 5086 | LYD516 foxtail_millet\|11v3\|PHY7SI037228M_P1 | 11310 | 651 | 86.4 | globlastp |
| 5087 | LYD516 orobanche\|10v1\|SRR023189S0025641_P1 | 11311 | 651 | 86.4 | globlastp |
| 5088 | LYD516 tobacco\|gb162\|EB446786 | 11312 | 651 | 86.4 | globlastp |
| 5089 | LYD516 thellungiella_halophilum\|11v1\|EHJGI11006704_P1 | 11313 | 651 | 86.2 | globlastp |
| 5090 | LYD516 artemisia\|10v1\|SRR019254S0000716_P1 | 11314 | 651 | 86.1 | globlastp |
| 5091 | LYD516 thellungiella_parvulum\|11v1\|EPCRP003771_P1 | 11315 | 651 | 86.0 | globlastp |
| 5092 | LYD516 radish\|gb164\|EV526582 | 11316 | 651 | 86.0 | globlastp |
| 5093 | LYD516 sorghum\|09v1\|SB01G002910 | 11317 | 651 | 86.0 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5094 | LYD516 sorghum\|11v1\|SB01G002910_P1 | 11317 | 651 | 86.0 | globlastp |
| 5095 | LYD516 sugarcane\|10v1\|CA080466 | 11318 | 651 | 86.0 | globlastp |
| 5096 | LYD516 switchgrass\|gb167\|DN151337 | 11319 | 651 | 86.0 | globlastp |
| 5097 | LYD516 switchgrass\|gb167\|FL906279 | 11320 | 651 | 86.0 | globlastp |
| 5098 | LYD516 barley\|10v2\|BG343745_P1 | 11321 | 651 | 85.7 | globlastp |
| 5099 | LYD516 wheat\|10v2\|BE490237 | 11322 | 651 | 85.7 | globlastp |
| 5100 | LYD516 tomato\|09v1\|BG133348 | 11323 | 651 | 85.5 | globlastp |
| 5101 | LYD516 arabidopsis_lyrata\|09v1\|JGIAL002170_P1 | 11324 | 651 | 85.4 | globlastp |
| 5102 | LYD516 centaurea\|gb166\|EH763345_P1 | 11325 | 651 | 85.2 | globlastp |
| 5103 | LYD516 lettuce\|10v1\|DW090930_P1 | 11326 | 651 | 85.2 | globlastp |
| 5104 | LYD516 flaveria\|11v1\|SRR149232.112380_T1 | 11327 | 651 | 85.2 | glotblastn |
| 5105 | LYD516 amorphophallus\|11v2\|SRR089351X118179_P1 | 11328 | 651 | 85.1 | globlastp |
| 5106 | LYD516 canola\|11v1\|EE492115XX2_P1 | 11329 | 651 | 85.0 | globlastp |
| 5107 | LYD516 arabidopsis\|10v1\|AT1G20575_P1 | 11330 | 651 | 85.0 | globlastp |
| 5108 | LYD516 b_rapa\|gb162\|DN192163_P1 | 11331 | 651 | 85.0 | globlastp |
| 5109 | LYD516 canola\|10v1\|EG020521 | 11331 | 651 | 85.0 | globlastp |
| 5110 | LYD516 canola\|11v1\|EG020521_P1 | 11331 | 651 | 85.0 | globlastp |
| 5111 | LYD516 millet\|10v1\|EVO454PM004940_P1 | 11332 | 651 | 84.8 | globlastp |
| 5112 | LYD516 rice\|gb170\|OS03G60939 | 11333 | 651 | 84.4 | globlastp |
| 5113 | LYD516 guizotia\|10v1\|GE574338_T1 | 11334 | 651 | 84.4 | glotblastn |
| 5114 | LYD516 barley\|10v2\|BI954789_P1 | 11335 | 651 | 84.1 | globlastp |
| 5115 | LYD516 cucurbita\|11v1\|SRR091276X104098_P1 | 11336 | 651 | 83.7 | globlastp |
| 5116 | LYD516 sunflower\|10v1\|DY912431 | 11337 | 651 | 83.7 | globlastp |
| 5117 | LYD516 cotton\|10v2\|SRR032367S0053467_P1 | 11338 | 651 | 83.2 | globlastp |
| 5118 | LYD516 fraxinus\|11v1\|SRR058827.140800_P1 | 11339 | 651 | 82.4 | globlastp |
| 5119 | LYD516 phalaenopsis\|11v1\|SRR125771.1162821_P1 | 11340 | 651 | 82.3 | globlastp |
| 5120 | LYD516 brachypodium\|09v1\|DV480052_P1 | 11341 | 651 | 82.0 | globlastp |
| 5121 | LYD516 cynara\|gb167\|GE592012_P1 | 11342 | 651 | 81.5 | globlastp |
| 5122 | LYD516 pea\|11v1\|FG535481_P1 | 11343 | 651 | 81.5 | globlastp |
| 5123 | LYD516 sciadopitys\|10v1\|SRR065035S0111756 | 11344 | 651 | 81.5 | globlastp |
| 5124 | LYD516 sequoia\|10v1\|SRR065044S0071394 | 11345 | 651 | 81.5 | glotblastn |
| 5125 | LYD516 prunus\|10v1\|CN581445 | 11346 | 651 | 81.3 | globlastp |
| 5126 | LYD516 pine\|10v2\|CO161942_P1 | 11347 | 651 | 81.2 | globlastp |
| 5127 | LYD516 spruce\|gb162\|DR480179 | 11348 | 651 | 81.2 | globlastp |
| 5128 | LYD516 cirsium\|11v1\|SRR346952.104906_P1 | 11349 | 651 | 80.7 | globlastp |
| 5129 | LYD516 rose\|10v1\|BQ104509 | 11350 | 651 | 80.3 | glotblastn |
| 5130 | LYD516 pseudotsuga\|10v1\|SRR065119S0144926 | 11351 | 651 | 80.2 | globlastp |
| 5131 | LYD517 soybean\|11v1\|GLYMA13G32400 | 11352 | 652 | 98.9 | globlastp |
| 5132 | LYD517 cowpea\|gb166\|FF383594_P1 | 11353 | 652 | 97.9 | globlastp |
| 5133 | LYD517 bean\|gb167\|CV543950_T1 | 11354 | 652 | 94.7 | glotblastn |
| 5134 | LYD517 soybean\|11v1\|GLYMA01G35880 | 11355 | 652 | 92.6 | globlastp |
| 5135 | LYD517 soybean\|11v1\|GLYMA15G19490 | 11356 | 652 | 92.6 | globlastp |
| 5136 | LYD517 liquorice\|gb171\|FS243082_P1 | 11357 | 652 | 90.4 | globlastp |
| 5137 | LYD517 pigeonpea\|10v1\|SRR054580S0027041_P1 | 11358 | 652 | 90.4 | globlastp |
| 5138 | LYD517 trigonella\|11v1\|SRR066194X109349_P1 | 11359 | 652 | 83.3 | globlastp |
| 5139 | LYD517 medicago\|09v1\|BE998971_P1 | 11360 | 652 | 81.1 | globlastp |
| 5140 | LYD517 medicago\|09v1\|LLEY475311_P1 | 11361 | 652 | 81.1 | globlastp |
| 5141 | LYD517 lotus\|09v1\|LLAW719440_P1 | 11362 | 652 | 80.9 | globlastp |
| 5142 | LYD518 soybean\|11v1\|GLYMA09G37680 | 11363 | 653 | 90.8 | globlastp |
| 5143 | LYD519 soybean\|11v1\|GLYMA17G13880 | 11364 | 654 | 97.1 | globlastp |
| 5143 | LYD446 soybean\|11v1\|GLYMA17G13880 | 11364 | 759 | 80.7 | globlastp |
| 5144 | LYD519 pigeonpea\|10v1\|SRR054580S0003918_P1 | 11365 | 654 | 90.0 | globlastp |
| 5144 | LYD446 pigeonpea\|10v1\|SRR054580S0003918_T1 | 11365 | 759 | 80.1 | glotblastn |
| 5145 | LYD519 medicago\|09v1\|AA660841_P1 | 11366 | 654 | 87.6 | globlastp |
| 5145 | LYD446 medicago\|09v1\|AA660841_P1 | 11366 | 759 | 81.7 | globlastp |
| 5146 | LYD519 trigonella\|11v1\|SRR066194X285692_P1 | 11367 | 654 | 86.9 | globlastp |
| 5146 | LYD446 trigonella\|11v1\|SRR066194X285692_P1 | 11367 | 759 | 82.1 | globlastp |
| 5147 | LYD519 bean\|gb167\|FE899248_P1 | 11368 | 654 | 81.7 | globlastp |
| 5147 | LYD446 bean\|gb167\|FE899248_P1 | 11368 | 759 | 92.0 | globlastp |
| 5148 | LYD519 pigeonpea\|10v1\|SRR054580S0003417_P1 | 11369 | 654 | 80.5 | globlastp |
| 5148 | LYD446 pigeonpea\|10v1\|SRR054580S0003417_P1 | 11369 | 759 | 92.0 | globlastp |
| 5149 | LYD519 soybean\|11v1\|GLYMA04G37140 | 11370 | 654 | 80.2 | globlastp |
| 5149 | LYD446 soybean\|11v1\|GLYMA04G37140 | 11370 | 759 | 95.4 | globlastp |
| 5150 | LYD520 soybean\|11v1\|GLYMA14G26410 | 11371 | 655 | 97.5 | globlastp |
| 5151 | LYD520 wheat\|10v2\|CA713308 | 11372 | 655 | 97.5 | glotblastn |
| 5152 | LYD346 canola\|10v1\|SRR019558S0000508 | 11373 | 656 | 90.6 | globlastp |
| 5153 | LYD346 canola\|10v1\|SRR019558S0000166 | 11374 | 656 | 82.4 | globlastp |
| 5154 | LYD346 radish\|gb164\|EX756745 | 11375 | 656 | 82.0 | glotblastn |
| 5155 | LYD346 radish\|gb164\|EW735537 | 11376 | 656 | 80.0 | glotblastn |
| 5156 | LYD347 radish\|gb164\|EW723638 | 11377 | 657 | 87.5 | glotblastn |
| 5157 | LYD347 rice\|gb170\|OS06G29180 | 11378 | 657 | 83.6 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5157 | LYD382 rice\|gb170\|OS06G29180 | 11378 | 730 | 81.9 | globlastp |
| 5158 | LYD347 barley\|10v2\|D88272_T1 | 11379 | 657 | 83.6 | glotblastn |
| 5158 | LYD382 barley\|10v2\|D88272_P1 | 11379 | 730 | 80.4 | globlastp |
| 5159 | LYD347 oat\|11v1\|CN816354_T1 | 11380 | 657 | 82.8 | glotblastn |
| 5159 | LYD382 oat\|11v1\|CN816354_T1 | 11380 | 730 | 80.1 | glotblastn |
| 5160 | LYD347 sorghum\|11v1\|SB10G016920_T1 | 11381 | 657 | 82.8 | glotblastn |
| 5161 | LYD347 switchgrass\|gb167\|DN152535 | 11382 | 657 | 82.8 | glotblastn |
| 5161 | LYD382 switchgrass\|gb167\|DN152535 | 11382 | 730 | 80.4 | globlastp |
| 5162 | LYD347 wheat\|10v2\|BE399573 | 11383 | 657 | 82.8 | glotblastn |
| 5162 | LYD382 wheat\|10v2\|BE399573 | 11383 | 730 | 80.6 | globlastp |
| 5163 | LYD347 wheat\|10v2\|BE402330 | 11383 | 657 | 82.8 | glotblastn |
| 5163 | LYD382 wheat\|10v2\|BE402330 | 11383 | 730 | 80.6 | globlastp |
| 5164 | LYD347 oat\|10v2\|CN816354 | 11384 | 657 | 82.8 | glotblastn |
| 5164 | LYD382 oat\|10v2\|CN816354 | 11384 | 730 | 80.4 | glotblastn |
| 5165 | LYD347 beet\|gb162\|BQ584012_T1 | 11385 | 657 | 82.0 | glotblastn |
| 5166 | LYD347 pineapple\|10v1\|CO730916_T1 | 11386 | 657 | 82.0 | glotblastn |
| 5167 | LYD347 cenchrus\|gb166\|EB656212_T1 | 11387 | 657 | 82.0 | glotblastn |
| 5167 | LYD382 cenchrus\|gb166\|EB656212_T1 | 11387 | 730 | 81.9 | glotblastn |
| 5168 | LYD347 b_juncea\|10v2\|E6ANDIZ01B65C8_P1 | 11388 | 657 | 82.0 | globlastp |
| 5169 | LYD347 momordica\|10v1\|EC612932_T1 | 11389 | 657 | 81.3 | glotblastn |
| 5170 | LYD347 switchgrass\|gb167\|DN152447 | 11390 | 657 | 81.3 | glotblastn |
| 5170 | LYD382 switchgrass\|gb167\|DN152447 | 11390 | 730 | 82.5 | globlastp |
| 5171 | LYD347 cannabis\|12v1\|EW701698_T1 | 11391 | 657 | 80.5 | glotblastn |
| 5171 | LYD382 cannabis\|12v1\|EW701698_P1 | 11391 | 730 | 82.5 | globlastp |
| 5172 | LYD347 phalaenopsis\|11v1\|HO059347_T1 | 11392 | 657 | 80.5 | glotblastn |
| 5173 | LYD347 phalaenopsis\|11v1\|SRR125771.1046126_T1 | 11393 | 657 | 80.5 | glotblastn |
| 5174 | LYD347 ginger\|gb164\|DY368088_T1 | 11394 | 657 | 80.5 | glotblastn |
| 5175 | LYD347 maize\|10v1\|CA829374_T1 | 11395 | 657 | 80.5 | glotblastn |
| 5176 | LYD347 maize\|10v1\|GRMZM2G147714T01_T1 | 11396 | 657 | 80.5 | glotblastn |
| 5177 | LYD347 petunia\|gb171\|CV296141_T1 | 11397 | 657 | 80.5 | glotblastn |
| 5178 | LYD347 wheat\|10v2\|BE398406 | 11398 | 657 | 80.5 | glotblastn |
| 5179 | LYD348 b_juncea\|10v2\|BJ1SLX00178941_T1 | 11399 | 658 | 95.1 | glotblastn |
| 5180 | LYD348 b_rapa\|gb162\|EX025369_T1 | 11400 | 658 | 95.1 | glotblastn |
| 5181 | LYD349 canola\|11v1\|ES900198_T1 | 11401 | 659 | 87.6 | glotblastn |
| 5182 | LYD349 canola\|10v1\|CX193484 | 11402 | 659 | 84.3 | glotblastn |
| 5183 | LYD349 thellungiella_parvulum\|11v1\|BY820471_T1 | 11403 | 659 | 81.6 | glotblastn |
| 5184 | LYD351 b_oleracea\|gb161\|EH414500_T1 | 11404 | 660 | 98.4 | glotblastn |
| 5185 | LYD351 radish\|gb164\|EV529730 | 11405 | 660 | 90.7 | globlastp |
| 5186 | LYD351 canola\|10v1\|EV157501 | 11406 | 660 | 83.1 | globlastp |
| 5187 | LYD351 cacao\|10v1\|CU509898_T1 | 11407 | 660 | 82.8 | glotblastn |
| 5188 | LYD351 eucalyptus\|11v2\|CD668366_T1 | 11408 | 660 | 82.4 | glotblastn |
| 5189 | LYD351 cannabis\|12v1\|SOLX00048062_T1 | 11409 | 660 | 81.8 | glotblastn |
| 5190 | LYD351 apple\|11v1\|CN492458_T1 | 11410 | 660 | 81.5 | glotblastn |
| 5191 | LYD351 castorbean\|09v1\|EG664260 | 11411 | 660 | 81.2 | glotblastn |
| 5192 | LYD351 castorbean\|11v1\|EG664260_T1 | 11411 | 660 | 81.2 | glotblastn |
| 5193 | LYD351 medicago\|09v1\|AW698369_T1 | 11412 | 660 | 81.2 | glotblastn |
| 5194 | LYD351 peanut\|10v1\|GO257140_T1 | 11413 | 660 | 81.2 | glotblastn |
| 5195 | LYD351 soybean\|11v1\|GLYMA09G38820 | 11414 | 660 | 81.2 | glotblastn |
| 5196 | LYD351 apple\|gb171\|CN491801 | 11415 | 660 | 80.9 | glotblastn |
| 5197 | LYD351 prunus\|10v1\|BU039990 | 11416 | 660 | 80.9 | glotblastn |
| 5198 | LYD351 bean\|gb167\|CV531630_T1 | 11417 | 660 | 80.8 | glotblastn |
| 5199 | LYD351 pigeonpea\|10v1\|SRR054580S0004621_T1 | 11418 | 660 | 80.8 | glotblastn |
| 5200 | LYD351 strawberry\|11v1\|SRR034840S0001005 | 11419 | 660 | 80.8 | glotblastn |
| 5201 | LYD351 watermelon\|11v1\|AM725308_T1 | 11420 | 660 | 80.6 | glotblastn |
| 5202 | LYD351 melon\|10v1\|AM725308_T1 | 11421 | 660 | 80.6 | glotblastn |
| 5203 | LYD351 monkeyflower\|10v1\|GO951608_T1 | 11422 | 660 | 80.6 | glotblastn |
| 5204 | LYD351 solanum_phureja\|09v1\|SPHBG123929 | 11423 | 660 | 80.5 | glotblastn |
| 5205 | LYD351 soybean\|11v1\|GLYMA18G47500 | 11424 | 660 | 80.5 | glotblastn |
| 5206 | LYD351 valeriana\|11v1\|SRR099039X100750_T1 | 11425 | 660 | 80.5 | glotblastn |
| 5207 | LYD351 cirsium\|11v1\|SRR346952.123633_T1 | 11426 | 660 | 80.2 | glotblastn |
| 5208 | LYD351 sorghum\|09v1\|SB04G037300 | 11427 | 660 | 80.2 | glotblastn |
| 5209 | LYD351 sorghum\|11v1\|SB04G037300_T1 | 11428 | 660 | 80.2 | glotblastn |
| 5210 | LYD352 radish\|gb164\|EV545410 | 11429 | 661 | 98.1 | glotblastn |
| 5211 | LYD352 b_oleracea\|gb161\|DY026468_T1 | 11430 | 661 | 97.0 | glotblastn |
| 5212 | LYD352 b_rapa\|gb162\|DN961910_T1 | 11431 | 661 | 95.9 | glotblastn |
| 5213 | LYD352 cleome_gynandra\|10v1\|SRR015532S0011306_P1 | 11432 | 661 | 90.0 | globlastp |
| 5214 | LYD352 ambrosia\|11v1\|SRR346935.101212_T1 | 11433 | 661 | 89.5 | glotblastn |
| 5215 | LYD352 ambrosia\|11v1\|SRR346935.103713_T1 | 11434 | 661 | 89.1 | glotblastn |
| 5216 | LYD352 tragopogon\|10v1\|SRR020205S0026626 | 11435 | 661 | 89.1 | glotblastn |
| 5217 | LYD352 spurge\|gb161\|DV127964 | 11436 | 661 | 88.8 | glotblastn |
| 5218 | LYD352 arnica\|11v1\|SRR099034X104117_T1 | 11437 | 661 | 88.4 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5219 | LYD352 cirsium\|11v1\|SRR346952.1104703_T1 | 11438 | 661 | 88.4 | glotblastn |
| 5220 | LYD352 flaveria\|11v1\|SRR149232.136427_T1 | 11439 | 661 | 88.4 | glotblastn |
| 5221 | LYD352 tripterygium\|11v1\|SRR098677X108916_T1 | 11440 | 661 | 88.4 | glotblastn |
| 5222 | LYD352 momordica\|10v1\|SRR071315S0009646_T1 | 11441 | 661 | 88.4 | glotblastn |
| 5223 | LYD352 flaveria\|11v1\|SRR149229.409621_T1 | 11442 | 661 | 88.0 | glotblastn |
| 5224 | LYD352 flaveria\|11v1\|SRR149232.121812_T1 | 11443 | 661 | 88.0 | glotblastn |
| 5225 | LYD352 flaveria\|11v1\|SRR149232.201046_T1 | 11444 | 661 | 87.6 | glotblastn |
| 5226 | LYD352 olea\|11v1\|SRR014463.16203_T1 | 11445 | 661 | 87.6 | glotblastn |
| 5227 | LYD352 plantago\|11v1\|SRR066373X114220_T1 | 11446 | 661 | 87.6 | glotblastn |
| 5228 | LYD352 eschscholzia\|10v1\|SRR014116S0015867 | 11447 | 661 | 87.6 | glotblastn |
| 5229 | LYD352 radish\|gb164\|EV539830 | 11448 | 661 | 87.4 | globlastp |
| 5230 | LYD352 flaveria\|11v1\|SRR149229.35667_T1 | 11449 | 661 | 87.3 | glotblastn |
| 5231 | LYD352 ipomoea_nil\|10v1\|BJ561491_T1 | 11450 | 661 | 87.3 | glotblastn |
| 5232 | LYD352 ambrosia\|11v1\|SRR346935.116176_T1 | 11451 | 661 | 86.9 | glotblastn |
| 5233 | LYD352 flaveria\|11v1\|SRR149238.21087_T1 | 11452 | 661 | 86.9 | glotblastn |
| 5234 | LYD352 artemisia\|10v1\|EY042264_T1 | 11453 | 661 | 86.9 | glotblastn |
| 5235 | LYD352 bean\|gb167\|CB556019_T1 | 11454 | 661 | 86.9 | glotblastn |
| 5236 | LYD352 poplar\|10v1\|AI162727_T1 | 11455 | 661 | 86.9 | glotblastn |
| 5237 | LYD352 triphysaria\|10v1\|EY159209 | 11456 | 661 | 86.9 | glotblastn |
| 5238 | LYD352 thalictrum\|11v1\|SRR096787X112428_T1 | 11457 | 661 | 86.5 | glotblastn |
| 5239 | LYD352 vinca\|11v1\|SRR098690X123285_T1 | 11458 | 661 | 86.5 | glotblastn |
| 5240 | LYD352 papaya\|gb165\|EX245660_T1 | 11459 | 661 | 86.5 | glotblastn |
| 5241 | LYD352 b_juncea\|10v2\|E6ANDIZ02HIGWB_P1 | 11460 | 661 | 86.5 | globlastp |
| 5242 | LYD352 humulus\|11v1\|SRR098683X16251_T1 | 11461 | 661 | 86.1 | glotblastn |
| 5243 | LYD352 phalaenopsis\|11v1\|CB032553XX1_T1 | 11462 | 661 | 86.1 | glotblastn |
| 5244 | LYD352 clover\|gb162\|BB903320_T1 | 11463 | 661 | 86.1 | glotblastn |
| 5245 | LYD352 kiwi\|gb166\|FG422711_T1 | 11464 | 661 | 86.1 | glotblastn |
| 5246 | LYD352 oil_palm\|gb166\|EY399708_T1 | 11465 | 661 | 86.1 | glotblastn |
| 5247 | LYD352 phyla\|11v2\|SRR0199037X114925_T1 | 11466 | 661 | 85.8 | glotblastn |
| 5248 | LYD352 sequoia\|10v1\|SRR065044S0008788 | 11467 | 661 | 85.8 | glotblastn |
| 5249 | LYD352 taxus\|10v1\|SRR032523S0055454 | 11468 | 661 | 85.8 | glotblastn |
| 5250 | LYD352 distylium\|11v1\|SRR065077X103079_T1 | 11469 | 661 | 85.4 | glotblastn |
| 5251 | LYD352 fagopyrum\|11v1\|SRR063689X104399_T1 | 11470 | 661 | 85.4 | glotblastn |
| 5252 | LYD352 cynodon\|10v1\|ES296962_T1 | 11471 | 661 | 85.4 | glotblastn |
| 5253 | LYD352 switchgrass\|gb167\|FE619761 | 11472 | 661 | 85.4 | glotblastn |
| 5254 | LYD352 gnetum\|10v1\|CB081075_T! | 11473 | 661 | 85.0 | glotblastn |
| 5255 | LYD352 amaranthus\|10v1\|SRR039411S0011775_T1 | 11474 | 661 | 84.6 | glotblastn |
| 5256 | LYD352 leymus\|gb166\|CN466043_T1 | 11475 | 661 | 84.6 | glotblastn |
| 5257 | LYD352 orobanche\|10v1\|SRR023189S0030948_T1 | 11476 | 661 | 84.6 | glotblastn |
| 5258 | LYD352 sciadopitys\|10v1\|SRR065035S0006970 | 11477 | 661 | 84.6 | glotblastn |
| 5259 | LYD352 foxtail_millet\|11v3\|PHY7SI034613M_T1 | 11478 | 661 | 84.6 | glotblastn |
| 5260 | LYD352 cedrus\|11v1\|SRR065007X106828_T1 | 11479 | 661 | 84.3 | glotblastn |
| 5261 | LYD352 sarracenia\|11v1\|SRR192669.100984_T1 | 11480 | 661 | 84.3 | glotblastn |
| 5262 | LYD352 foxtail_millet\|10v2\|OXFXTRMSLX00010459D1T1 | 11481 | 661 | 84.3 | glotblastn |
| 5263 | LYD352 utricularia\|11v1\|SRR094438.104933_T1 | 11482 | 661 | 83.5 | glotblastn |
| 5264 | LYD352 eggplant\|10v1\|FS037002_P1 | 11483 | 661 | 83.5 | globlastp |
| 5265 | LYD352 silene\|11v1\|SRR096785X102605_T1 | 11484 | 661 | 82.8 | glotblastn |
| 5266 | LYD352 oil_palm\|gb166\|EL608857_T1 | 11485 | 661 | 82.4 | glotblastn |
| 5267 | LYD352 pepper\|gb171\|CA523086_P1 | 11486 | 661 | 82.0 | globlastp |
| 5268 | LYD352 physcomitrella\|10v1\|BJ171424_T1 | 11487 | 661 | 81.7 | glotblastn |
| 5269 | LYD352 ceratodon\|10v1\|SRR074890S0033327_T1 | 11488 | 661 | 81.3 | glotblastn |
| 5270 | LYD352 apple\|11v1\|CN496969_P1 | 11489 | 661 | 81.1 | globlastp |
| 5271 | LYD352 petunia\|gb171\|FN004778_P1 | 11490 | 661 | 81.0 | globlastp |
| 5272 | LYD352 physcomitrella\|10v1\|BI741161_T1 | 11491 | 661 | 80.9 | glotblastn |
| 5273 | LYD352 basilicum\|10v1\|DY323163_P1 | 11492 | 661 | 80.4 | globlastp |
| 5274 | LYD352 pigeonpea\|10v1\|SRR054580S0006246_P1 | 11493 | 661 | 80.3 | globlastp |
| 5275 | LYD352 flaveria\|11v1\|SRR149229.143097_T1 | 11494 | 661 | 80.2 | glotblastn |
| 5276 | LYD353 b_oleracea\|gb161\|AF518565_T1 | 11495 | 662 | 94.7 | glotblastn |
| 5277 | LYD353 canola\|10v1\|DY006446 | 11496 | 662 | 90.5 | glotblastn |
| 5278 | LYD353 canola\|10v1\|EE392420 | 11497 | 662 | 84.3 | globlastp |
| 5279 | LYD354 b_rapa\|gb162\|CA991777_T1 | 11498 | 663 | 97.3 | glotblastn |
| 5280 | LYD354 canola\|10v1\|CD844283 | 11499 | 663 | 95.0 | globlastp |
| 5281 | LYD354 radish\|gb164\|EV525615 | 11500 | 663 | 95.0 | glotblastn |
| 5282 | LYD354 b_oleracea\|gb161\|EH425328_P1 | 11501 | 663 | 84.9 | globlastp |
| 5283 | LYD354 canola\|10v1\|CD820441 | 11502 | 663 | 84.5 | globlastp |
| 5284 | LYD354 cacao\|10v1\|CU472559_T1 | 11503 | 663 | 80.1 | glotblastn |
| 5285 | LYD355 b_juncea\|10v2\|E6ANDIZ01A60HG_T1 | 11504 | 664 | 99.4 | glotblastn |
| 5286 | LYD355 canola\|10v1\|CX194122 | 11505 | 664 | 99.4 | glotblastn |
| 5287 | LYD355 canola\|11v1\|SRR341921.283862_T1 | 11506 | 664 | 97.4 | glotblastn |
| 5288 | LYD355 nasturtium\|10v1\|SRR032558S0033224 | 11507 | 664 | 86.9 | glotblastn |
| 5289 | LYD355 papaya\|gb165\|EX246985_T1 | 11508 | 664 | 86.9 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5290 | LYD355 clover\|gb162\|BB903247_T1 | 11509 | 664 | 86.3 | glotblastn |
| 5291 | LYD355 medicago\|09v1\|LLAW775404_T1 | 11510 | 664 | 86.3 | glotblastn |
| 5292 | LYD355 tripterygium\|11v1\|SRR098677X106287_T1 | 11511 | 664 | 85.6 | glotblastn |
| 5293 | LYD355 peanut\|10v1\|CD037973_T1 | 11512 | 664 | 85.6 | glotblastn |
| 5294 | LYD355 soybean\|11v1\|GLYMA17G14240 | 11513 | 664 | 85.6 | glotblastn |
| 5295 | LYD355 canola\|11v1\|H07712_T1 | 11514 | 664 | 85.0 | glotblastn |
| 5296 | LYD355 chestnut\|gb170\|SRR006295S0032466_T1 | 11515 | 664 | 85.0 | glotblastn |
| 5297 | LYD355 radish\|gb164\|EV526919 | 11516 | 664 | 85.0 | glotblastn |
| 5298 | LYD355 soybean\|11v1\|GLYMA05G03730 | 11517 | 664 | 85.0 | glotblastn |
| 5299 | LYD355 apple\|11v1\|CN493994_T1 | 11518 | 664 | 84.3 | glotblastn |
| 5300 | LYD355 clementine\|11v1\|CD574793_T1 | 11519 | 664 | 84.3 | glotblastn |
| 5301 | LYD355 euonymus\|11v1\|SRR070038X134724_T1 | 11520 | 664 | 84.3 | glotblastn |
| 5302 | LYD355 tripterygium\|11v1\|SRR098677X110946_T1 | 11521 | 664 | 84.3 | glotblastn |
| 5303 | LYD355 lotus\|09v1\|AV414211_T1 | 11522 | 664 | 84.3 | glotblastn |
| 5304 | LYD355 pigeonpea\|10v1\|GW348054_T1 | 11523 | 664 | 84.3 | glotblastn |
| 5305 | LYD355 orange\|11v1\|CD574793_T1 | 11524 | 664 | 83.7 | glotblastn |
| 5306 | LYD355 b_juncea\|10v2\|E6ANDIZ01AEYJ6_T1 | 11525 | 664 | 83.7 | glotblastn |
| 5307 | LYD355 bean\|gb167\|CB280490_T1 | 11526 | 664 | 83.7 | glotblastn |
| 5308 | LYD355 castorbean\|09v1\|XM002509629 | 11527 | 664 | 83.7 | glotblastn |
| 5309 | LYD355 castorbean\|11v1\|XM002509629_T1 | 11527 | 664 | 83.7 | glotblastn |
| 5310 | LYD355 citrus\|gb166\|CD574793_T1 | 11528 | 664 | 83.7 | glotblastn |
| 5311 | LYD355 oak\|10v1\|CR627875_T1 | 11529 | 664 | 83.7 | glotblastn |
| 5312 | LYD355 strawberry\|11v1\|CX661491 | 11530 | 664 | 83.7 | glotblastn |
| 5313 | LYD355 eucalyptus\|11v2\|ES590957_T1 | 11531 | 664 | 83.0 | glotblastn |
| 5314 | LYD355 cowpea\|gb166\|FC460407_T1 | 11532 | 664 | 83.0 | glotblastn |
| 5315 | LYD355 salvia\|10v1\|CV166630 | 11533 | 664 | 83.0 | glotblastn |
| 5316 | LYD355 cucurbita\|11v1\|SRR091276X100581_T1 | 11534 | 664 | 82.4 | glotblastn |
| 5317 | LYD355 scabiosa\|11v1\|SRR063723X103499_T1 | 11535 | 664 | 82.4 | glotblastn |
| 5318 | LYD355 cassava\|09v1\|DV446891_T1 | 11536 | 664 | 82.4 | glotblastn |
| 5319 | LYD355 rhizophora\|10v1\|SRR005792S0003493 | 11537 | 664 | 82.4 | glotblastn |
| 5320 | LYD355 thellungiella\|gb167\|BQ060370 | 11538 | 664 | 82.4 | glotblastn |
| 5321 | LYD355 walnuts\|gb166\|CV197891 | 11539 | 664 | 82.4 | glotblastn |
| 5322 | LYD355 cannabis\|12v1\|EW701812_T1 | 11540 | 664 | 81.7 | glotblastn |
| 5323 | LYD355 watermelon\|11v1\|AM725626_T1 | 11541 | 664 | 81.7 | glotblastn |
| 5324 | LYD355 cacao\|10v1\|CU497443_T1 | 11542 | 664 | 81.7 | glotblastn |
| 5325 | LYD355 cotton\|10v2\|CO070876_T1 | 11543 | 664 | 81.7 | glotblastn |
| 5326 | LYD355 ipomoea_nil\|10v1\|BJ560048_T1 | 11544 | 664 | 81.7 | glotblastn |
| 5327 | LYD355 melon\|10v1\|AM719013_T1 | 11545 | 664 | 81.7 | glotblastn |
| 5328 | LYD355 radish\|gb164\|EX894871 | 11546 | 664 | 81.7 | globlastp |
| 5329 | LYD355 amsonia\|11v1\|SRR098688X107329_T1 | 11547 | 664 | 81.1 | glotblastn |
| 5330 | LYD355 humulus\|11v1\|SRR098683X102237_T1 | 11548 | 664 | 81.1 | glotblastn |
| 5331 | LYD355 humulus\|11v1\|SRR098683X122889_T1 | 11549 | 664 | 81.1 | glotblastn |
| 5332 | LYD355 tomato\|11v1\|BG643189_T1 | 11550 | 664 | 81.1 | glotblastn |
| 5333 | LYD355 eggplant\|10v1\|FS023952_T1 | 11551 | 664 | 81.1 | glotblastn |
| 5334 | LYD355 lotus\|09v1\|AV408322_T1 | 11552 | 664 | 81.1 | glotblastn |
| 5335 | LYD355 pepper\|gb171\|CA523690_T1 | 11553 | 664 | 81.1 | glotblastn |
| 5336 | LYD355 poplar\|10v1\|AI164083_T1 | 11554 | 664 | 81.1 | glotblastn |
| 5337 | LYD355 prunus\|10v1\|CN493994 | 11555 | 664 | 81.1 | glotblastn |
| 5338 | LYD355 tobacco\|gb162\|EB425265 | 11556 | 664 | 81.1 | glotblastn |
| 5339 | LYD355 tomato\|09v1\|BG643189 | 11550 | 664 | 81.1 | glotblastn |
| 5340 | LYD355 chelidonium\|11v1\|SRR084752X106940_T1 | 11557 | 664 | 80.4 | glotblastn |
| 5341 | LYD355 phyla\|11v2\|SRR099035X106177_T1 | 11558 | 664 | 80.4 | glotblastn |
| 5342 | LYD355 phyla\|11v2\|SRR099037X108839_T1 | 11559 | 664 | 80.4 | glotblastn |
| 5343 | LYD355 cotton\|10v2\|SRR032367S0886821_T1 | 11560 | 664 | 80.4 | glotblastn |
| 5344 | LYD355 heritiera\|10v1\|SRR005794S0008008_T1 | 11561 | 664 | 80.4 | glotblastn |
| 5345 | LYD355 nicotiana_benthamiana\|gb162\|CK283344_T1 | 11562 | 664 | 80.4 | glotblastn |
| 5346 | LYD355 poplar\|10v1\|DT504899_T1 | 11563 | 664 | 80.4 | glotblastn |
| 5347 | LYD355 solanum_phureja\|09v1\|SPHBG643189 | 11564 | 664 | 80.4 | glotblastn |
| 5348 | LYD355 peanut\|10v1\|ES757895_P1 | 11565 | 664 | 80.3 | globlastp |
| 5349 | LYD356 canola\|11v1\|SRR001111.1538_T1 | 11566 | 665 | 100.0 | glotblastn |
| 5350 | LYD356 b_rapa\|gb162\|DN965431_T1 | 11567 | 665 | 100.0 | glotblastn |
| 5351 | LYD356 canola\|10v1\|CD812013 | 11568 | 665 | 100.0 | glotblastn |
| 5352 | LYD356 canola\|11v1\|DW999400_T1 | 11569 | 665 | 99.2 | glotblastn |
| 5353 | LYD356 canola\|10v1\|CD818021 | 11570 | 665 | 99.2 | glotblastn |
| 5354 | LYD356 canola\|11v1\|EE456034_T1 | 11571 | 665 | 99.2 | glotblastn |
| 5355 | LYD356 radish\|gb164\|EV535710 | 11572 | 665 | 99.2 | glotblastn |
| 5356 | LYD356 canola\|11v1\|DY025387_T1 | 11573 | 665 | 98.3 | glotblastn |
| 5357 | LYD356 canola\|11v1\|EV150587_T1 | 11574 | 665 | 98.3 | glotblastn |
| 5358 | LYD356 thellungiella_halophilum\|11v1\|EHJGI11017677_T1 | 11575 | 665 | 98.3 | glotblastn |
| 5359 | LYD356 thellungiella_parvulum\|11v1\|EPCRP024594_T1 | 11576 | 665 | 98.3 | glotblastn |
| 5360 | LYD356 thellungiella_parvulum\|11v1\|EPPRD115900_T1 | 11577 | 665 | 98.3 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5361 | LYD356 canola\|11v1\|SRR019556.38807_T1 | 11578 | 665 | 97.5 | glotblastn |
| 5362 | LYD356 b_oleracea\|gb161\|EH424605_T1 | 11579 | 665 | 97.5 | glotblastn |
| 5363 | LYD356 radish\|gb164\|EY903675 | 11580 | 665 | 97.5 | glotblastn |
| 5364 | LYD356 canola\|11v1\|SRR019556.25802_T1 | 11581 | 665 | 96.6 | glotblastn |
| 5365 | LYD356 b_juncea\|10v2\|BJ1SLX00097842_P1 | 11582 | 665 | 95.8 | globlastp |
| 5366 | LYD356 b_juncea\|10v2\|E6ANDIZ01BKC0G_P1 | 11583 | 665 | 95.8 | globlastp |
| 5367 | LYD356 arabidopsis_lyrata\|09v1\|JGIAL023575_T1 | 11584 | 665 | 94.9 | glotblastn |
| 5368 | LYD356 canola\|10v1\|CD818409 | 11585 | 665 | 94.9 | glotblastn |
| 5369 | LYD356 arabidopsis\|10v1\|AT4G02720_T1 | 11586 | 665 | 94.1 | glotblastn |
| 5370 | LYD356 plantago\|11v1\|SRR066373X303297_T1 | 11587 | 665 | 87.4 | glotblastn |
| 5371 | LYD356 oak\|10v1\|FN699035_T1 | 11588 | 665 | 87.4 | glotblastn |
| 5372 | LYD356 oak\|10v1\|SRR006309S0035632_T1 | 11589 | 665 | 87.4 | glotblastn |
| 5373 | LYD356 aquilegia\|10v2\|DR942514_T1 | 11590 | 665 | 87.3 | glotblastn |
| 5374 | LYD356 ceratodon\|10v1\|SRR074890S0163110_T1 | 11591 | 665 | 87.3 | glotblastn |
| 5375 | LYD356 papaya\|gb165\|EX266455_T1 | 11592 | 665 | 87.3 | glotblastn |
| 5376 | LYD356 oak\|10v1\|SRR006313S0030771_T1 | 11593 | 665 | 86.6 | glotblastn |
| 5377 | LYD356 arnica\|11v1\|SRR099034X101611_T1 | 11594 | 665 | 86.4 | glotblastn |
| 5378 | LYD356 euonymus\|11v1\|SRR070038X111481_T1 | 11595 | 665 | 86.4 | glotblastn |
| 5379 | LYD356 flaveria\|11v1\|SRR149229.117955_T1 | 11596 | 665 | 86.4 | glotblastn |
| 5380 | LYD356 flax\|11v1\|JG265449_T1 | 11597 | 665 | 86.4 | glotblastn |
| 5381 | LYD356 maritime_pine\|10v1\|SRR073317S0007921_T1 | 11598 | 665 | 86.4 | glotblastn |
| 5382 | LYD356 tripterygium\|11v1\|SRR098677X12073_T1 | 11599 | 665 | 86.4 | glotblastn |
| 5383 | LYD356 artemisia\|10v1\|SRR019254S0004070_T1 | 11600 | 665 | 86.4 | glotblastn |
| 5384 | LYD356 gnetum\|10v1\|SRR064399S0013098_T1 | 11601 | 665 | 86.4 | glotblastn |
| 5385 | LYD356 lettuce\|10v1\|BQ851656_T1 | 11602 | 665 | 86.4 | glotblastn |
| 5386 | LYD356 physcomitrella\|10v1\|BQ826614_T1 | 11603 | 665 | 86.4 | glotblastn |
| 5387 | LYD356 pine\|10v2\|BQ698784_T1 | 11604 | 665 | 86.4 | glotblastn |
| 5388 | LYD356 poplar\|10v1\|BI138171_T1 | 11605 | 665 | 86.4 | glotblastn |
| 5389 | LYD356 poplar\|10v1\|CV245819_T1 | 11606 | 665 | 86.4 | glotblastn |
| 5390 | LYD356 spikemoss\|gb165\|FE429548 | 11607 | 665 | 86.4 | glotblastn |
| 5391 | LYD356 sunflower\|10v1\|EE612000 | 11608 | 665 | 86.4 | glotblastn |
| 5392 | LYD356 ambrosia\|11v1\|SRR346935.119259_T1 | 11609 | 665 | 85.6 | glotblastn |
| 5393 | LYD356 cirsium\|11v1\|SRR346952.1012579_T1 | 11610 | 665 | 85.6 | glotblastn |
| 5394 | LYD356 clementine\|11v1\|CK937619_T1 | 11611 | 665 | 85.6 | glotblastn |
| 5395 | LYD356 euphorbia\|11v1\|DV124777_T1 | 11612 | 665 | 85.6 | glotblastn |
| 5396 | LYD356 euphorbia\|11v1\|SRR098678X107912_T1 | 11613 | 665 | 85.6 | glotblastn |
| 5397 | LYD356 fagopyrum\|11v1\|SRR063703X142561_T1 | 11614 | 665 | 85.6 | glotblastn |
| 5398 | LYD356 orange\|11v1\|CK937619_T1 | 11615 | 665 | 85.6 | glotblastn |
| 5399 | LYD356 primula\|11v1\|SRR098679X28143_T1 | 11616 | 665 | 85.6 | glotblastn |
| 5400 | LYD356 trigonella\|11v1\|SRR066194X109214_T1 | 11617 | 665 | 85.6 | glotblastn |
| 5401 | LYD356 cacao\|10v1\|CU482446_T1 | 11618 | 665 | 85.6 | glotblastn |
| 5402 | LYD356 citrus\|gb166\|CX072860_T1 | 11619 | 665 | 85.6 | glotblastn |
| 5403 | LYD356 cotton\|10v2\|ES840642_T1 | 11620 | 665 | 85.6 | glotblastn |
| 5404 | LYD356 cotton\|10v2\|SRR032367S0033019_T1 | 11621 | 665 | 85.6 | glotblastn |
| 5405 | LYD356 kiwi\|gb166\|FG432036_T1 | 11622 | 665 | 85.6 | glotblastn |
| 5406 | LYD356 nasturtium\|10v1\|SRR032561S0028000 | 11623 | 665 | 85.6 | glotblastn |
| 5407 | LYD356 peanut\|10v1\|ES719543_T1 | 11624 | 665 | 85.6 | glotblastn |
| 5408 | LYD356 pigeonpea\|10v1\|SRR054580S0028503_T1 | 11625 | 665 | 85.6 | glotblastn |
| 5409 | LYD356 senecio\|gb170\|SRR006592S0015752 | 11626 | 665 | 85.6 | glotblastn |
| 5410 | LYD356 soybean\|11v1\|GLYMA02G16550 | 11627 | 665 | 85.6 | glotblastn |
| 5411 | LYD356 soybean\|11v1\|GLYMA10G03290 | 11628 | 665 | 85.6 | glotblastn |
| 5412 | LYD356 spruce\|gb162\|DV973304 | 11629 | 665 | 85.6 | glotblastn |
| 5413 | LYD356 spurge\|gb161\|DV124777 | 11630 | 665 | 85.6 | glotblastn |
| 5414 | LYD356 triphysaria\|10v1\|DR175417 | 11631 | 665 | 85.6 | glotblastn |
| 5415 | LYD356 scabiosa\|11v1\|SRR063723X11768_P1 | 11632 | 665 | 85.0 | globlastp |
| 5416 | LYD356 abies\|11v2\|SRR098676X135794XX1_T1 | 11633 | 665 | 84.8 | glotblastn |
| 5417 | LYD356 amsonia\|11v1\|SRR098688X122456_T1 | 11634 | 665 | 84.8 | glotblastn |
| 5418 | LYD356 chelidonium\|11v1\|SRR084752X104418_T1 | 11635 | 665 | 84.8 | glotblastn |
| 5419 | LYD356 utricularia\|11v1\|SRR094438.105857_T1 | 11636 | 665 | 84.8 | glotblastn |
| 5420 | LYD356 vinca\|11v1\|SRR098690X105973_T1 | 11637 | 665 | 84.8 | glotblastn |
| 5421 | LYD356 cassava\|09v1\|FF379873_T1 | 11638 | 665 | 84.8 | glotblastn |
| 5422 | LYD356 castorbean\|09v1\|EG677265 | 11639 | 665 | 84.8 | glotblastn |
| 5423 | LYD356 castorbean\|11v1\|EG677265_T1 | 11639 | 665 | 84.8 | glotblastn |
| 5424 | LYD356 coffea\|10v1\|DV681549_t1 | 11640 | 665 | 84.8 | glotblastn |
| 5425 | LYD356 medicago\|09v1\|AW686788_T1 | 11641 | 665 | 84.8 | glotblastn |
| 5426 | LYD356 monkeyflower\|10v1\|GO985950_T1 | 11642 | 665 | 84.8 | glotblastn |
| 5427 | LYD356 orobanche\|10v1\|SRR023189S0000451_T1 | 11643 | 665 | 84.8 | glotblastn |
| 5428 | LYD356 sciadopitys\|10v1\|SRR065035S0013795 | 11644 | 665 | 84.8 | glotblastn |
| 5429 | LYD356 spruce\|gb162\|CO237788 | 11645 | 665 | 84.8 | glotblastn |
| 5430 | LYD356 taxus\|10v1\|SRR032523S0002704XX1 | 11646 | 665 | 84.8 | glotblastn |
| 5431 | LYD356 tobacco\|gb162\|EB424813 | 11647 | 665 | 84.8 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5432 | LYD356 cedrus\|11v1\|SRR065007X136942_P1 | 11648 | 665 | 84.2 | globlastp |
| 5433 | LYD356 apple\|11v1\|CN945493_T1 | 11649 | 665 | 83.9 | glotblastn |
| 5434 | LYD356 cephalotaxus\|11v1\|SRR064395X163987_T1 | 11650 | 665 | 83.9 | glotblastn |
| 5435 | LYD356 distylium\|11v1\|SRR065077X117387_T1 | 11651 | 665 | 83.9 | glotblastn |
| 5436 | LYD356 phyla\|11v2\|SRR099035X124185_T1 | 11652 | 665 | 83.9 | glotblastn |
| 5437 | LYD356 pteridium\|11v1\|SRR043594X101190_T1 | 11653 | 665 | 83.9 | glotblastn |
| 5438 | LYD356 tomato\|11v1\|BG133792_T1 | 11654 | 665 | 83.9 | glotblastn |
| 5439 | LYD356 aristolochia\|10v1\|FD757103_T1 | 11655 | 665 | 83.9 | glotblastn |
| 5440 | LYD356 cichorium\|gb171\|EH703772_T1 | 11656 | 665 | 83.9 | glotblastn |
| 5441 | LYD356 fescue\|gb161\|CK801362_P1 | 11657 | 665 | 83.9 | globlastp |
| 5442 | LYD356 nicotiana_benthamiana\|gb162\|CK280501_T1 | 11658 | 665 | 83.9 | glotblastn |
| 5443 | LYD356 potato\|10v1\|BE923917_T1 | 11659 | 665 | 83.9 | glotblastn |
| 5444 | LYD356 pseudotsuga\|10v1\|SRR065119S0024802 | 11660 | 665 | 83.9 | glotblastn |
| 5445 | LYD356 triphysaria\|10v1\|EY156207 | 11661 | 665 | 83.9 | glotblastn |
| 5446 | LYD356 walnuts\|gb166\|EL891945 | 11662 | 665 | 83.9 | glotblastn |
| 5447 | LYD356 wheat\|10v2\|AL818846 | 11663 | 665 | 83.9 | glotblastn |
| 5448 | LYD356 apple\|11v1\|CN490746_T1 | 11664 | 665 | 83.5 | glotblastn |
| 5449 | LYD356 b_juncea\|10v2\|BJ1SLX00231994D1_P1 | 11665 | 665 | 83.1 | globlastp |
| 5450 | LYD356 amorphophallus\|11v2\|SRR089351X228262_T1 | 11666 | 665 | 83.1 | glotblastn |
| 5451 | LYD356 eucalyptus\|11v2\|SRR001659X162636_T1 | 11667 | 665 | 83.1 | glotblastn |
| 5452 | LYD356 phalaenopsis\|11v1\|SRR125771.1032743_T1 | 11668 | 665 | 83.1 | glotblastn |
| 5453 | LYD356 silene\|11v1\|SRR096785X148365_T1 | 11669 | 665 | 83.1 | glotblastn |
| 5454 | LYD356 sorghum\|11v1\|SBPRD033244_T1 | 11670 | 665 | 83.1 | glotblastn |
| 5455 | LYD356 tabernaemontana\|11v1\|SRR098689X102369_T1 | 11671 | 665 | 83.1 | glotblastn |
| 5456 | LYD356 valeriana\|11v1\|SRR099039X131482_T1 | 11672 | 665 | 83.1 | glotblastn |
| 5457 | LYD356 barley\|10v2\|BG343265_T1 | 11673 | 665 | 83.1 | glotblastn |
| 5458 | LYD356 brachypodium\|09v1\|DV478575_T1 | 11674 | 665 | 83.1 | glotblastn |
| 5459 | LYD356 cucumber\|09v1\|GD177374_T1 | 11675 | 665 | 83.1 | glotblastn |
| 5460 | LYD356 eggplant\|10v1\|FS001151_T1 | 11676 | 665 | 83.1 | glotblastn |
| 5461 | LYD356 grape\|11v1\|GSVIVT01001165001_T1 | 11677 | 665 | 83.1 | glotblastn |
| 5462 | LYD356 grape\|gb160\|CB346996 | 11678 | 665 | 83.1 | glotblastn |
| 5463 | LYD356 maize\|10v1\|AI861652_T1 | 11679 | 665 | 83.1 | glotblastn |
| 5464 | LYD356 oat\|11v1\|GR337037_T1 | 11680 | 665 | 83.1 | glotblastn |
| 5465 | LYD356 oil_palm\|gb166\|CN600839_T1 | 11681 | 665 | 83.1 | glotblastn |
| 5466 | LYD356 podocarpus\|10v1\|SRR065014S0003833_T1 | 11682 | 665 | 83.1 | glotblastn |
| 5467 | LYD356 prunus\|10v1\|AJ533094 | 11683 | 665 | 83.1 | glotblastn |
| 5468 | LYD356 pseudoroegneria\|gb167\|FF364837 | 11684 | 665 | 83.1 | glotblastn |
| 5469 | LYD356 sequoia\|10v1\|SRR065044S0066945XX2 | 11685 | 665 | 83.1 | glotblastn |
| 5470 | LYD356 sorghum\|09v1\|SB02G026540 | 11686 | 665 | 83.1 | glotblastn |
| 5471 | LYD356 sorghum\|11v1\|SB02G026540_T1 | 11687 | 665 | 83.1 | glotblastn |
| 5472 | LYD356 strawberry\|11v1\|DY674471 | 11688 | 665 | 83.1 | glotblastn |
| 5473 | LYD356 eucalyptus\|11v2\|ES595924_T1 | 11689 | 665 | 83.1 | glotblastn |
| 5474 | LYD356 salvia\|10v1\|FE536257 | 11690 | 665 | 82.4 | glotblastn |
| 5475 | LYD356 zostera\|10v1\|SRR057351S0011707 | 11691 | 665 | 82.4 | glotblastn |
| 5476 | LYD356 pseudotsuga\|10v1\|SRR065119S0186570 | 11692 | 665 | 82.2 | glotblastn |
| 5477 | LYD356 rice\|gb170\|OS09G28220 | 11693 | 665 | 82.2 | glotblastn |
| 5478 | LYD356 sugarcane\|10v1\|CA085363 | 11694 | 665 | 82.2 | glotblastn |
| 5479 | LYD356 switchgrass\|gb167\|DN145224 | 11695 | 665 | 82.2 | glotblastn |
| 5480 | LYD356 ipomoea_batatas\|10v1\|EE876122_T1 | 11696 | 665 | 81.8 | glotblastn |
| 5481 | LYD356 sarracenia\|11v1\|SRR192671.163689_T1 | 11697 | 665 | 81.4 | glotblastn |
| 5482 | LYD356 foxtail_millet\|10v2\|FXTRMSLX00755129D2 | 11698 | 665 | 81.4 | glotblastn |
| 5483 | LYD356 foxtail_millet\|11v3\|PHY7SI029571M_T1 | 11699 | 665 | 81.4 | glotblastn |
| 5484 | LYD356 melon\|10v1\|VMEL00523006693402_T1 | 11700 | 665 | 81.4 | glotblastn |
| 5485 | LYD356 millet\|10v1\|EVO454PM016880_T1 | 11701 | 665 | 81.4 | glotblastn |
| 5486 | LYD356 catharanthus\|11v1\|SRR098691X116776_P1 | 11702 | 665 | 80.7 | globlastp |
| 5487 | LYD356 eucalyptus\|gb166\|ES595924 | 11703 | 665 | 80.7 | globlastp |
| 5488 | LYD356 marchantia\|gb166\|BJ864302_P1 | 11704 | 665 | 80.2 | globlastp |
| 5489 | LYD357 b_rapa\|gb162\|EX023270_T1 | 11705 | 666 | 86.9 | glotblastn |
| 5490 | LYD357 canola\|11v1\|SRR001112.17151_T1 | 11706 | 666 | 83.7 | glotblastn |
| 5491 | LYD357 canola\|10v1\|EE462485 | 11707 | 666 | 80.2 | glotblastn |
| 5492 | LYD358 b_rapa\|gb162\|CX270280_T1 | 11708 | 667 | 99.0 | glotblastn |
| 5493 | LYD358 canola\|11v1\|EE400666_T1 | 11709 | 667 | 98.5 | glotblastn |
| 5494 | LYD358 b_juncea\|10v2\|E6ANDIZ01A7E3I_P1 | 11710 | 667 | 89.9 | globlastp |
| 5495 | LYD358 amsonia\|11v1\|SRR098688X143078_T1 | 11711 | 667 | 83.7 | glotblastn |
| 5496 | LYD358 silene\|11v1\|SRR096785X126876_T1 | 11712 | 667 | 83.7 | glotblastn |
| 5497 | LYD358 spurge\|gb161\|DV126456 | 11713 | 667 | 83.7 | glotblastn |
| 5498 | LYD358 eggplant\|10v1\|FS004361_P1 | 11714 | 667 | 83.2 | globlastp |
| 5499 | LYD358 radish\|gb164\|EX773740 | 11715 | 667 | 83.2 | globlastp |
| 5500 | LYD358 catharanthus\|11v1\|SRR098691X103621_T1 | 11716 | 667 | 82.7 | glotblastn |
| 5501 | LYD358 cleome_spinosa\|10v1\|SRR015531S0037218_T1 | 11717 | 667 | 82.7 | glotblastn |
| 5502 | LYD358 petunia\|gb171\|FN003690_T1 | 11718 | 667 | 82.7 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5503 | LYD358 vinca\|11v1\|SRR098690X104484_T1 | 11719 | 667 | 82.1 | glotblastn |
| 5504 | LYD358 valeriana\|11v1\|SRR099039X105133_T1 | 11720 | 667 | 81.6 | glotblastn |
| 5505 | LYD358 cirsium\|11v1\|SRR346952.1031342_T1 | 11721 | 667 | 81.1 | glotblastn |
| 5506 | LYD358 flax\|11v1\|EH792492_T1 | 11722 | 667 | 81.1 | glotblastn |
| 5507 | LYD358 blueberry\|10v1\|CV091378_T1 | 11723 | 667 | 81.1 | glotblastn |
| 5508 | LYD358 thalictrum\|11v1\|SRR096787X124040_T1 | 11724 | 667 | 80.6 | glotblastn |
| 5509 | LYD358 bean\|gb167\|CA907763_T1 | 11725 | 667 | 80.6 | glotblastn |
| 5510 | LYD358 cucurbita\|11v1\|SRR091276X217402_T1 | 11726 | 667 | 80.1 | glotblastn |
| 5511 | LYD358 flaveria\|11v1\|SRR149229.165184_T1 | 11727 | 667 | 80.1 | glotblastn |
| 5512 | LYD358 phyla\|11v2\|SRR099035X110496_T1 | 11728 | 667 | 80.1 | glotblastn |
| 5513 | LYD358 phyla\|11v2\|SRR099037X306550_T1 | 11729 | 667 | 80.1 | glotblastn |
| 5514 | LYD358 silene\|11v1\|SRR096785X372550_T1 | 11730 | 667 | 80.1 | glotblastn |
| 5515 | LYD358 cassava\|09v1\|JGICASSAVA1573VALIDM1_T1 | 11731 | 667 | 80.1 | glotblastn |
| 5516 | LYD359 canola\|11v1\|EE490176_T1 | 11732 | 668 | 100.0 | glotblastn |
| 5517 | LYD359 radish\|gb164\|EX899697 | 11733 | 668 | 98.5 | glotblastn |
| 5518 | LYD359 canola\|11v1\|DY000280_T1 | 11734 | 668 | 97.7 | glotblastn |
| 5519 | LYD359 b_juncea\|10v2\|E6ANDIZ01AG58J_T1 | 11735 | 668 | 97.7 | glotblastn |
| 5520 | LYD359 b_juncea\|10v2\|E6ANDIZ01AKCG22_T1 | 11736 | 668 | 97.7 | glotblastn |
| 5521 | LYD359 radish\|gb164\|EV566067 | 11737 | 668 | 97.7 | glotblastn |
| 5522 | LYD359 canola\|11v1\|EE503198_T1 | 11738 | 668 | 97.0 | glotblastn |
| 5523 | LYD359 thellungiella\|gb167\|DN776586 | 11739 | 668 | 94.7 | glotblastn |
| 5524 | LYD359 thellungiella_halophilum\|11v1\|DN776586_T1 | 11740 | 668 | 91.9 | glotblastn |
| 5525 | LYD359 b_juncea\|10v2\|BJ1SLX00658980D1_T1 | 11741 | 668 | 84.9 | glotblastn |
| 5526 | LYD359 canola\|11v1\|DY011839_T1 | 11742 | 668 | 84.1 | glotblastn |
| 5527 | LYD359 thellungiella_halophilum\|11v1\|EHJGI11003533_T1 | 11743 | 668 | 84.1 | glotblastn |
| 5528 | LYD359 nicotiana_benthamiana\|gb162\|CK289869_T1 | 11744 | 668 | 84.1 | glotblastn |
| 5529 | LYD359 cleome_spinosa\|10v1\|SRR015531S0018777_P1 | 11745 | 668 | 83.6 | globlastp |
| 5530 | LYD359 canola\|11v1\|EV103857_T1 | — | 668 | 83.5 | glotblastn |
| 5531 | LYD359 potato\|10v1\|BQ112923_T1 | 11746 | 668 | 83.3 | glotblastn |
| 5532 | LYD359 flaveria\|11v1\|SRR149244.142571_T1 | 11747 | 668 | 82.6 | glotblastn |
| 5533 | LYD359 cucurbita\|11v1\|SRR091276X112867_T1 | 11748 | 668 | 81.8 | glotblastn |
| 5534 | LYD359 flax\|11v1\|FJ667606_T1 | 11749 | 668 | 81.8 | glotblastn |
| 5535 | LYD359 pteridium\|11v1\|SRR043594X114111_T1 | 11750 | 668 | 81.8 | glotblastn |
| 5536 | LYD359 cucumber\|09v1\|DN909508_T1 | 11751 | 668 | 81.8 | glotblastn |
| 5537 | LYD359 switchgrass\|gb167\|DN142539 | 11752 | 668 | 81.8 | glotblastn |
| 5538 | LYD359 euonymus\|11v1\|SRR070038X213353_T1 | 11753 | 668 | 81.1 | glotblastn |
| 5539 | LYD359 flaveria\|11v1\|SRR149229.118245_T1 | 11754 | 668 | 81.1 | glotblastn |
| 5540 | LYD359 olea\|11v1\|SRR014463.29907_T1 | 11755 | 668 | 81.1 | glotblastn |
| 5541 | LYD359 tripterygium\|11v1\|SRR098677X104686_T1 | 11756 | 668 | 81.1 | glotblastn |
| 5542 | LYD359 arabidopsis\|10v1\|AT3G21500_T1 | 11757 | 668 | 81.1 | glotblastn |
| 5543 | LYD359 curcuma\|10v1\|DY392061_T1 | 11758 | 668 | 81.1 | glotblastn |
| 5544 | LYD359 ipomoea_batatas\|10v1\|DC879850_T1 | 11759 | 668 | 81.1 | glotblastn |
| 5545 | LYD359 millet\|10v1\|PMSLX0021194D1_T1 | 11760 | 668 | 81.1 | glotblastn |
| 5546 | LYD359 peanut\|10v1\|GO334821_T1 | 11761 | 668 | 81.1 | glotblastn |
| 5547 | LYD359 tragopogon\|10v1\|SRR020205S0037443 | 11762 | 668 | 81.1 | glotblastn |
| 5548 | LYD359 ambrosia\|11v1\|SRR346935.191232_T1 | 11763 | 668 | 80.3 | glotblastn |
| 5549 | LYD359 cirsium\|11v1\|SRR349641.58535_T1 | 11764 | 668 | 80.3 | glotblastn |
| 5550 | LYD359 fagopyrum\|11v1\|SRR063689X121326_T1 | 11765 | 668 | 80.3 | glotblastn |
| 5551 | LYD359 fraxinus\|11v1\|SRR058827.101300_T1 | 11766 | 668 | 80.3 | glotblastn |
| 5552 | LYD359 pea\|11v1\|AM161923_T1 | 11767 | 668 | 80.3 | glotblastn |
| 5553 | LYD359 trigonella\|11v1\|SRR066194X133520_T1 | 11768 | 668 | 80.3 | glotblastn |
| 5554 | LYD359 watermelon\|11v1\|VMEL00331737993893_T1 | 11769 | 668 | 80.3 | glotblastn |
| 5555 | LYD359 artemisia\|10v1\|EY110588_T1 | 11770 | 668 | 80.3 | glotblastn |
| 5556 | LYD359 chestnut\|gb170\|SRR006296S0001908_T1 | 11771 | 668 | 80.3 | glotblastn |
| 5557 | LYD359 cynodon\|10v1\|ES299726_T1 | 11772 | 668 | 80.3 | glotblastn |
| 5558 | LYD359 iceplant\|gb164\|BE036942_T1 | 11773 | 668 | 80.3 | glotblastn |
| 5559 | LYD359 lotus\|09v1\|AV779383_T1 | 11774 | 668 | 80.3 | glotblastn |
| 5560 | LYD359 lotus\|09v1\|LLAV779383_T1 | 11774 | 668 | 80.3 | glotblastn |
| 5561 | LYD359 peanut\|10v1\|GO328545_T1 | 11775 | 668 | 80.3 | glotblastn |
| 5562 | LYD359 pigeonpea\|10v2\|SSR054580S0195525_T1 | 11776 | 668 | 80.3 | glotblastn |
| 5563 | LYD359 sugarcane\|10v1\|CA112682 | 11777 | 668 | 80.3 | glotblastn |
| 5564 | LYD360 canola\|11v1\|SRR019556.17100_T1 | 11778 | 669 | 99.3 | glotblastn |
| 5565 | LYD360 canola\|10v1\|DW998552 | 11779 | 669 | 99.3 | glotblastn |
| 5566 | LYD360 canola\|11v1\|DW998552_T! | 11780 | 669 | 99.3 | glotblastn |
| 5567 | LYD360 canola\|11v1\|SRR019558.5477_T1 | 11781 | 669 | 98.5 | glotblastn |
| 5568 | LYD360 b_juncea\|10v2\|E6ANDIZ01A00BR_T1 | 11782 | 669 | 98.5 | glotblastn |
| 5569 | LYD360 b_juncea\|10v2\|E6ANDIZ01BQ44X_T1 | 11783 | 669 | 98.5 | glotblastn |
| 5570 | LYD360 b_rapa\|gb162\|AY460108_T1 | 11784 | 669 | 98.5 | glotblastn |
| 5571 | LYD360 canola\|10v1\|CD832066 | 11785 | 669 | 98.5 | glotblastn |
| 5572 | LYD360 canola\|10v1\|CD833090 | 11786 | 669 | 98.5 | glotblastn |
| 5573 | LYD360 canola\|10v1\|EE457660 | 11787 | 669 | 98.5 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5574 | LYD360 radish\|gb164\|EV542093 | 11788 | 669 | 98.5 | glotblastn |
| 5575 | LYD360 b_rapa\|gb162\|CO749825_T1 | 11789 | 669 | 97.8 | glotblastn |
| 5576 | LYD360 b_oleracea\|gb161\|AM387742_T1 | 11790 | 669 | 97.8 | glotblastn |
| 5577 | LYD360 canola\|10v1\|CN731858 | 11791 | 669 | 97.8 | glotblastn |
| 5578 | LYD360 canola\|11v1\|CN731858_T1 | 11792 | 669 | 97.8 | glotblastn |
| 5579 | LYD360 radish\|gb164\|EV565876 | 11793 | 669 | 97.8 | glotblastn |
| 5580 | LYD360 thellungiella\|gb167\|DN773350 | 11794 | 669 | 97.8 | glotblastn |
| 5581 | LYD360 canola\|11v1\|SRR023612.19864_T1 | 11795 | 669 | 97.0 | glotblastn |
| 5582 | LYD360 canola\|11v1\|SRR329661.576405_T1 | 11796 | 669 | 95.6 | glotblastn |
| 5583 | LYD360 thellungiella_halophilum\|11v1\|EHPRD122952_T1 | 11797 | 669 | 94.9 | glotblastn |
| 5584 | LYD360 b_juncea\|10v2\|E6ANDIZ01AY40X_P1 | 11798 | 669 | 91.9 | globlastp |
| 5585 | LYD360 b_juncea\|10v2\|E6ANDIZ01AXYLC_P1 | 11799 | 669 | 91.8 | globlastp |
| 5586 | LYD360 primula\|11v1\|SRR098679X115772_T1 | 11800 | 669 | 88.1 | glotblastn |
| 5587 | LYD360 thalictrum\|11v1\|SRR096787X110948_T1 | 11801 | 669 | 88.1 | glotblastn |
| 5588 | LYD360 cleome_gynandra\|10v1\|SRR015532S0011508_T1 | 11802 | 669 | 87.3 | glotblastn |
| 5589 | LYD360 scabiosa\|11v1\|SRR063723X105289_T1 | 11803 | 669 | 86.7 | glotblastn |
| 5590 | LYD360 amaranthus\|10v1\|SRR039411S0001326_T1 | 11804 | 669 | 86.7 | glotblastn |
| 5591 | LYD360 amaranthus\|10v1\|SRR039411S0006123_T1 | 11805 | 669 | 86.7 | glotblastn |
| 5592 | LYD360 cleome_gynandra\|10v1\|SRR015532S0030501_T1 | 11806 | 669 | 86.7 | glotblastn |
| 5593 | LYD360 euphorbia\|11v1\|DV115557_T1 | 11807 | 669 | 86.6 | glotblastn |
| 5594 | LYD360 spurge\|gb161\|DV115557 | 11808 | 669 | 85.8 | glotblastn |
| 5595 | LYD360 thellungiella\|gb167\|DN776690 | 11809 | 669 | 85.4 | glotblastn |
| 5596 | LYD360 cleome_spinosa\|10v1\|GR934996_T1 | 11810 | 669 | 85.2 | glotblastn |
| 5597 | LYD360 kiwi\|gb166\|FG397670_T1 | 11811 | 669 | 85.2 | glotblastn |
| 5598 | LYD360 oak\|10v1\|FP032824_T1 | 11812 | 669 | 85.1 | glotblastn |
| 5599 | LYD360 apple\|11v1\|CN444746_T1 | 11813 | 669 | 85.1 | glotblastn |
| 5600 | LYD360 canola\|10v1\|CD812899 | 11814 | 669 | 84.7 | glotblastn |
| 5601 | LYD360 canola\|11v1\|DY020776_T1 | 11815 | 669 | 84.7 | glotblastn |
| 5602 | LYD360 fagopyrum\|11v1\|SRR063689X100984_T1 | 11816 | 669 | 84.4 | glotblastn |
| 5603 | LYD360 primula\|11v1\|SRR098679X106813_T1 | 11817 | 669 | 84.4 | glotblastn |
| 5604 | LYD360 sarracenia\|11v1\|SRR192669.115218_T1 | 11818 | 669 | 84.4 | glotblastn |
| 5605 | LYD360 medicago\|09v1\|AW126260_T1 | 11819 | 669 | 84.4 | glotblastn |
| 5606 | LYD360 momordica\|10v1\|SRR071315S0024912_T1 | 11820 | 669 | 84.4 | glotblastn |
| 5607 | LYD360 oat\|10v2\|GR363558 | 11821 | 669 | 84.4 | glotblastn |
| 5608 | LYD360 oat\|11v1\|GR363558_T1 | 11821 | 669 | 84.4 | glotblastn |
| 5609 | LYD360 petunia\|gb171\|CV300069_T1 | 11822 | 669 | 84.4 | glotblastn |
| 5610 | LYD360 ambrosia\|11v1\|SRR346935.410448_T1 | 11823 | 669 | 84.3 | glotblastn |
| 5611 | LYD360 cucurbita\|11v1\|SRR091276X108228_T1 | 11824 | 669 | 84.3 | glotblastn |
| 5612 | LYD360 apple\|gb171\|CN444746 | 11825 | 669 | 84.3 | glotblastn |
| 5613 | LYD360 potato\|10v1\|BE921232_T1 | 11826 | 669 | 84.3 | glotblastn |
| 5614 | LYD360 potato\|10v1\|BQ113327_T1 | 11827 | 669 | 84.3 | glotblastn |
| 5615 | LYD360 sunflower\|10v1\|CX945348 | 11828 | 669 | 84.3 | glotblastn |
| 5616 | LYD360 zinnia\|gb171\|AU301937 | 11829 | 669 | 84.3 | glotblastn |
| 5617 | LYD360 b_rapa\|gb162\|EE516329_P1 | 11830 | 669 | 84.3 | globlastp |
| 5618 | LYD360 b_oleracea\|gb161\|AM388348_T1 | 11831 | 669 | 83.9 | glotblastn |
| 5619 | LYD360 canola\|10v1\|EE435089 | 11832 | 669 | 83.9 | glotblastn |
| 5620 | LYD360 cichorium\|gb171\|FL672715_T1 | 11833 | 669 | 83.7 | glotblastn |
| 5621 | LYD360 ipomoea_nil\|10v1\|CJ771651_T1 | 11834 | 669 | 83.7 | glotblastn |
| 5622 | LYD360 leymus\|gb166\|EG397819_T1 | 11835 | 669 | 83.7 | glotblastn |
| 5623 | LYD360 pseudoroegneria\|gb167\|FF350425 | 11836 | 669 | 83.7 | glotblastn |
| 5624 | LYD360 wheat\|10v2\|BE492877 | 11837 | 669 | 83.7 | glotblastn |
| 5625 | LYD360 cucurbita\|11v1\|SRR091276X118724_T1 | 11838 | 669 | 83.6 | glotblastn |
| 5626 | LYD360 cucurbita\|11v1\|SRR091276X127327_T1 | 11839 | 669 | 83.6 | glotblastn |
| 5627 | LYD360 cucurbita\|11v1\|SRR091276X176316_T1 | 11840 | 669 | 83.6 | glotblastn |
| 5628 | LYD360 apple\|gb171\|CN495646 | 11841 | 669 | 83.6 | glotblastn |
| 5629 | LYD360 oat\|11v1\|GR353893_T1 | 11842 | 669 | 83.6 | glotblastn |
| 5630 | LYD360 walnuts\|gb166\|CV194988 | 11843 | 669 | 83.6 | glotblastn |
| 5631 | LYD360 citrus\|gb166\|CV886939_T1 | 11844 | 669 | 83.0 | glotblastn |
| 5632 | LYD360 eucalyptus\|gb166\|CT983802 | 11845 | 669 | 83.0 | glotblastn |
| 5633 | LYD360 onion\|gb162\|CF437571_T1 | 11846 | 669 | 83.0 | glotblastn |
| 5634 | LYD360 tragopogon\|10v1\|SRR020205S0094843 | 11847 | 669 | 83.0 | glotblastn |
| 5635 | LYD360 wheat\|10v2\|BE428826 | 11848 | 669 | 83.0 | glotblastn |
| 5636 | LYD360 wheat\|10v2\|BG262758 | 11849 | 669 | 83.0 | glotblastn |
| 5637 | LYD360 fagopyrum\|11v1\|SRR063689X123297_T1 | 11850 | 669 | 82.8 | glotblastn |
| 5638 | LYD360 platanus\|11v1\|SRR096786X133734_T1 | 11851 | 669 | 82.8 | glotblastn |
| 5639 | LYD360 banana\|10v1\|FF558854_T1 | 11852 | 669 | 82.8 | glotblastn |
| 5640 | LYD360 iceplant\|gb164\|BE577569_T1 | 11853 | 669 | 82.8 | glotblastn |
| 5641 | LYD360 melon\|10v1\|AM718298_T1 | 11854 | 669 | 82.8 | glotblastn |
| 5642 | LYD360 potato\|10v1\|BG595277_T1 | 11855 | 669 | 82.8 | glotblastn |
| 5643 | LYD360 salvia\|10v1\|FE537079 | 11856 | 669 | 82.8 | glotblastn |
| 5644 | LYD360 phalaenopsis\|11v1\|SRR125771.1130054_T1 | 11857 | 669 | 82.4 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5645 | LYD360 pteridium\|11v1\|GW574872_T1 | 11858 | 669 | 82.2 | glotblastn |
| 5646 | LYD360 clover\|gb162\|BB903915_T1 | 11859 | 669 | 82.2 | glotblastn |
| 5647 | LYD360 coffea\|10v1\|DV663605_T1 | 11860 | 669 | 82.2 | glotblastn |
| 5648 | LYD360 papaya\|gb165\|EX288092_T1 | 11861 | 669 | 82.2 | glotblastn |
| 5649 | LYD360 peanut\|10v1\|SRR042413S0023193_T1 | 11862 | 669 | 82.2 | glotblastn |
| 5650 | LYD360 flax\|11v1\|EB710725_T1 | 11863 | 669 | 82.1 | glotblastn |
| 5651 | LYD360 phyla\|11v2\|SRR099035X111169_T1 | 11864 | 669 | 82.1 | glotblastn |
| 5652 | LYD360 oil_palm\|gb166\|EL684407_T1 | 11865 | 669 | 82.1 | glotblastn |
| 5653 | LYD360 pigeonpea\|10v1\|SSR054580S0020654_T1 | 11866 | 669 | 81.8 | glotblastn |
| 5654 | LYD360 pepper\|gb171\|GD077370_P1 | 11867 | 669 | 81.5 | globlastp |
| 5655 | LYD360 flax\|11v1\|JG123126_T1 | 11868 | 669 | 81.5 | glotblastn |
| 5656 | LYD360 olea\|11v1\|SRR014463.11920_T1 | 11869 | 669 | 81.5 | glotblastn |
| 5657 | LYD360 peanut\|10v1\|SRR042413S0015373_T1 | 11870 | 669 | 81.5 | glotblastn |
| 5658 | LYD360 cirsium\|11v1\|SRR346952.1001301_T1 | 11871 | 669 | 81.3 | glotblastn |
| 5659 | LYD360 humulus\|11v1\|GD250731_T1 | 11872 | 669 | 81.3 | glotblastn |
| 5660 | LYD360 platanus\|11v1\|SRR096786X10895_T1 | 11873 | 669 | 81.3 | glotblastn |
| 5661 | LYD360 sarracenia\|11v1\|SRR192669.100315_T1 | 11874 | 669 | 81.3 | glotblastn |
| 5662 | LYD360 centaurea\|gb166\|EL933654_T1 | 11875 | 669 | 81.3 | glotblastn |
| 5663 | LYD360 cichorium\|gb171\|DT211242_T1 | 11876 | 669 | 81.3 | glotblastn |
| 5664 | LYD360 cynara\|gb167\|GE591437_T1 | 11877 | 669 | 81.3 | glotblastn |
| 5665 | LYD360 eggplant\|10v1\|FS033086_T1 | 11878 | 669 | 81.3 | glotblastn |
| 5666 | LYD360 ipomoea_nil\|10v1\|BJ568082_T1 | 11879 | 669 | 81.3 | glotblastn |
| 5667 | LYD360 millet\|10v1\|EVO454PM046177_T1 | 11880 | 669 | 81.3 | glotblastn |
| 5668 | LYD360 fagopyrum\|11v1\|SRR063703X117511_T1 | 11881 | 669 | 80.7 | glotblastn |
| 5669 | LYD360 olea\|11v1\|SRR014463.16600_T1 | 11882 | 669 | 80.7 | glotblastn |
| 5670 | LYD360 pepper\|gb171\|GD055477_T1 | 11883 | 669 | 80.7 | glotblastn |
| 5671 | LYD360 potato\|10v1\|AJ489100_T1 | 11884 | 669 | 80.7 | glotblastn |
| 5672 | LYD360 fagopyrum\|11v1\|SRR063689X131571_P1 | 11885 | 669 | 80.7 | globlastp |
| 5673 | LYD360 ambrosia\|11v1\|SRR346943.174803_T1 | 11886 | 669 | 80.6 | glotblastn |
| 5674 | LYD360 cirsium\|11v1\|SRR346952.135278_T1 | 11887 | 669 | 80.6 | glotblastn |
| 5675 | LYD360 euonymus\|11v1\|SRR070038X122146_T1 | 11888 | 669 | 80.6 | glotblastn |
| 5676 | LYD360 flaveria\|11v1\|SRR149229.121676_T1 | 11889 | 669 | 80.6 | glotblastn |
| 5677 | LYD360 flaveria\|11v1\|SRR149229.194597_T1 | 11890 | 669 | 80.6 | glotblastn |
| 5678 | LYD360 flax\|11v1\|CA482731_T1 | 11891 | 669 | 80.6 | glotblastn |
| 5679 | LYD360 chestnut\|gb170\|SRR006295S0003307_T1 | 11892 | 669 | 80.6 | glotblastn |
| 5680 | LYD360 kiwi\|gb166\|FG411380_P1 | 11893 | 669 | 80.6 | globlastp |
| 5681 | LYD360 lolium\|10v1\|DT669022_T1 | 11894 | 669 | 80.6 | glotblastn |
| 5682 | LYD360 oak\|10v1\|FN708127_T1 | 11895 | 669 | 80.6 | glotblastn |
| 5683 | LYD360 safflower\|gb162\|EL376935 | 11896 | 669 | 80.6 | glotblastn |
| 5684 | LYD360 salvia\|10v1\|FE536026 | 11897 | 669 | 80.6 | glotblastn |
| 5685 | LYD360 cynodon\|10v1\|ES298921_T1 | 11898 | 669 | 80.6 | glotblastn |
| 5686 | LYD360 trigonella\|11v1\|SRR066194X154393_T1 | 11899 | 669 | 80.2 | glotblastn |
| 5687 | LYD360 gerbera\|09v1\|AJ750312_T1 | 11900 | 669 | 80.2 | glotblastn |
| 5688 | LYD360 lettuce\|10v1\|DW100136_T1 | 11901 | 669 | 80.2 | glotblastn |
| 5689 | LYD360 chelidonium\|11v1\|SRR084752X101739_T1 | 11902 | 669 | 80.0 | glotblastn |
| 5690 | LYD360 basilicum\|10v1\|DY329462_T1 | 11903 | 669 | 80.0 | glotblastn |
| 5691 | LYD360 chickpea\|09v2\|GR403455_T1 | 11904 | 669 | 80.0 | glotblastn |
| 5692 | LYD360 ginger\|gb164\|DY351005_T1 | 11905 | 669 | 80.0 | glotblastn |
| 5693 | LYD360 nasturtium\|10v1\|SRR032558S0111187 | 11906 | 669 | 80.0 | globlastp |
| 5694 | LYD360 pepper\|gb171\|BM064746_T1 | 11907 | 669 | 80.0 | glotblastn |
| 5695 | LYD361 b_oleracea\|gb161\|AM385405_T1 | 11908 | 670 | 99.2 | glotblastn |
| 5696 | LYD361 tripterygium\|11v1\|SRR098677X138468_T1 | 11909 | 670 | 84.8 | glotblastn |
| 5697 | LYD361 flaveria\|11v1\|SRR149229.122667_T1 | 11910 | 670 | 83.9 | glotblastn |
| 5698 | LYD361 tabernaemontana\|11v1\|SRR098689X125809_T1 | 11911 | 670 | 83.9 | glotblastn |
| 5699 | LYD361 parthenium\|10v1\|GW786680_T1 | 11912 | 670 | 83.9 | glotblastn |
| 5700 | LYD361 ambrosia\|11v1\|SRR346935.133224_T1 | 11913 | 670 | 83.1 | glotblastn |
| 5701 | LYD361 cynara\|gb167\|GE577457_T1 | 11914 | 670 | 83.1 | glotblastn |
| 5702 | LYD361 cichorium\|gb171\|EL347127_T1 | 11915 | 670 | 82.4 | glotblastn |
| 5703 | LYD361 heritiera\|10v1\|SRR005794S0007778_T1 | 11916 | 670 | 82.4 | glotblastn |
| 5704 | LYD361 amsonia\|11v1\|SRR098688X100426_T1 | 11917 | 670 | 82.2 | glotblastn |
| 5705 | LYD361 senecio\|gb170\|DY658023 | 11918 | 670 | 81.7 | glotblastn |
| 5706 | LYD361 cleome_gynandra\|10v1\|SRR015532S0011695_T1 | 11919 | 670 | 80.7 | glotblastn |
| 5707 | LYD364 b_juncea\|10v2\|E6ANDIZ01AH21H_T1 | 11920 | 671 | 95.6 | glotblastn |
| 5708 | LYD364 b_juncea\|10v2\|E6ANDIZ02F6CV4_T1 | 11921 | 671 | 94.7 | glotblastn |
| 5709 | LYD364 ipomoea_nil\|10v1\|BJ561612_T1 | 11922 | 671 | 92.9 | glotblastn |
| 5710 | LYD364 nicotiana_benthamiana\|gb162\|CK281812_T1 | 11923 | 671 | 92.0 | glotblastn |
| 5711 | LYD364 tobacco\|gb162\|EB450183 | 11924 | 671 | 92.0 | glotblastn |
| 5712 | LYD364 ambrosia\|11v1\|SRR346935.106828_T1 | 11925 | 671 | 91.2 | glotblastn |
| 5713 | LYD364 ambrosia\|11v1\|SRR346935.112131_T1 | 11926 | 671 | 91.2 | glotblastn |
| 5714 | LYD364 ambrosia\|11v1\|SRR346943.139013_T1 | 11927 | 671 | 91.2 | glotblastn |
| 5715 | LYD364 flax\|11v1\|GW865802_T1 | 11928 | 671 | 91.2 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5716 | LYD364_flax\|11v1\|JG173317_T1 | 11929 | 671 | 91.2 | glotblastn |
| 5717 | LYD364_sunflower\|10v1\|BU023818 | 11930 | 671 | 91.2 | glotblastn |
| 5718 | LYD364_tragopogon\|10v1\|SRR020205S0006230 | 11931 | 671 | 91.2 | glotblastn |
| 5719 | LYD364_arnica\|11v1\|SRR099034X133755_T1 | 11932 | 671 | 90.3 | glotblastn |
| 5720 | LYD364_flaveria\|11v1\|SRR149229.121780_T1 | 11933 | 671 | 90.3 | glotblastn |
| 5721 | LYD364_trigonella\|11v1\|SRR066195X726617_T1 | 11934 | 671 | 90.3 | glotblastn |
| 5722 | LYD364_apple\|gb171\|CN945125 | 11935 | 671 | 90.3 | glotblastn |
| 5723 | LYD364_eucalyptus\|gb166\|CU397180 | 11936 | 671 | 90.3 | glotblastn |
| 5724 | LYD364_peanut\|10v1\|EE125876_T1 | 11937 | 671 | 90.3 | glotblastn |
| 5725 | LYD364_potato\|10v1\|CK253656_T1 | 11938 | 671 | 90.3 | glotblastn |
| 5726 | LYD364_solanum_phureja\|09v1\|SPHAW031194 | 11938 | 671 | 90.3 | glotblastn |
| 5727 | LYD364_tragopogon\|10v1\|SRR020205S0035822 | 11939 | 671 | 90.3 | glotblastn |
| 5728 | LYD364_cirsium\|11v1\|SRR346952.1004435_T1 | 11940 | 671 | 89.4 | glotblastn |
| 5729 | LYD364_cirsium\|11v1\|SRR349641.175990_T1 | 11941 | 671 | 89.4 | glotblastn |
| 5730 | LYD364_cucurbita\|11v1\|SRR091276X119946_T1 | 11942 | 671 | 89.4 | glotblastn |
| 5731 | LYD364_flaveria\|11v1\|SRR149229.169963_T1 | 11943 | 671 | 89.4 | glotblastn |
| 5732 | LYD364_fraxinus\|11v1\|SRR058827.102531_T1 | 11944 | 671 | 89.4 | glotblastn |
| 5733 | LYD364_valeriana\|11v1\|SRR099039X42953_T1 | 11945 | 671 | 89.4 | glotblastn |
| 5734 | LYD364_chestnut\|gb170\|SRR006295S0053605_T1 | 11946 | 671 | 89.4 | glotblastn |
| 5735 | LYD364_eggplant\|10v1\|FS047507_T1 | 11947 | 671 | 89.4 | glotblastn |
| 5736 | LYD364_amorphophallus\|11v2\|SRR089351X161177_T1 | 11948 | 671 | 88.5 | glotblastn |
| 5737 | LYD364_cirsium\|11v1\|SRR346952.10377_T1 | 11949 | 671 | 88.5 | glotblastn |
| 5738 | LYD364_silene\|11v1\|SRR096785X11002_T1 | 11950 | 671 | 88.5 | glotblastn |
| 5739 | LYD364_aristolochia\|10v1\|FD751247_T1 | 11951 | 671 | 88.5 | glotblastn |
| 5740 | LYD364_grape\|11v1\|GSVIVT01016640001_T1 | 11952 | 671 | 88.5 | glotblastn |
| 5741 | LYD364_grape\|gb160\|CA816039 | 11953 | 671 | 88.5 | glotblastn |
| 5742 | LYD364_cirsium\|11v1\|SRR346952.1066385_T1 | 11954 | 671 | 87.6 | glotblastn |
| 5743 | LYD364_eucalyptus\|11v2\|SRR001659X139344_T1 | 11955 | 671 | 87.6 | glotblastn |
| 5744 | LYD364_sarracenia\|11v1\|SRR192669.109882XX2_T1 | 11956 | 671 | 87.6 | glotblastn |
| 5745 | LYD364_amaranthus\|10v1\|SRR039411S0006119_T1 | 11957 | 671 | 87.6 | glotblastn |
| 5746 | LYD364_artemisia\|10v1\|EY083311_T1 | 11958 | 671 | 87.6 | glotblastn |
| 5747 | LYD364_pseudotsuga\|10v1\|SRR065119S0001409 | 11959 | 671 | 87.6 | glotblastn |
| 5748 | LYD364_cedrus\|11v1\|SRR065065X122227_T1 | 11960 | 671 | 86.7 | glotblastn |
| 5749 | LYD364_fagopyrum\|11v1\|SRR063689X127821_T1 | 11961 | 671 | 86.7 | glotblastn |
| 5750 | LYD364_cotton\|10v2\|SRR032877S0003205_T1 | 11962 | 671 | 86.7 | glotblastn |
| 5751 | LYD364_gnetum\|10v1\|SRR064399S0027176_T1 | 11963 | 671 | 86.7 | glotblastn |
| 5752 | LYD364_rice\|gb170\|OS05G38670 | 11964 | 671 | 86.7 | glotblastn |
| 5753 | LYD364_sequoia\|10v1\|SRR065044S0055390 | 11965 | 671 | 86.7 | glotblastn |
| 5754 | LYD364_spruce\|gb162\|CO256190 | 11966 | 671 | 86.7 | glotblastn |
| 5755 | LYD364_wheat\|10v2\|CA619872 | 11967 | 671 | 86.7 | glotblastn |
| 5756 | LYD364_amorphophallus\|11v2\|SRR089351X156007_T1 | 11968 | 671 | 85.8 | glotblastn |
| 5757 | LYD364_cephalotaxus\|11v1\|SRR064395X114663_T1 | 11969 | 671 | 85.8 | glotblastn |
| 5758 | LYD364_chelidonium\|11v1\|SRR084752X140022_T1 | 11970 | 671 | 85.8 | glotblastn |
| 5759 | LYD364_barley\|10v2\|AJ461622_T1 | 11971 | 671 | 85.8 | glotblastn |
| 5760 | LYD364_brachypodium\|09v1\|GT791460_T1 | 11972 | 671 | 85.8 | glotblastn |
| 5761 | LYD364_foxtail_millet\|10v2\|FXTRMSLX01701757D2 | 11973 | 671 | 85.8 | glotblastn |
| 5762 | LYD364_foxtail_millet\|11v3\|PHY7SI001645M_T1 | 11974 | 671 | 85.8 | glotblastn |
| 5763 | LYD364_leymus\|gb166\|EG375301_T1 | 11975 | 671 | 85.8 | glotblastn |
| 5764 | LYD364_millet\|10v1\|EVO454PM014724_T1 | 11976 | 671 | 85.8 | glotblastn |
| 5765 | LYD364_rice\|gb170\|OS01G62070 | 11977 | 671 | 85.8 | glotblastn |
| 5766 | LYD364_sciadopitys\|10v1\|SRR065035S0042595 | 11978 | 671 | 85.8 | glotblastn |
| 5767 | LYD364_switchgrass\|gb167\|FE636275 | 11979 | 671 | 85.8 | glotblastn |
| 5768 | LYD364_switchgrass\|gb167\|FL689954 | 11980 | 671 | 85.8 | glotblastn |
| 5769 | LYD364_wheat\|10v2\|CD910406 | 11981 | 671 | 85.8 | glotblastn |
| 5770 | LYD364_euphorbia\|11v1\|BP956540_P1 | 11982 | 671 | 85.8 | globlastp |
| 5771 | LYD364_cleome_spinosa\|10v1\|SRR015531S0227074_P1 | 11983 | 671 | 85.7 | globlastp |
| 5772 | LYD364_thellungiella\|gb167\|BY801460 | 11984 | 671 | 85.4 | globlastp |
| 5773 | LYD364_maritime_pine\|10v1\|SRR073317S0041913_T1 | 11985 | 671 | 85.0 | glotblastn |
| 5774 | LYD364_platanus\|11v1\|SRR096786X142855_T1 | 11986 | 671 | 85.0 | glotblastn |
| 5775 | LYD364_barley\|10v2\|AK250937_T1 | 11987 | 671 | 85.0 | glotblastn |
| 5776 | LYD364_fescue\|gb161\|DT695847_T1 | 11988 | 671 | 85.0 | glotblastn |
| 5777 | LYD364_maize\|10v1\|BE056147_T1 | 11989 | 671 | 85.0 | glotblastn |
| 5778 | LYD364_oat\|10v2\|GR313367 | 11990 | 671 | 85.0 | glotblastn |
| 5779 | LYD364_oat\|11v1\|GR313367_T1 | 11991 | 671 | 85.0 | glotblastn |
| 5780 | LYD364_pine\|10v2\|BQ696882_T1 | 11992 | 671 | 85.0 | glotblastn |
| 5781 | LYD364_podocarpus\|10v1\|SRR065014S0014985_T1 | 11993 | 671 | 85.0 | glotblastn |
| 5782 | LYD364_sorghum\|09v1\|SB03G039220 | 11994 | 671 | 85.0 | glotblastn |
| 5783 | LYD364_sorghum\|11v1\|SB03G039220_T1 | 11994 | 671 | 85.0 | glotblastn |
| 5784 | LYD364_sugarcane\|10v1\|CA102804 | 11995 | 671 | 85.0 | glotblastn |
| 5785 | LYD364_b_rapa\|gb162\|DN191492_T1 | 11996 | 671 | 84.4 | glotblastn |
| 5786 | LYD364_phalaenopsis\|11v1\|CK857898_T1 | 11997 | 671 | 84.1 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5787 | LYD364 phalaenopsis\|11v1\|SRR125771.1001015_T1 | 11998 | 671 | 84.1 | glotblastn |
| 5788 | LYD364 pteridium\|11v1\|SRR043594X100119_T1 | 11999 | 671 | 84.1 | glotblastn |
| 5789 | LYD364 brachypodium\|09v1\|GT795519_T1 | 12000 | 671 | 84.1 | glotblastn |
| 5790 | LYD364 cryptomeria\|gb166\|BY901929_T1 | 12001 | 671 | 84.1 | glotblastn |
| 5791 | LYD364 cycas\|gb166\|EX925953_T1 | 12002 | 671 | 84.1 | glotblastn |
| 5792 | LYD364 taxus\|10v1\|SRR032523S0006190 | 12003 | 671 | 84.1 | glotblastn |
| 5793 | LYD364 zostera\|10v1\|SRR057351S0003681 | 12004 | 671 | 84.1 | glotblastn |
| 5794 | LYD364 cucurbita\|11v1\|SRR091276X214940_P1 | 12005 | 671 | 84.0 | globlastp |
| 5795 | LYD364 distylium\|11v1\|SRR065077X107821_T1 | 12006 | 671 | 83.2 | glotblastn |
| 5796 | LYD364 momordica\|10v1\|SRR071315S0000271_T1 | 12007 | 671 | 83.2 | glotblastn |
| 5797 | LYD364 oat\|10v2\|SRR020741S0038718 | 12008 | 671 | 82.8 | glotblastn |
| 5798 | LYD364 oat\|11v1\|SRR020741.131397_T1 | 12009 | 671 | 82.8 | glotblastn |
| 5799 | LYD364 olea\|11v1\|SRR014463.56253_P1 | 12010 | 671 | 82.5 | globlastp |
| 5800 | LYD364 cephalotaxus\|11v1\|SRR064395X137359_T1 | 12011 | 671 | 82.3 | glotblastn |
| 5801 | LYD364 foxtail_millet\|10v2\|SICRP002033 | 12012 | 671 | 81.4 | glotblastn |
| 5802 | LYD364 foxtail_millet\|11v3\|PHY7SI022202M_T1 | 12013 | 671 | 81.4 | glotblastn |
| 5803 | LYD364 pseudotsuga\|10v1\|SRR065119S0016187 | 12014 | 671 | 81.4 | glotblastn |
| 5804 | LYD364 pseudotsuga\|10v1\|SRR065119S0106471 | 12015 | 671 | 81.4 | glotblastn |
| 5805 | LYD364 abies\|11v2\|SRR098676X127699_T1 | 12016 | 671 | 80.5 | glotblastn |
| 5806 | LYD364 sciadopitys\|10v1\|SRR065035S0157226 | 12017 | 671 | 80.5 | glotblastn |
| 5807 | LYD365 canola\|11v1\|ES984275_T1 | 12018 | 672 | 91.2 | glotblastn |
| 5808 | LYD365 radish\|gb164\|EX761695 | 12019 | 672 | 88.3 | globlastp |
| 5809 | LYD365 radish\|gb164\|EX775330 | 12020 | 672 | 87.2 | glotblastn |
| 5810 | LYD365 thellungiella\|gb167\|BY810879 | 12021 | 672 | 87.0 | globlastp |
| 5811 | LYD365 canola\|11v1\|GT072857_P1 | 12022 | 672 | 86.2 | globlastp |
| 5812 | LYD365 cotton\|10v2\|DW488586_t1 | 12023 | 672 | 80.4 | glotblastn |
| 5813 | LYD366 radish\|gb164\|EV535443 | 12024 | 673 | 96.2 | glotblastn |
| 5814 | LYD366 canola\|11v1\|CD813578_T1 | 12025 | 673 | 87.3 | glotblastn |
| 5815 | LYD366 b_juncea\|10v2\|E6ANDIZ01ES9WJ_T1 | 12026 | 673 | 87.3 | glotblastn |
| 5816 | LYD366 radish\|gb164\|EX897742 | 12027 | 673 | 85.8 | glotblastn |
| 5817 | LYD366 radish\|gb164\|FD560502 | 12028 | 673 | 85.3 | glotblastn |
| 5818 | LYD366 canola\|10v1\|EV014524 | 12029 | 673 | 80.9 | globlastp |
| 5819 | LYD367 cleome_spinosa\|10v1\|SRR015531S0007269_T1 | 12030 | 674 | 98.2 | glotblastn |
| 5820 | LYD367 papaya\|gb165\|EX260912_T1 | 12031 | 674 | 95.5 | glotblastn |
| 5821 | LYD367 cucurbita\|11v1\|SRR091276X204950_T1 | 12032 | 674 | 94.6 | glotblastn |
| 5822 | LYD367 aquilegia\|10v2\|DR933416_T1 | 12033 | 674 | 94.6 | glotblastn |
| 5823 | LYD367 castorbean\|11v1\|E0669531_T1 | 12034 | 674 | 94.6 | glotblastn |
| 5824 | LYD367 melon\|10v1\|AM714178_T1 | 12035 | 674 | 93.6 | glotblastn |
| 5825 | LYD367 cirsium\|11v1\|SRR346952.1000932_T1 | 12036 | 674 | 92.7 | glotblastn |
| 5826 | LYD367 aristolochia\|10v1\|FD751804_T1 | 12037 | 674 | 92.7 | glotblastn |
| 5827 | LYD367 avocado\|10v1\|CV004504_T1 | 12038 | 674 | 92.7 | glotblastn |
| 5828 | LYD367 castorbean\|09v1\|XM002520858 | 12039 | 674 | 92.7 | glotblastn |
| 5829 | LYD367 centaurea\|gb166\|EH729011_T1 | 12040 | 674 | 92.7 | glotblastn |
| 5830 | LYD367 citrus\|gb166\|EY718574_T1 | 12041 | 674 | 92.7 | glotblastn |
| 5831 | LYD367 grape\|gb160\|DT006013 | 12042 | 674 | 92.7 | glotblastn |
| 5832 | LYD367 liriodendron\|gb166\|FD491724_T1 | 12043 | 674 | 92.7 | glotblastn |
| 5833 | LYD367 pseudotsuga\|10v1\|SRR065119S0001846 | 12044 | 674 | 92.7 | glotblastn |
| 5834 | LYD367 abies\|11v2\|SRR098676X110149_T1 | 12045 | 674 | 91.8 | glotblastn |
| 5835 | LYD367 chelidonium\|11v1\|SRR084752X111167_T1 | 12046 | 674 | 91.8 | glotblastn |
| 5836 | LYD367 flax\|11v1\|GW864933_T1 | 12047 | 674 | 91.8 | glotblastn |
| 5837 | LYD367 fraxinus\|11v1\|SRR058827.106277_T1 | 12048 | 674 | 91.8 | glotblastn |
| 5838 | LYD367 chestnut\|gb170\|SRR006297S0073285_T1 | 12049 | 674 | 91.8 | glotblastn |
| 5839 | LYD367 citrus\|gb166\|CB293725_T1 | 12050 | 674 | 91.8 | glotblastn |
| 5840 | LYD367 nasturtium\|10v1\|SRR032558S0003127 | 12051 | 674 | 91.8 | glotblastn |
| 5841 | LYD367 nasturtium\|10v1\|SRR032558S0011900 | 12052 | 674 | 91.8 | glotblastn |
| 5842 | LYD367 nuphar\|gb166\|CK763308_T1 | 12053 | 674 | 91.8 | glotblastn |
| 5843 | LYD367 oak\|10v1\|FP029855_T1 | 12054 | 674 | 91.8 | glotblastn |
| 5844 | LYD367 sequoia\|10v1\|SRR065044S0012683 | 12055 | 674 | 91.8 | glotblastn |
| 5845 | LYD367 solanum_phureja\|09v1\|SPHAW035221 | 12056 | 674 | 91.8 | glotblastn |
| 5846 | LYD367 spruce\|gb162\|CO220971 | 12057 | 674 | 91.8 | glotblastn |
| 5847 | LYD367 spruce\|gb162\|CO223147 | 12058 | 674 | 91.8 | glotblastn |
| 5848 | LYD367 walnuts\|gb166\|CV196814 | 12059 | 674 | 91.8 | glotblastn |
| 5849 | LYD367 zostera\|10v1\|SRR057351S0000726 | 12060 | 674 | 91.8 | glotblastn |
| 5850 | LYD367 ambrosia\|11v1\|SRR346935.105602_T1 | 12061 | 674 | 90.9 | glotblastn |
| 5851 | LYD367 cannabis\|12v1\|SOLX00007976_T1 | 12062 | 674 | 90.9 | glotblastn |
| 5852 | LYD367 cirsium\|11v1\|SRR346952.1076540_T1 | 12063 | 674 | 90.9 | glotblastn |
| 5853 | LYD367 cirsium\|11v1\|SRR346952.130641_T1 | 12064 | 674 | 90.9 | glotblastn |
| 5854 | LYD367 cirsium\|11v1\|SRR346952.283708XX2_T1 | 12065 | 674 | 90.9 | glotblastn |
| 5855 | LYD367 flaveria\|11v1\|SRR149229.132370_T1 | 12066 | 674 | 90.9 | glotblastn |
| 5856 | LYD367 flaveria\|11v1\|SRR149229.32333_T1 | 12067 | 674 | 90.9 | glotblastn |
| 5857 | LYD367 flaveria\|11v1\|SRR149229.507541_T1 | 12068 | 674 | 90.9 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5858 | LYD367 flaveria\|11v1\|SRR149238.359193_T1 | 12069 | 674 | 90.9 | glotblastn |
| 5859 | LYD367 maritime_pine\|10v1\|CT576292_T1 | 12070 | 674 | 90.9 | glotblastn |
| 5860 | LYD367 olea\|11v1\|SRR014463.14519_T1 | 12071 | 674 | 90.9 | glotblastn |
| 5861 | LYD367 trigonella\|11v1\|SRR066194X106720_T1 | 12072 | 674 | 90.9 | glotblastn |
| 5862 | LYD367 trigonella\|11v1\|SRR066194X519652_T1 | 12073 | 674 | 90.9 | glotblastn |
| 5863 | LYD367 tripterygium\|11v1\|SRR098677X106952_T1 | 12074 | 674 | 90.9 | glotblastn |
| 5864 | LYD367 vinca\|11v1\|SRR098690X116305_T1 | 12075 | 674 | 90.9 | glotblastn |
| 5865 | LYD367 apple\|11v1\|CN492832_T1 | 12076 | 674 | 90.9 | glotblastn |
| 5866 | LYD367 apple\|gb171\|CN544831 | 12077 | 674 | 90.9 | glotblastn |
| 5867 | LYD367 artemisia\|10v1\|EY079311_T1 | 12078 | 674 | 90.9 | glotblastn |
| 5868 | LYD367 ceratodon\|10v1\|SRR074890S0000494_T1 | 12079 | 674 | 90.9 | glotblastn |
| 5869 | LYD367 cryptomeria\|gb166\|BW996943_T1 | 12080 | 674 | 90.9 | glotblastn |
| 5870 | LYD367 cycas\|gb166\|CB092562_T1 | 12081 | 674 | 90.9 | glotblastn |
| 5871 | LYD367 gnetum\|10v1\|CB082032_T1 | 12082 | 674 | 90.9 | glotblastn |
| 5872 | LYD367 ipomoea_nil\|10v1\|BJ564547_T1 | 12083 | 674 | 90.9 | glotblastn |
| 5873 | LYD367 kiwi\|gb166\|FG397176_T1 | 12084 | 674 | 90.9 | glotblastn |
| 5874 | LYD367 medicago\|09v1\|AW256785_T1 | 12085 | 674 | 90.9 | glotblastn |
| 5875 | LYD367 peanut\|10v1\|ES719984_T1 | 12086 | 674 | 90.9 | glotblastn |
| 5876 | LYD367 pepper\|gb171\|CA522688_T1 | 12087 | 674 | 90.9 | glotblastn |
| 5877 | LYD367 physcomitrella\|10v1\|BJ192437_T1 | 12088 | 674 | 90.9 | glotblastn |
| 5878 | LYD367 pigeonpea\|10v1\|SRR054580S0000703_T1 | 12089 | 674 | 90.9 | glotblastn |
| 5879 | LYD367 pseudotsuga\|10v1\|SRR065119S0001434 | 12090 | 674 | 90.9 | glotblastn |
| 5880 | LYD367 rhizophora\|10v1\|SRR005793S0002403 | 12091 | 674 | 90.9 | glotblastn |
| 5881 | LYD367 spikemoss\|gb165\|DN839472 | 12092 | 674 | 90.9 | glotblastn |
| 5882 | LYD367 spikemoss\|gb165\|FE452380 | 12092 | 674 | 90.9 | glotblastn |
| 5883 | LYD367 sunflower\|10v1\|AJ828638 | 12093 | 674 | 90.9 | glotblastn |
| 5884 | LYD367 ambrosia\|11v1\|SRR346935.147733_T1 | 12094 | 674 | 90.0 | glotblastn |
| 5885 | LYD367 ambrosia\|11v1\|SRR346935.178069_T1 | 12095 | 674 | 90.0 | glotblastn |
| 5886 | LYD367 amorphophallus\|11v2\|SRR089351X112951_T1 | 12096 | 674 | 90.0 | glotblastn |
| 5887 | LYD367 arnica\|11v1\|SRR099034X159126_T1 | 12097 | 674 | 90.0 | glotblastn |
| 5888 | LYD367 cirsium\|11v1\|SRR346952.1172107_T1 | 12098 | 674 | 90.0 | glotblastn |
| 5889 | LYD367 cirsium\|11v1\|SRR346952.117874_T1 | 12099 | 674 | 90.0 | glotblastn |
| 5890 | LYD367 fagopyrum\|11v1\|SRR063689X11984_T1 | 12100 | 674 | 90.0 | glotblastn |
| 5891 | LYD367 flaveria\|11v1\|SRR149229.104797_T1 | 12101 | 674 | 90.0 | glotblastn |
| 5892 | LYD367 flaveria\|11v1\|SRR149229.138180_T1 | 12102 | 674 | 90.0 | glotblastn |
| 5893 | LYD367 flaveria\|11v1\|SRR149229.367117_T1 | 12103 | 674 | 90.0 | glotblastn |
| 5894 | LYD367 vinca\|11v1\|SRR098690X104064_T1 | 12104 | 674 | 90.0 | glotblastn |
| 5895 | LYD367 aquilegia\|10v2\|DR923174_T1 | 12105 | 674 | 90.0 | glotblastn |
| 5896 | LYD367 centaurea\|gb166\|EH732999_T1 | 12106 | 674 | 90.0 | glotblastn |
| 5897 | LYD367 lotus\|09v1\|AV771851_T1 | 12107 | 674 | 90.0 | glotblastn |
| 5898 | LYD367 peanut\|10v1\|GO263445_T1 | 12108 | 674 | 90.0 | glotblastn |
| 5899 | LYD367 pepper\|gb171\|GD087782_T1 | 12109 | 674 | 90.0 | glotblastn |
| 5900 | LYD367 physcomitrella\|10v1\|AW699394_T1 | 12110 | 674 | 90.0 | glotblastn |
| 5901 | LYD367 pigeonpea\|10v1\|SRR054580S0004838_T1 | 12111 | 674 | 90.0 | glotblastn |
| 5902 | LYD367 taxus\|10v1\|SRR032523S0006400XX1 | 12112 | 674 | 89.3 | glotblastn |
| 5903 | LYD367 ambrosia\|11v1\|SRR346935.100427_T1 | 12113 | 674 | 89.1 | glotblastn |
| 5904 | LYD367 ambrosia\|11v1\|SRR346935.2799_T1 | 12114 | 674 | 89.1 | glotblastn |
| 5905 | LYD367 cirsium\|11v1\|SRR346952.1054548_T1 | 12115 | 674 | 89.1 | glotblastn |
| 5906 | LYD367 pteridium\|11v1\|SRR043594X223763_T1 | 12116 | 674 | 89.1 | glotblastn |
| 5907 | LYD367 scabiosa\|11v1\|SRR063723X1469_T1 | 12117 | 674 | 89.1 | glotblastn |
| 5908 | LYD367 valeriana\|11v1\|SRR099039X119875XX2_T1 | 12118 | 674 | 89.1 | glotblastn |
| 5909 | LYD367 amaranthus\|10v1\|SRR039411S0012428_T1 | 12119 | 674 | 89.1 | glotblastn |
| 5910 | LYD367 banana\|10v1\|DN238108_T1 | 12120 | 674 | 89.1 | glotblastn |
| 5911 | LYD367 bean\|gb167\|CA913133_T1 | 12121 | 674 | 89.1 | glotblastn |
| 5912 | LYD367 cichorium+G \|gb171\|EH691389_T1 | 12122 | 674 | 89.1 | glotblastn |
| 5913 | LYD367 cichorium\|gb171\|EH700899_T1 | 12123 | 674 | 89.1 | glotblastn |
| 5914 | LYD367 cynara\|gb167\|GE602515_T1 | 12124 | 674 | 89.1 | glotblastn |
| 5915 | LYD367 oil_palm\|gb166\|EL688509_T1 | 12125 | 674 | 89.1 | glotblastn |
| 5916 | LYD367 peanut\|10v1\|DT044311_T1 | 12126 | 674 | 89.1 | glotblastn |
| 5917 | LYD367 pigeonpea\|10v1\|SRR054580S0002792_T1 | 12127 | 674 | 89.1 | glotblastn |
| 5918 | LYD367 sunflower\|10v1\|CF078055 | 12128 | 674 | 89.1 | glotblastn |
| 5919 | LYD367 sequoia\|10v1\|SRR065044S0105538 | 12129 | 674 | 88.4 | glotblastn |
| 5920 | LYD367 amorphophallus\|11v2\|SRR089351X261661_T1 | 12130 | 674 | 88.2 | glotblastn |
| 5921 | LYD367 arnica\|11v1\|SRR099034X134252_T1 | 12131 | 674 | 88.2 | glotblastn |
| 5922 | LYD367 cirsium\|11v1\|SRR346952.468708_T1 | 12132 | 674 | 88.2 | glotblastn |
| 5923 | LYD367 flaveria\|11v1\|SRR149229.101706_T1 | 12133 | 674 | 88.2 | glotblastn |
| 5924 | LYD367 maritime_pine\|10v1\|CT581036_T1 | 12134 | 674 | 88.2 | glotblastn |
| 5925 | LYD367 phyla\|11v2\|SRR099038X9150_T1 | 12135 | 674 | 88.2 | glotblastn |
| 5926 | LYD367 plantago\|11v1\|SRR066373X130326_T1 | 12136 | 674 | 88.2 | glotblastn |
| 5927 | LYD367 pteridium\|11v1\|SRR043594X111779_T1 | 12137 | 674 | 88.2 | glotblastn |
| 5928 | LYD367 artemisia\|10v1\|EY085181_T1 | 12138 | 674 | 88.2 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 5929 | LYD367 citrus\|gb166\|EY752937_T1 | 12139 | 674 | 88.2 | glotblastn |
| 5930 | LYD367 lettuce\|10v1\|DW074593_T1 | 12140 | 674 | 88.2 | glotblastn |
| 5931 | LYD367 medicago\|09v1\|AW689662_T1 | 12141 | 674 | 88.2 | glotblastn |
| 5932 | LYD367 pine\|10v2\|BE762098_T1 | 12142 | 674 | 88.2 | glotblastn |
| 5933 | LYD367 rice\|gb170\|OS05G40410 | 12143 | 674 | 88.2 | glotblastn |
| 5934 | LYD367 tragopogon\|10v1\|SRR020205S0002294 | 12144 | 674 | 88.2 | glotblastn |
| 5935 | LYD367 triphysaria\|10v1\|EX983322 | 12145 | 674 | 88.2 | glotblastn |
| 5936 | LYD367 distylium\|11v1\|SRR065077X115608_T1 | 12146 | 674 | 87.5 | glotblastn |
| 5937 | LYD367 arnica\|11v1\|SRR099034X144079_T1 | 12147 | 674 | 87.3 | glotblastn |
| 5938 | LYD367 phyla\|11v2\|SRR099035X115629_T1 | 12148 | 674 | 87.3 | glotblastn |
| 5939 | LYD367 trigonella\|11v1\|SRR066194X147598_T1 | 12149 | 674 | 87.3 | glotblastn |
| 5940 | LYD367 aristolochia\|10v1\|SRR039082S0006000_T1 | 12150 | 674 | 87.3 | glotblastn |
| 5941 | LYD367 brachypodium\|09v1\|DV472362_T1 | 12151 | 674 | 87.3 | glotblastn |
| 5942 | LYD367 cenchrus\|gb166\|EB661926_T1 | 12152 | 674 | 87.3 | glotblastn |
| 5943 | LYD367 dandelion\|10v1\|DR400957_T1 | 12153 | 674 | 87.3 | glotblastn |
| 5944 | LYD367 foxtail_millet\|10v2\|FXTRMSLX05049312D2 | 12154 | 674 | 87.3 | glotblastn |
| 5945 | LYD367 foxtail_millet\|11v3\|PHY7SI021998M_T1 | 12155 | 674 | 87.3 | glotblastn |
| 5946 | LYD367 maize\|10v1\|AW091026_T1 | 12156 | 674 | 87.3 | glotblastn |
| 5947 | LYD367 millet\|10v1\|EVO454PM009739_T1 | 12157 | 674 | 87.3 | glotblastn |
| 5948 | LYD367 nuphar\|gb166\|ES730419_T1 | 12158 | 674 | 87.3 | glotblastn |
| 5949 | LYD367 sorghum\|09v1\|SB09G023710_T1 | 12159 | 674 | 87.3 | glotblastn |
| 5950 | LYD367 sorghum\|11v1\|SB09G023710_T1 | 12159 | 674 | 87.3 | glotblastn |
| 5951 | LYD367 soybean\|11v1\|GLYMA09G40710 | 12160 | 674 | 87.3 | glotblastn |
| 5952 | LYD367 soybean\|11v1\|GLYMA18G45110 | 12161 | 674 | 87.3 | glotblastn |
| 5953 | LYD367 sugarcane\|10v1\|CA119210 | 12162 | 674 | 87.3 | glotblastn |
| 5954 | LYD367 switchgrass\|gb167\|FE644637 | 12163 | 674 | 87.3 | glotblastn |
| 5955 | LYD367 cephalotaxus\|11v1\|SRR064395X125946_T1 | — | 674 | 86.6 | glotblastn |
| 5956 | LYD367 ambrosia\|11v1\|SRR346935.198800_T1 | 12164 | 674 | 86.4 | glotblastn |
| 5957 | LYD367 scabiosa\|11v1\|SRR063723X127554_T1 | 12165 | 674 | 86.4 | glotblastn |
| 5958 | LYD367 maize\|10v1\|AW067260_T1 | 12166 | 674 | 86.4 | glotblastn |
| 5959 | LYD367 poplar\|10v1\|PT2CRP012145_T1 | 12167 | 674 | 86.4 | glotblastn |
| 5960 | LYD367 switchgrass\|gb167\|FE602844 | 12168 | 674 | 86.4 | glotblastn |
| 5961 | LYD367 cedrus\|11v1\|SRR065007X30235_T1 | 12169 | 674 | 85.5 | glotblastn |
| 5962 | LYD367 olea\|11v1\|SRR014463.17446_T1 | 12170 | 674 | 85.5 | glotblastn |
| 5963 | LYD367 phalaenopsis\|11v1\|SRR125771.100655_T1 | 12171 | 674 | 85.5 | glotblastn |
| 5964 | LYD367 phyla\|11v2\|SRR099035X102998_T1 | 12172 | 674 | 85.5 | glotblastn |
| 5965 | LYD367 safflower\|gb162\|EL386802 | 12173 | 674 | 85.5 | glotblastn |
| 5966 | LYD367 triphysaria\|10v1\|EY140069 | 12174 | 674 | 85.5 | glotblastn |
| 5967 | LYD367 utricularia\|11v1\|SRR094438.16248_T1 | 12175 | 674 | 84.6 | glotblastn |
| 5968 | LYD367 barley\|10v2\|BI950418_T1 | 12176 | 674 | 84.6 | glotblastn |
| 5969 | LYD367 ginger\|gb164\|DY357344_T1 | 12177 | 674 | 84.6 | glotblastn |
| 5970 | LYD367 oat\|10v2\|GO590080 | 12178 | 674 | 84.6 | glotblastn |
| 5971 | LYD367 oat\|11v1\|GO590080_T1 | 12178 | 674 | 84.6 | glotblastn |
| 5972 | LYD367 sarracenia\|11v1\|SRR192671.80839_P1 | 12179 | 674 | 83.8 | globlastp |
| 5973 | LYD367 silene\|11v1\|SRR096785X27468_T1 | 12180 | 674 | 83.6 | glotblastn |
| 5974 | LYD367 artemisia\|10v1\|EY043419_T1 | 12181 | 674 | 83.6 | glotblastn |
| 5975 | LYD367 fescue\|gb161\|DT689636_T1 | 12182 | 674 | 83.6 | glotblastn |
| 5976 | LYD367 oil_palm\|gb166\|EL689018_T1 | 12183 | 674 | 83.6 | glotblastn |
| 5977 | LYD367 orobanche\|10v1\|SRR023189S0021385_T1 | 12184 | 674 | 83.6 | glotblastn |
| 5978 | LYD367 wheat\|10v2\|BE419765 | 12185 | 674 | 83.6 | glotblastn |
| 5979 | LYD367 guizotia\|10v1\|GE569234_T1 | — | 674 | 83.6 | glotblastn |
| 5980 | LYD367 pseudoroegneria\|gb167\|FF355597 | 12186 | 674 | 82.7 | glotblastn |
| 5981 | LYD367 rice\|gb170\|OS12G31440 | 12187 | 674 | 82.7 | glotblastn |
| 5982 | LYD367 centaurea\|gb166\|EH718339_T1 | 12188 | 674 | 82.3 | glotblastn |
| 5983 | LYD367 platanus\|11v1\|SRR096786X204003_T1 | 12189 | 674 | 81.8 | glotblastn |
| 5984 | LYD367 sorghum\|09v1\|SB08G015420 | 12190 | 674 | 81.8 | glotblastn |
| 5985 | LYD367 sorghum\|11v1\|SB08G015420_T1 | 12190 | 674 | 81.8 | glotblastn |
| 5986 | LYD367 fagopyrum\|11v1\|SRR063689X103151_T1 | 12191 | 674 | 80.9 | glotblastn |
| 5987 | LYD367 amborella\|gb166\|CD482229_T1 | 12192 | 674 | 80.9 | glotblastn |
| 5988 | LYD367 brachypodium\|09v1\|GT813693_T1 | 12193 | 674 | 80.9 | glotblastn |
| 5989 | LYD367 citrus\|gb166\|DN958969_T1 | 12194 | 674 | 80.9 | glotblastn |
| 5990 | LYD367 maize\|10v1\|AI964659_T1 | 12195 | 674 | 80.9 | glotblastn |
| 5991 | LYD367 sugarcane\|10v1\|CA087697 | 12196 | 674 | 80.9 | glotblastn |
| 5992 | LYD367 clementine\|11v1\|CX295745_T1 | 12197 | 674 | 80.0 | glotblastn |
| 5993 | LYD367 barley\|10v2\|BE437313_T1 | 12198 | 674 | 80.0 | glotblastn |
| 5994 | LYD367 pseudoroegneria\|gb167\|FF365401 | 12199 | 674 | 80.0 | glotblastn |
| 5995 | LYD367 rice\|gb170\|OS01G60200 | 12200 | 674 | 80.0 | glotblastn |
| 5996 | LYD367 switchgrass\|gb167\|DN141731 | 12201 | 674 | 80.0 | glotblastn |
| 5997 | LYD367 switchgrass\|gb167\|FE614785 | 12202 | 674 | 80.0 | glotblastn |
| 5998 | LYD367 wheat\|10v2\|BQ743752 | 12203 | 674 | 80.0 | glotblastn |
| 5999 | LYD371 fescue\|gb161\|DT681155_T1 | 12204 | 675 | 81.5 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6000 | LYD376 b_juncea\|10v2\|E6ANDIZ01CYQ9J_P1 | 12205 | 676 | 97.3 | globlastp |
| 6001 | LYD376 canola\|11v1\|EV095015_T1 | 12206 | 676 | 97.2 | glotblastn |
| 6002 | LYD376 canola\|11v1\|EV099299_T1 | 12207 | 676 | 97.2 | glotblastn |
| 6003 | LYD376 radish\|gb164\|FD543910 | 12208 | 676 | 96.1 | glotblastn |
| 6004 | LYD376 b_rapa\|gb162\|DN964030_P1 | 12209 | 676 | 95.7 | globlastp |
| 6005 | LYD376 canola\|11v1\|EE493324_T1 | 12210 | 676 | 91.7 | glotblastn |
| 6006 | LYD376 canola\|11v1\|SRR023612.10965_T1 | 12211 | 676 | 89.5 | glotblastn |
| 6007 | LYD376 b_oleracea\|gb161\|AM057497_P1 | 12212 | 676 | 89.5 | globlastp |
| 6008 | LYD376 cleome_spinosa\|10v1\|SRR015531S0047913_T1 | 12213 | 676 | 84.5 | glotblastn |
| 6009 | LYD377 b_rapa\|gb162\|CO749638_T1 | 12214 | 677 | 96.2 | glotblastn |
| 6010 | LYD378 b_juncea\|10v2\|E6ANDIZ01B3NIF_T1 | 12215 | 678 | 100.0 | glotblastn |
| 6011 | LYD378 canola\|11v1\|DR697840_T1 | 12216 | 678 | 98.3 | glotblastn |
| 6012 | LYD378 canola\|11v1\|SRR329661.339530_T1 | 12217 | 678 | 98.3 | glotblastn |
| 6013 | LYD378 thellungiella_halophilum\|11v1\|EHPRD042325_T1 | 12218 | 678 | 98.3 | glotblastn |
| 6014 | LYD378 b_juncea\|10v2\|E6ANDIZ01A5MR8_T1 | 12219 | 678 | 98.3 | glotblastn |
| 6015 | LYD378 b_juncea\|10v2\|E6ANDIZ01AHDOV_T1 | 12220 | 678 | 98.3 | glotblastn |
| 6016 | LYD378 b_juncea\|10v2\|E6ANDIZ01APB48_T1 | 12221 | 678 | 98.3 | glotblastn |
| 6017 | LYD378 b_juncea\|10v2\|E6ANDIZ01BLJ36_T1 | 12222 | 678 | 98.3 | glotblastn |
| 6018 | LYD378 b_juncea\|10v2\|OXBJ1SLX00000927D1T1_T1 | 12223 | 678 | 98.3 | glotblastn |
| 6019 | LYD378 b_juncea\|10v2\|OXBJ1SLX00001601T1_T1 | 12222 | 678 | 98.3 | glotblastn |
| 6020 | LYD378 b_juncea\|10v2\|OXBJ1SLX00006377D2T1_T1 | 12224 | 678 | 98.3 | glotblastn |
| 6021 | LYD378 radish\|gb164\|EV546476 | 12225 | 678 | 98.3 | glotblastn |
| 6022 | LYD378 radish\|gb164\|EV547145 | 12226 | 678 | 98.3 | glotblastn |
| 6023 | LYD378 radish\|gb164\|EX901507 | 12227 | 678 | 98.3 | glotblastn |
| 6024 | LYD378 radish\|gb164\|EY926429 | 12228 | 678 | 98.3 | glotblastn |
| 6025 | LYD378 canola\|11v1\|CX192418_T1 | 12229 | 678 | 97.4 | glotblastn |
| 6026 | LYD378 canola\|11v1\|EV017982_T1 | 12230 | 678 | 97.4 | glotblastn |
| 6027 | LYD378 canola\|11v1\|SRR329670.138543_T1 | 12231 | 678 | 97.4 | glotblastn |
| 6028 | LYD378 thellungiella_parvulum\|11v1\|EPPRD046860_T1 | 12232 | 678 | 97.4 | glotblastn |
| 6029 | LYD378 b_juncea\|10v2\|E6ANDIZ01A5TKV_T1 | 12233 | 678 | 97.4 | glotblastn |
| 6030 | LYD378 b_juncea\|10v2\|OXBJ1SLX00002868T1_T1 | 12234 | 678 | 97.4 | glotblastn |
| 6031 | LYD378 b_juncea\|10v2\|E6ANDIZ01AJ2J7_T1 | 12235 | 678 | 96.5 | glotblastn |
| 6032 | LYD378 b_nigra\|09v1\|GT075327_T1 | 12236 | 678 | 96.5 | glotblastn |
| 6033 | LYD378 thellungiella_parvulum\|11v1\|EPPRD131368_T1 | — | 678 | 96.5 | glotblastn |
| 6034 | LYD378 thellungiella\|gb167\|BM985729 | 12237 | 678 | 95.6 | glotblastn |
| 6035 | LYD378 potato\|10v1\|BI405371_T1 | 12238 | 678 | 94.7 | glotblastn |
| 6036 | LYD378 poppy\|gb166\|FE965193_T1 | 12239 | 678 | 93.9 | glotblastn |
| 6037 | LYD378 tomato\|11v1\|AW441457_T1 | 12240 | 678 | 93.0 | glotblastn |
| 6038 | LYD378 basilicum\|10v1\|DY321719_T1 | 12241 | 678 | 93.0 | glotblastn |
| 6039 | LYD378 basilicum\|10v1\|DY322263_T1 | 12242 | 678 | 93.0 | glotblastn |
| 6040 | LYD378 cleome_spinosa\|10v1\|GR934036_T1 | 12243 | 678 | 93.0 | glotblastn |
| 6041 | LYD378 nicotiana_benthamiana\|gb162\|CN744909_T1 | 12244 | 678 | 93.0 | glotblastn |
| 6042 | LYD378 petunia\|gb171\|CV294287_T1 | 12245 | 678 | 93.0 | glotblastn |
| 6043 | LYD378 potato\|10v1\|CK862426_T1 | 12246 | 678 | 93.0 | glotblastn |
| 6044 | LYD378 salvia\|10v1\|SRR014553S0000193 | 12247 | 678 | 93.0 | glotblastn |
| 6045 | LYD378 tomato\|09v1\|AW441457 | 12248 | 678 | 93.0 | glotblastn |
| 6046 | LYD378 canola\|11v1\|SRR329671.232832_T1 | 12249 | 678 | 92.1 | glotblastn |
| 6047 | LYD378 grape\|11v1\|XM_002266166_T1 | 12250 | 678 | 92.1 | glotblastn |
| 6048 | LYD378 cenchrus\|gb166\|EB653648_T1 | 12251 | 678 | 92.1 | glotblastn |
| 6049 | LYD378 foxtail_millet\|10v2\|FXTRMSLX00260397D1 | 12252 | 678 | 92.1 | glotblastn |
| 6050 | LYD378 pseudoroegneria\|gb167\|FF340573 | 12253 | 678 | 92.1 | glotblastn |
| 6051 | LYD378 salvia\|10v1\|CV163274 | 12254 | 678 | 92.1 | glotblastn |
| 6052 | LYD378 switchgrass\|gb167\|DN146005 | 12255 | 678 | 92.1 | glotblastn |
| 6053 | LYD378 tea\|10v1\|GE650198 | 12256 | 678 | 92.1 | glotblastn |
| 6054 | LYD378 tobacco\|gb162\|DW003613 | 12257 | 678 | 92.1 | glotblastn |
| 6055 | LYD378 wheat\|10v2\|BG905439 | 12258 | 678 | 92.1 | glotblastn |
| 6056 | LYD378 fagopyrum\|11v1\|SRR063689X119786_T1 | 12259 | 678 | 91.2 | glotblastn |
| 6057 | LYD378 flax\|11v1\|CA482372_T1 | 12260 | 678 | 91.2 | glotblastn |
| 6058 | LYD378 olea\|11v1\|SRR014463.18226_T1 | 12261 | 678 | 91.2 | glotblastn |
| 6059 | LYD378 bean\|gb167\|CA900869_T1 | 12262 | 678 | 91.2 | glotblastn |
| 6060 | LYD378 brachypodium\|09v1\|DV470217_T1 | 12263 | 678 | 91.2 | glotblastn |
| 6061 | LYD378 cynodon\|10v1\|DN987401_T1 | 12264 | 678 | 91.2 | glotblastn |
| 6062 | LYD378 eggplant\|10v1\|FS002314_T1 | 12265 | 678 | 91.2 | glotblastn |
| 6063 | LYD378 eggplant\|10v1\|FS012540_T1 | 12266 | 678 | 91.2 | glotblastn |
| 6064 | LYD378 foxtail_millet\|10v2\|OXFXTRMSLX00036801D1T1 | 12267 | 678 | 91.2 | glotblastn |
| 6065 | LYD378 lolium\|10v1\|DT670856_T1 | 12268 | 678 | 91.2 | glotblastn |
| 6066 | LYD378 lovegrass\|gb167\|EH185845_T1 | 12269 | 678 | 91.2 | glotblastn |
| 6067 | LYD378 nasturtium\|10v1\|GH169874 | 12270 | 678 | 91.2 | glotblastn |
| 6068 | LYD378 sugarcane\|10v1\|AA842797 | 12271 | 678 | 91.2 | glotblastn |
| 6069 | LYD378 wheat\|10v2\|BI750578 | 12272 | 678 | 91.2 | glotblastn |
| 6070 | LYD378 cirsium\|11v1\|SRR346952.58083_T1 | 12273 | 678 | 90.4 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6071 | LYD378 cucurbita\|11v1\|SRR091276X125827XX1_T1 | 12274 | 678 | 90.4 | glotblastn |
| 6072 | LYD378 euphorbia\|11v1\|BP961123_T1 | 12275 | 678 | 90.4 | glotblastn |
| 6073 | LYD378 platanus\|11v1\|SRR096786X106256_T1 | 12276 | 678 | 90.4 | glotblastn |
| 6074 | LYD378 scabiosa\|11v1\|SRR063723X103616_T1 | 12277 | 678 | 90.4 | glotblastn |
| 6075 | LYD378 thalictrum\|11v1\|SRR096787X110894_T1 | 12278 | 678 | 90.4 | glotblastn |
| 6076 | LYD378 amaranthus\|10v1\|SRR039411S0016258_T1 | 12279 | 678 | 90.4 | glotblastn |
| 6077 | LYD378 basilicum\|10v1\|DY323438_T1 | 12280 | 678 | 90.4 | glotblastn |
| 6078 | LYD378 cotton\|10v2\|SRR032367S0014733_T1 | 12281 | 678 | 90.4 | glotblastn |
| 6079 | LYD378 cotton\|10v2\|SRR032367S0054688_T1 | 12282 | 678 | 90.4 | glotblastn |
| 6080 | LYD378 eggplant\|10v1\|FS001214_T1 | 12283 | 678 | 90.4 | glotblastn |
| 6081 | LYD378 eucalyptus\|gb166\|CB967558 | 12284 | 678 | 90.4 | glotblastn |
| 6082 | LYD378 leymus\|gb166\|EG390551_T1 | 12285 | 678 | 90.4 | glotblastn |
| 6083 | LYD378 millet\|10v1\|CD724455_T1 | 12286 | 678 | 90.4 | glotblastn |
| 6084 | LYD378 millet\|10v1\|EVO454PM000567_T1 | 12287 | 678 | 90.4 | glotblastn |
| 6085 | LYD378 millet\|10v1\|EVO454PM022284_T1 | 12288 | 678 | 90.4 | glotblastn |
| 6086 | LYD378 oak\|10v1\|FP026027_T1 | 12289 | 678 | 90.4 | glotblastn |
| 6087 | LYD378 oat\|10v2\|CN821646 | 12290 | 678 | 90.4 | glotblastn |
| 6088 | LYD378 oil_palm\|gb166\|EL688766_T1 | 12291 | 678 | 90.4 | glotblastn |
| 6089 | LYD378 rye\|gb164\|BE705372 | 12292 | 678 | 90.4 | glotblastn |
| 6090 | LYD378 switchgrass\|gb167\|FE598877 | 12293 | 678 | 90.4 | glotblastn |
| 6091 | LYD378 walnuts\|gb166\|EL897331 | 12294 | 678 | 90.4 | glotblastn |
| 6092 | LYD378 thellungiella\|gb167\|BY803395 | 12295 | 678 | 89.6 | globlastp |
| 6093 | LYD378 nicotiana_benthamiana\|gb162\|CN743220_P1 | 12296 | 678 | 89.5 | globlastp |
| 6094 | LYD378 cirsium\|11v1\|SRR346952.102806_T1 | 12297 | 678 | 89.5 | glotblastn |
| 6095 | LYD378 flax\|11v1\|JG152039_T1 | 12298 | 678 | 89.5 | glotblastn |
| 6096 | LYD378 fraxinus\|11v1\|SRR058827.118157_T1 | 12299 | 678 | 89.5 | glotblastn |
| 6097 | LYD378 olea\|11v1\|SRR014463.12858_T1 | 12300 | 678 | 89.5 | glotblastn |
| 6098 | LYD378 thalictrum\|11v1\|SRR096787X110831_T1 | 12301 | 678 | 89.5 | glotblastn |
| 6099 | LYD378 watermelon\|11v1\|DV632146_T1 | 12302 | 678 | 89.5 | glotblastn |
| 6100 | LYD378 beech\|gb170\|SRR006293S0000235_T1 | 12303 | 678 | 89.5 | glotblastn |
| 6101 | LYD378 centaurea\|gb166\|EL931201_T1 | 12304 | 678 | 89.5 | glotblastn |
| 6102 | LYD378 cichorium\|gb171\|EH702760_T1 | 12305 | 678 | 89.5 | glotblastn |
| 6103 | LYD378 cotton\|10v2\|DW225932_T1 | 12306 | 678 | 89.5 | glotblastn |
| 6104 | LYD378 cyamopsis\|10v1\|EG976318_T1 | 12307 | 678 | 89.5 | glotblastn |
| 6105 | LYD378 dandelion\|10v1\|DR399897_T1 | 12308 | 678 | 89.5 | glotblastn |
| 6106 | LYD378 ipomoea_nil\|10v1\|CJ772812_T1 | 12309 | 678 | 89.5 | glotblastn |
| 6107 | LYD378 parthenium\|10v1\|GW779007_T1 | 12310 | 678 | 89.5 | glotblastn |
| 6108 | LYD378 ambrosia\|11v1\|SRR346935.11544_T1 | 12311 | 678 | 88.6 | glotblastn |
| 6109 | LYD378 cirsium\|11v1\|SRR346952.850956_T1 | 12312 | 678 | 88.6 | glotblastn |
| 6110 | LYD378 flaveria\|11v1\|SRR149229.100557_T1 | 12313 | 678 | 88.6 | glotblastn |
| 6111 | LYD378 flaveria\|11v1\|SRR149229.176667_T1 | 12314 | 678 | 88.6 | glotblastn |
| 6112 | LYD378 flaveria\|11v1\|SRR149232.107512_T1 | 12315 | 678 | 88.6 | glotblastn |
| 6113 | LYD378 flaveria\|11v1\|SRR149241.182232_T1 | 12316 | 678 | 88.6 | glotblastn |
| 6114 | LYD378 phalaenopsis\|11v1\|SRR125771.1215264_T1 | 12317 | 678 | 88.6 | glotblastn |
| 6115 | LYD378 sarracenia\|11v1\|SRR192669.100339_T1 | 12318 | 678 | 88.6 | glotblastn |
| 6116 | LYD378 apple\|gb171\|CN492192 | 12319 | 678 | 88.6 | glotblastn |
| 6117 | LYD378 basilicum\|10v1\|DY322324_T1 | 12320 | 678 | 88.6 | glotblastn |
| 6118 | LYD378 clover\|gb162\|BB904781_T1 | 12321 | 678 | 88.6 | glotblastn |
| 6119 | LYD378 curcuma\|10v1\|DY386249_T1 | 12322 | 678 | 88.6 | glotblastn |
| 6120 | LYD378 gerbera\|09v1\|AJ750690_T1 | 12323 | 678 | 88.6 | glotblastn |
| 6121 | LYD378 ginger\|gb164\|DY350120_T1 | 12324 | 678 | 88.6 | glotblastn |
| 6122 | LYD378 heritiera\|10v1\|SRR005795S0023609_T1 | 12325 | 678 | 88.6 | glotblastn |
| 6123 | LYD378 liquorice\|gb171\|FS272394_T1 | 12326 | 678 | 88.6 | glotblastn |
| 6124 | LYD378 papaya\|gb165\|EX243807_T1 | 12327 | 678 | 88.6 | glotblastn |
| 6125 | LYD378 peanut\|10v1\|GO262437_T1 | 12328 | 678 | 88.6 | glotblastn |
| 6126 | LYD378 pigeonpea\|10v1\|EE604807_T1 | 12329 | 678 | 88.6 | glotblastn |
| 6127 | LYD378 podocarpus\|10v1\|SRR065014S0417362_T1 | 12330 | 678 | 88.6 | glotblastn |
| 6128 | LYD378 senecio\|gb170\|DY663965 | 12331 | 678 | 88.6 | glotblastn |
| 6129 | LYD378 tamarix\|gb166\|EG969299 | 12332 | 678 | 88.6 | glotblastn |
| 6130 | LYD378 tragopogon\|10v1\|SRR020205S0007434 | 12333 | 678 | 88.6 | glotblastn |
| 6131 | LYD378 wheat\|10v2\|CK160708 | 12334 | 678 | 88.6 | glotblastn |
| 6132 | LYD378 flaveria\|11v1\|SRR149229.150147_T1 | 12335 | 678 | 87.7 | glotblastn |
| 6133 | LYD378 flaveria\|11v1\|SRR149232.334067_T1 | 12336 | 678 | 87.7 | glotblastn |
| 6134 | LYD378 flaveria\|11v1\|SRR149238.1735_T1 | 12337 | 678 | 87.7 | glotblastn |
| 6135 | LYD378 flaveria\|11v1\|SRR149238.209221_T1 | 12338 | 678 | 87.7 | glotblastn |
| 6136 | LYD378 fraxinus\|11v1\|SRR058827.140953_T1 | 12339 | 678 | 87.7 | glotblastn |
| 6137 | LYD378 phalaenopsis\|11v1\|SRR125771.1070254_T1 | 12340 | 678 | 87.7 | glotblastn |
| 6138 | LYD378 scabiosa\|11v1\|SRR063723X120394_T1 | 12341 | 678 | 87.7 | glotblastn |
| 6139 | LYD378 artemisia\|10v1\|SRR019254S0105821_T1 | 12342 | 678 | 87.7 | glotblastn |
| 6140 | LYD378 avocado\|10v1\|CK756491_T1 | 12343 | 678 | 87.7 | glotblastn |
| 6141 | LYD378 guizotia\|10v1\|GE561707_T1 | 12344 | 678 | 87.7 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6142 | LYD378 liriodendron\|gb166\|CK747315_T1 | 12345 | 678 | 87.7 | glotblastn |
| 6143 | LYD378 medicago\|09v1\|AW560377_T1 | 12346 | 678 | 87.7 | glotblastn |
| 6144 | LYD378 nuphar\|gb166\|CD474545_T1 | 12347 | 678 | 87.7 | glotblastn |
| 6145 | LYD378 pineapple\|10v1\|DT336930_T1 | 12348 | 678 | 87.7 | glotblastn |
| 6146 | LYD378 salvia\|10v1\|CV162297 | 12349 | 678 | 87.7 | glotblastn |
| 6147 | LYD378 sugarcane\|10v1\|BQ537086 | 12350 | 678 | 87.7 | glotblastn |
| 6148 | LYD378 flaveria\|11v1\|SRR149241.387648XX1_P1 | 12351 | 678 | 87.7 | globlastp |
| 6149 | LYD378 fagopyrum\|11v1\|SRR063689X145018_T1 | 12352 | 678 | 86.8 | glotblastn |
| 6150 | LYD378 fagopyrum\|11v1\|SRR063703X119654_T1 | 12353 | 678 | 86.8 | glotblastn |
| 6151 | LYD378 amaranthus\|10v1\|SRR039411S0004407_T1 | 12354 | 678 | 86.8 | glotblastn |
| 6152 | LYD378 cryptomeria\|gb166\|BP176209_T1 | 12355 | 678 | 86.8 | glotblastn |
| 6153 | LYD378 cynara\|gb167\|GE588994_T1 | 12356 | 678 | 86.8 | glotblastn |
| 6154 | LYD378 pigeonpea\|10v1\|GW353751_T1 | 12357 | 678 | 86.8 | glotblastn |
| 6155 | LYD378 pea\|11v1\|CD858828_T1 | 12358 | 678 | 86.8 | glotblastn |
| 6156 | LYD378 phalaenopsis\|11v1\|SRR125771.1019125_T1 | 12359 | 678 | 86.0 | glotblastn |
| 6157 | LYD378 banana\|10v1\|FF558128_T1 | 12360 | 678 | 86.0 | glotblastn |
| 6158 | LYD378 ipomoea_batatas\|10v1\|EE881828_T1 | 12361 | 678 | 86.0 | glotblastn |
| 6159 | LYD378 peanut\|10v1\|SRR042413S0012947_T1 | 12362 | 678 | 86.0 | glotblastn |
| 6160 | LYD378 canola\|11v1\|SRR341920.1055881_T1 | 12363 | 678 | 85.6 | glotblastn |
| 6161 | LYD378 phalaenopsis\|11v1\|SRR125771.1032981_T1 | 12364 | 678 | 85.1 | glotblastn |
| 6162 | LYD378 primula\|11v1\|SRR098679X131473_T1 | 12365 | 678 | 85.1 | glotblastn |
| 6163 | LYD378 pea\|09v1\|CD858828 | 12366 | 678 | 85.1 | glotblastn |
| 6164 | LYD378 potato\|10v1\|EG012661_P1 | 12367 | 678 | 84.8 | globlastp |
| 6165 | LYD378 flaveria\|11v1\|SRR149232.107286_T1 | 12368 | 678 | 84.2 | glotblastn |
| 6166 | LYD378 ginger\|gb164\|DY357331_T1 | 12369 | 678 | 84.2 | glotblastn |
| 6167 | LYD378 maize\|10v1\|AI714876_T1 | 12370 | 678 | 84.2 | glotblastn |
| 6168 | LYD378 parthenium\|10v1\|GW778444_T1 | 12371 | 678 | 84.2 | glotblastn |
| 6169 | LYD378 melon\|10v1\|VMEL00687014123493_P1 | 12372 | 678 | 83.9 | globlastp |
| 6170 | LYD378 ipomoea_nil\|10v1\|BJ567405_T1 | 12373 | 678 | 83.5 | glotblastn |
| 6171 | LYD378 primula\|11v1\|SRR098679X105050_T1 | 12374 | 678 | 83.3 | glotblastn |
| 6172 | LYD378 ginger\|gb164\|DY362679_T1 | 12375 | 678 | 83.3 | glotblastn |
| 6173 | LYD378 tobacco\|gb162\|AM794012 | 12376 | 678 | 83.3 | globlastp |
| 6174 | LYD378 cryptomeria\|gb166\|BW994348_P1 | 12377 | 678 | 82.9 | globlastp |
| 6175 | LYD378 zamia\|gb166\|FD766929 | 12378 | 678 | 82.5 | glotblastn |
| 6176 | LYD378 flaveria\|11v1\|SRR149232.149174_P1 | 12379 | 678 | 82.1 | globlastp |
| 6177 | LYD378 pine\|10v2\|SRR063935S0213665_T1 | 12380 | 678 | 82.1 | glotblastn |
| 6178 | LYD378 utricularia\|11v1\|SRR094438.100048_T1 | 12381 | 678 | 81.9 | glotblastn |
| 6179 | LYD378 potato\|10v1\|BG600955_P1 | 12382 | 678 | 81.6 | globlastp |
| 6180 | LYD378 utricularia\|11v1\|SRR094438.111220_T1 | 12383 | 678 | 81.6 | glotblastn |
| 6181 | LYD378 citrus\|gb166\|CD573955_T1 | 12384 | 678 | 81.6 | glotblastn |
| 6182 | LYD378 bean\|gb167\|CA900866_P1 | 12385 | 678 | 81.2 | globlastp |
| 6183 | LYD378 fraxinus\|11v1\|SRR058827.11107_P1 | 12386 | 678 | 81.1 | globlastp |
| 6184 | LYD378 petunia\|gb171\|FN020079_T1 | 12387 | 678 | 80.7 | glotblastn |
| 6185 | LYD380 cotton\|10v2\|SRR032367S0002872_T1 | 12388 | 679 | 99.2 | glotblastn |
| 6186 | LYD380 cacao\|10v1\|CU491446_T1 | 12389 | 679 | 81.7 | glotblastn |
| 6187 | LYD388 humulus\|11v1\|EX517382_T1 | 12390 | 681 | 92.2 | glotblastn |
| 6188 | LYD388 pigeonpea\|10v1\|GW358596_P1 | 12391 | 681 | 91.1 | globlastp |
| 6189 | LYD388 cleome_gynandra\|10v1\|SRR015532S0003375_T1 | 12392 | 681 | 90.7 | glotblastn |
| 6190 | LYD388 flaveria\|11v1\|SRR149229.128978_T1 | 12393 | 681 | 90.2 | glotblastn |
| 6191 | LYD388 ambrosia\|11v1\|SRR346935.596524_T1 | 12394 | 681 | 89.8 | glotblastn |
| 6192 | LYD388 vinca\|11v1\|SRR098690X10013_T1 | 12395 | 681 | 89.8 | glotblastn |
| 6193 | LYD388 amorphophallus\|11v2\|SRR089351X378857_T1 | 12396 | 681 | 89.7 | glotblastn |
| 6194 | LYD388 trigonella\|11v1\|SRR066198X1023993_T1 | 12397 | 681 | 89.7 | glotblastn |
| 6195 | LYD388 artemisia\|10v1\|EX980101_T1 | 12398 | 681 | 89.1 | glotblastn |
| 6196 | LYD388 guizotia\|10v1\|GE553532XX1_T1 | 12399 | 681 | 89.1 | glotblastn |
| 6197 | LYD388 potato\|10v1\|BE920935_T1 | 12400 | 681 | 89.1 | glotblastn |
| 6198 | LYD388 canola\|11v1\|CN827393_T1 | 12401 | 681 | 88.8 | glotblastn |
| 6199 | LYD388 canola\|10v1\|CD834527 | 12402 | 681 | 88.8 | glotblastn |
| 6200 | LYD388 solanum_phureja\|09v1\|SPHAA076677 | 12403 | 681 | 88.8 | glotblastn |
| 6201 | LYD388 flaveria\|11v1\|SRR149238.109365_T1 | 12404 | 681 | 88.4 | glotblastn |
| 6202 | LYD388 monkeyflower\|10v1\|CV520668_T1 | 12405 | 681 | 88.4 | glotblastn |
| 6203 | LYD388 ambrosia\|11v1\|SRR346943.116737_T1 | 12406 | 681 | 88.3 | glotblastn |
| 6204 | LYD388 plantago\|11v1\|SRR066373X107163_T1 | 12407 | 681 | 88.1 | glotblastn |
| 6205 | LYD388 tragopogon\|10v1\|SRR020205S0029741 | 12408 | 681 | 87.9 | glotblastn |
| 6206 | LYD388 sorghum\|09v1\|SB06G023840 | 12409 | 681 | 87.5 | glotblastn |
| 6207 | LYD388 rice\|gb170\|OS04G45490 | 12410 | 681 | 86.8 | glotblastn |
| 6208 | LYD388 ambrosia\|11v1\|SRR346935.149001_P1 | 12411 | 681 | 86.8 | globlastp |
| 6209 | LYD388 apple\|gb171\|CN926018 | 12412 | 681 | 86.8 | globlastp |
| 6210 | LYD388 coffea\|10v1\|DV665919_P1 | 12413 | 681 | 86.7 | globlastp |
| 6211 | LYD388 maritime_pine\|10v1\|BX252770_T1 | 12414 | 681 | 86.6 | glotblastn |
| 6212 | LYD388 pine\|10v2\|BI076874_T1 | 12415 | 681 | 86.6 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6213 | LYD388 podocarpus\|10v1\|SRR065014S0001282_T1 | 12416 | 681 | 86.3 | glotblastn |
| 6214 | LYD388 sequoia\|10v1\|SRR065044S0000715 | 12417 | 681 | 86.3 | glotblastn |
| 6215 | LYD388 foxtail_millet\|10v2\|SICRP000634 | 12418 | 681 | 86.1 | glotblastn |
| 6216 | LYD388 pseudotsuga\|10v1\|SRR065119S0041143 | 12419 | 681 | 86.1 | glotblastn |
| 6217 | LYD388 barley\|10v2\|AJ234426_T1 | 12420 | 681 | 85.9 | glotblastn |
| 6218 | LYD388 distylium\|11v1\|SRR065077X106569XX1_T1 | 12421 | 681 | 85.7 | glotblastn |
| 6219 | LYD388 flaveria\|11v1\|SRR149238.152316_P1 | 12422 | 681 | 85.6 | globlastp |
| 6220 | LYD388 fescue\|gb161\|DT679668_T1 | 12423 | 681 | 85.2 | glotblastn |
| 6221 | LYD388 flaveria\|11v1\|SRR149232.111649_P1 | 12424 | 681 | 85.2 | globlastp |
| 6222 | LYD388 brachypodium\|09v1\|DV482284_T1 | 12425 | 681 | 85.2 | glotblastn |
| 6223 | LYD388 oat\|10v2\|1CN821648 | 12426 | 681 | 85.1 | glotblastn |
| 6224 | LYD388 oat\|11v1\|CN821648_T1 | 12426 | 681 | 85.1 | glotblastn |
| 6225 | LYD388 pteridium\|11v1\|SRR043594X102160_T1 | 12427 | 681 | 85.0 | glotblastn |
| 6226 | LYD388 taxus\|10v1\|SRR032523S0000086 | 12428 | 681 | 85.0 | glotblastn |
| 6227 | LYD388 millet\|10v1\|EVO454PM008349_P1 | 12429 | 681 | 84.5 | globlastp |
| 6228 | LYD388 peanut\|10v1\|GO260070_T1 | 12430 | 681 | 84.5 | glotblastn |
| 6229 | LYD388 euonymus\|11v1\|SRR070038X117654_P1 | 12431 | 681 | 84.1 | globlastp |
| 6230 | LYD388 curcuma\|10v1\|DY385673_P1 | 12432 | 681 | 82.6 | globlastp |
| 6231 | LYD388 flaveria\|11v1\|SRR149239.26158_P1 | 12433 | 681 | 81.6 | globlastp |
| 6232 | LYD388 cynara\|gb167\|GE579498_T1 | 12434 | 681 | 80.9 | glotblastn |
| 6233 | LYD388 physcomitrella\|10v1\|BJ158900_T1 | 12435 | 681 | 80.9 | glotblastn |
| 6234 | LYD388 ceratodon\|10v1\|SRR074890S0014010_T1 | 12436 | 681 | 80.8 | glotblastn |
| 6235 | LYD388 grape\|gb160\|BM436915 | 12437 | 681 | 80.4 | globlastp |
| 6236 | LYD388 spikemoss\|gb165\|DN837773 | 12438 | 681 | 80.2 | glotblastn |
| 6237 | LYD388 flaveria\|11v1\|SRR149229.39858_T1 | 12439 | 681 | 80.0 | glotblastn |
| 6238 | LYD388 spikemoss\|gb165\|FE429926 | 12440 | 681 | 80.0 | glotblastn |
| 6239 | LYD388 citrus\|gb166\|CK701311_P1 | 12441 | 681 | 80.0 | globlastp |
| 6240 | LYD390 cotton\|10v2\|ES812723_P1 | 12442 | 682 | 98.3 | globlastp |
| 6241 | LYD390 cotton\|10v2\|DT564392_P1 | 12443 | 682 | 95.8 | globlastp |
| 6242 | LYD390 cacao\|10v1\|CU487646_T1 | 12444 | 682 | 80.0 | glotblastn |
| 6243 | LYD413 lotus\|09v1\|CRPLJ038657_P1 | 12445 | 683 | 87.7 | globlastp |
| 6244 | LYD417 soybean\|11v1\|GLYMA05G27020 | 12446 | 684 | 83.2 | glotblastn |
| 6245 | LYD421 medicago\|09v1\|CRPMT001820_T1 | 12447 | 686 | 83.7 | glotblastn |
| 6246 | LYD421 medicago\|09v1\|CRPMT001893_T1 | 12448 | 686 | 83.3 | glotblastn |
| 6247 | LYD422 medicago\|09v1\|BI272042_P1 | 12449 | 687 | 94.9 | globlastp |
| 6248 | LYD422 pigeonpea\|10v1\|SRR054580S0024854_P1 | 12450 | 687 | 88.4 | globlastp |
| 6249 | LYD422 soybean\|11v1\|GLYMA11G25900 | 12451 | 687 | 88.1 | globlastp |
| 6250 | LYD422 cacao\|10v1\|CU480709_P1 | 12452 | 687 | 87.0 | globlastp |
| 6251 | LYD422 cotton\|10v2\|SRR032367S0551343_P1 | 12453 | 687 | 86.7 | globlastp |
| 6252 | LYD422 castorbean\|09v1\|EG685203 | 12454 | 687 | 86.7 | glotblastn |
| 6253 | LYD422 castorbean\|11v1\|EG685203_T1 | 12454 | 687 | 86.7 | glotblastn |
| 6254 | LYD422 chelidonium\|11v1\|SRR084752X100074_T1 | 12455 | 687 | 86.5 | glotblastn |
| 6255 | LYD422 euphorbia\|11v1\|DV150044_T1 | 12456 | 687 | 86.1 | glotblastn |
| 6256 | LYD422 strawberry\|11v1\|DY671101 | 12457 | 687 | 85.2 | glotblastn |
| 6257 | LYD422 strawberry\|11v1\|EX683910 | 12458 | 687 | 85.2 | glotblastn |
| 6258 | LYD422 catharanthus\|11v1\|SRR098691X106789_T1 | 12459 | 687 | 85.0 | glotblastn |
| 6259 | LYD422 oak\|10v1\|FN730816XX1_T1 | 12460 | 687 | 84.6 | glotblastn |
| 6260 | LYD422 prunus\|10v1\|CN491996 | 12461 | 687 | 84.6 | glotblastn |
| 6261 | LYD422 cassava\|09v1\|JGICASSAVA36468VALIDM1_P1 | 12462 | 687 | 84.6 | globlastp |
| 6262 | LYD422 cucumber\|09v1\|GO897466_P1 | 12463 | 687 | 84.6 | globlastp |
| 6263 | LYD422 vinca\|11v1\|SRR098690X102682_T1 | 12464 | 687 | 84.6 | glotblastn |
| 6264 | LYD422 tobacco\|gb162\|AF321497 | 12465 | 687 | 84.2 | glotblastn |
| 6265 | LYD422 clementine\|11v1\|CF828807_P1 | 12466 | 687 | 84.1 | globlastp |
| 6266 | LYD422 cannabis\|12v1\|EW701745_P1 | 12467 | 687 | 83.9 | globlastp |
| 6267 | LYD422 eucalyptus\|11v2\|SRR001659X101835_T1 | 12468 | 687 | 83.8 | glotblastn |
| 6268 | LYD422 thellungiella_halophilum\|11v1\|EHJGI11000600_P1 | 12469 | 687 | 83.7 | globlastp |
| 6269 | LYD422 cirsium\|11v1\|SRR346952.259146_T1 | 12470 | 687 | 83.7 | glotblastn |
| 6270 | LYD422 orange\|11v1\|CF828807_P1 | 12471 | 687 | 83.6 | globlastp |
| 6271 | LYD422 spurge\|gb161\|DV150044 | 12472 | 687 | 83.6 | globlastp |
| 6272 | LYD422 ambrosia\|11v1\|SRR346935.142175_T1 | 12473 | 687 | 83.5 | glotblastn |
| 6273 | LYD422 flaveria\|11v1\|SRR149229.127874_T1 | 12474 | 687 | 83.5 | glotblastn |
| 6274 | LYD422 eucalyptus\|11v2\|CT988193_T1 | 12475 | 687 | 83.3 | glotblastn |
| 6275 | LYD422 arabidopsis\|10v1\|AT2G35040_P1 | 12476 | 687 | 83.1 | globlastp |
| 6276 | LYD422 canola\|10v1\|CD812941 | 12477 | 687 | 83.1 | globlastp |
| 6277 | LYD422 poplar\|10v1\|BI069324_P1 | 12478 | 687 | 83.1 | globlastp |
| 6278 | LYD422 ambrosia\|11v1\|SRR346935.103685_T1 | 12479 | 687 | 83.1 | glotblastn |
| 6279 | LYD422 ambrosia\|11v1\|SRR346935.490751_T1 | 12480 | 687 | 83.1 | glotblastn |
| 6280 | LYD422 citrus\|gb166\|CF828807_P1 | 12481 | 687 | 83.0 | globlastp |
| 6281 | LYD422 canola\|11v1\|EE551702_P1 | 12482 | 687 | 82.9 | globlastp |
| 6282 | LYD422 sunflower\|10v1\|CD853207 | 12483 | 687 | 82.7 | glotblastn |
| 6283 | LYD422 monkeyflower\|10v1\|GO949859_T1 | 12484 | 687 | 82.5 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6284 | LYD422 tomato\|11v1\|AF321497_P1 | 12485 | 687 | 82.5 | globlastp |
| 6285 | LYD422 tomato\|09v1\|BG643048 | 12486 | 687 | 82.5 | globlastp |
| 6286 | LYD422 artemisia\|10v1\|EY033767_T1 | 12487 | 687 | 82.5 | glotblastn |
| 6287 | LYD422 aristolochia\|10v1\|FD758333_P1 | 12488 | 687 | 82.3 | globlastp |
| 6288 | LYD422 solanum_phureja\|09v1\|SPHBG643048 | 12489 | 687 | 82.3 | globlastp |
| 6289 | LYD422 nasturtium\|10v1\|SRR032558S0022711 | 12490 | 687 | 82.2 | globlastp |
| 6290 | LYD422 amorphophallus\|11v2\|SRR089351X225812_T1 | 12491 | 687 | 82.0 | glotblastn |
| 6291 | LYD422 arabidopsis_lyrata\|09v1\|JGIAL014637_P1 | 12492 | 687 | 81.7 | globlastp |
| 6292 | LYD422 brachypodium\|09v1\|SRR031795S0012272_T1 | 12493 | 687 | 81.2 | glotblastn |
| 6293 | LYD422 flaveria\|11v1\|SRR149229.98719_T1 | 12494 | 687 | 81.1 | glotblastn |
| 6294 | LYD422 canola\|11v1\|DY020098_T1 | 12495 | 687 | 81.1 | glotblastn |
| 6295 | LYD422 foxtail_millet\|11v3\|PHY7SI013439M_T1 | 12496 | 687 | 81.1 | glotblastn |
| 6296 | LYD422 rice\|gb170\|OS08G10570 | 12497 | 687 | 81.1 | glotblastn |
| 6297 | LYD422 triphysaria\|10v1\|EY149036 | 12498 | 687 | 81.0 | globlastp |
| 6298 | LYD422 flaveria\|11v1\|SRR149229.11675_T1 | 12499 | 687 | 80.9 | glotblastn |
| 6299 | LYD422 flaveria\|11v1\|SRR149232.127123_T1 | 12500 | 687 | 80.9 | glotblastn |
| 6300 | LYD422 wheat\|10v2\|BM136889 | 12501 | 687 | 80.9 | globlastp |
| 6301 | LYD422 silene\|11v1\|SRR096785X103903_T1 | 12502 | 687 | 80.8 | glotblastn |
| 6302 | LYD422 valeriana\|11v1\|SRR099039X123791_P1 | 12503 | 687 | 80.0 | globlastp |
| 6303 | LYD431 foxtail_millet\|11v3\|PHY7SI025920M_P1 | 12504 | 688 | 86.1 | globlastp |
| 6304 | LYD434 maize\|10v1\|AI737158_P1 | 12505 | 689 | 89.8 | globlastp |
| 6305 | LYD434 foxtail_millet\|11v3\|SOLX00024471_T1 | 12506 | 689 | 87.0 | glotblastn |
| 6306 | LYD434 foxtail_millet\|11v3\|PHY7SI013394M_P1 | 12507 | 689 | 86.8 | globlastp |
| 6307 | LYD443 soybean\|11v1\|GLYMA06G13820 | 12508 | 690 | 97.5 | globlastp |
| 6308 | LYD443 pigeonpea\|10v1\|SRR054580S0026699_P1 | 12509 | 690 | 90.8 | globlastp |
| 6309 | LYD443 medicago\|09v1\|BE240322_P1 | 12510 | 690 | 85.7 | globlastp |
| 6310 | LYD443 prunus\|10v1\|CO865636 | 12511 | 690 | 84.3 | globlastp |
| 6311 | LYD443 cacao\|10v1\|CF974602_P1 | 12512 | 690 | 82.8 | globlastp |
| 6312 | LYD443 cotton\|10v2\|SRR032367S0031308_P1 | 12513 | 690 | 82.0 | globlastp |
| 6313 | LYD443 cassava\|09v1\|CK644353_P1 | 12514 | 690 | 81.8 | globlastp |
| 6314 | LYD443 cotton\|10v2\|SRR032367S0198758_T1 | 12515 | 690 | 81.5 | globlastn |
| 6315 | LYD443 cassava\|09v1\|DV441944_P1 | 12516 | 690 | 81.5 | globlastp |
| 6316 | LYD443 citrus\|gb166\|CK938806_T1 | 12517 | 690 | 81.1 | glotblastn |
| 6317 | LYD443 apple\|11v1\|CO865636_P 1 | 12518 | 690 | 80.9 | globlastp |
| 6318 | LYD443 clementine\|11v1\|CK938806_P1 | 12519 | 690 | 80.9 | globlastp |
| 6319 | LYD443 poplar\|10v1\|CK109402_P1 | 12520 | 690 | 80.9 | globlastp |
| 6320 | LYD443 orange\|11v1\|CK938806_P1 | 12521 | 690 | 80.5 | globlastp |
| 6321 | LYD443 castorbean\|09v1\|EG662900 | 12522 | 690 | 80.4 | globlastp |
| 6322 | LYD443 castorbean\|11v1\|EG662900_P1 | 12522 | 690 | 80.4 | globlastp |
| 6323 | LYD443 cannabis\|12v1\|SOLX00049073_P1 | 12523 | 690 | 80.0 | globlastp |
| 6324 | LYD471 lotus\|09v1\|LLBP036021_P1 | 12524 | 695 | 82.9 | globlastp |
| 6325 | LYD471 soybean\|11v1\|GLYMA10G44120 | 12525 | 695 | 80.9 | glotblastn |
| 6326 | LYD483 solanum_phureja\|09v1\|SPHAW738746 | 12526 | 696 | 97.3 | globlastp |
| 6327 | LYD495 foxtail_millet\|10v2\|FXTRMSLX01800514D2 | 12527 | 697 | 89.3 | glotblastn |
| 6328 | LYD495 amorphophallus\|11v2\|SRR089351X278786_T1 | 12528 | 697 | 81.5 | glotblastn |
| 6329 | LYD495 phyla\|11v2\|SRR099035X167958_T1 | 12529 | 697 | 80.5 | glotblastn |
| 6330 | LYD495 eucalyptus\|11v2\|CT980391_T1 | 12530 | 697 | 80.1 | glotblastn |
| 6331 | LYD497 thellungiella_parvulum\|11v1\|DN775488_T1 | 12531 | 698 | 97.7 | glotblastn |
| 6332 | LYD497 cleome_spinosa\|10v1\|SRR015531S0003837_T1 | 12532 | 698 | 87.6 | glotblastn |
| 6333 | LYD497 canola\|11v1\|EE459144_T1 | 12533 | 698 | 87.4 | glotblastn |
| 6334 | LYD497 b_juncea\|10v2\|OXBJ1SLX00004191T1_P1 | 12534 | 698 | 85.2 | globlastp |
| 6335 | LYD497 b_rapa\|gb162\|CO749785_P1 | 12535 | 698 | 84.7 | globlastp |
| 6336 | LYD497 radish\|gb164\|EW713571 | 12536 | 698 | 84.7 | globlastp |
| 6337 | LYD497 amaranthus\|10v1\|SRR039411S0007706_T1 | 12537 | 698 | 84.0 | glotblastn |
| 6338 | LYD497 plantago\|11v1\|SRR066373X103636_T1 | 12538 | 698 | 82.8 | glotblastn |
| 6339 | LYD497 radish\|gb164\|EV535512 | 12539 | 698 | 82.8 | globlastp |
| 6340 | LYD497 cotton\|10v2\|BG444106_T1 | 12540 | 698 | 82.4 | glotblastn |
| 6341 | LYD497 pigeonpea\|10v1\|GW352224_T1 | 12541 | 698 | 82.4 | glotblastn |
| 6342 | LYD497 vinca\|11v1\|SRR098690X102660_T1 | 12542 | 698 | 82.1 | glotblastn |
| 6343 | LYD497 tragopogon\|10v1\|SRR02020550003738 | 12543 | 698 | 82.1 | glotblastn |
| 6344 | LYD497 eschscholzia\|10v1\|CD480606 | 12544 | 698 | 81.7 | glotblastn |
| 6345 | LYD497 fagopyrum\|11v1\|SRR063689X100147_T1 | 12545 | 698 | 81.3 | glotblastn |
| 6346 | LYD497 basilicum\|10v1\|DY323579_T1 | 12546 | 698 | 81.2 | glotblastn |
| 6347 | LYD497 cucurbita\|11v1\|SRR091276X101255_T1 | 12547 | 698 | 80.9 | glotblastn |
| 6348 | LYD497 fagopyrum\|11v1\|SRR063689X22962_T1 | 12548 | 698 | 80.9 | glotblastn |
| 6349 | LYD497 phalaenopsis\|11v1\|SRR125771.1096697_T1 | 12549 | 698 | 80.9 | glotblastn |
| 6350 | LYD497 fraxinus\|11v1\|SRR058827.107168_T1 | 12550 | 698 | 80.8 | glotblastn |
| 6351 | LYD497 cucumber\|09v1\|DN910339_T1 | 12551 | 698 | 80.8 | glotblastn |
| 6352 | LYD497 b_juncea\|10v2\|E6ANDIZ01AHCYX_P1 | 12552 | 698 | 80.8 | globlastp |
| 6353 | LYD497 cleome_spinosa\|10v1\|SRR015531S0006483_T1 | 12553 | 698 | 80.5 | glotblastn |
| 6354 | LYD497 flaveria\|11v1\|SRR149232.8223_T1 | 12554 | 698 | 80.5 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6355 | LYD497 platanus\|11v1\|SRR096786X127261_T1 | 12555 | 698 | 80.5 | glotblastn |
| 6356 | LYD497 basilicum\|10v1\|DY322340_P1 | 12556 | 698 | 80.2 | globlastp |
| 6357 | LYD497 sunflower\|10v1\|BQ980037 | 12557 | 698 | 80.2 | globlastp |
| 6358 | LYD497 ambrosia\|11v1\|SRR346935.124626_T1 | 12558 | 698 | 80.2 | glotblastn |
| 6359 | LYD497 sunflower\|10v1\|BQ970741 | 12559 | 698 | 80.2 | glotblastn |
| 6360 | LYD497 arnica\|11v1\|SRR099034X111067_T1 | 12560 | 698 | 80.1 | glotblastn |
| 6361 | LYD497 cucurbita\|11v1\|SRR091276X109788_T1 | 12561 | 698 | 80.1 | glotblastn |
| 6362 | LYD497 centaurea\|gb166\|EH764932_T1 | 12562 | 698 | 80.1 | glotblastn |
| 6363 | LYD497 cichorium\|gb171\|EH692983_T1 | 12563 | 698 | 80.1 | glotblastn |
| 6364 | LYD497 ginger\|gb164\|DY346584_T1 | 12564 | 698 | 80.1 | glotblastn |
| 6365 | LYD499 canola\|11v1\|EE483676XX1_T1 | 12565 | 699 | 100.0 | glotblastn |
| 6366 | LYD499 b_juncea\|10v2\|BJ1SLX01127239D1 | 12566 | 699 | 85.4 | globlastp |
| 6367 | LYD499 b_juncea\|10v2\|E6ANDIZ01BEK7Q_T1 | 12567 | 699 | 82.1 | glotblastn |
| 6368 | LYD499 arabidopsis\|10v1\|CF773067_T1 | 12568 | 699 | 80.4 | glotblastn |
| 6369 | LYD500 b_rapa\|gb162\|BG544497_T1 | 12569 | 700 | 98.3 | glotblastn |
| 6370 | LYD500 canola\|11v1\|SRR341920.426223_T1 | 12570 | 700 | 89.7 | glotblastn |
| 6371 | LYD500 radish\|gb164\|EW714765 | 12571 | 700 | 89.7 | glotblastn |
| 6372 | LYD500 b_juncea\|10v2\|E6ANDIZ01CDXEZ | 12572 | 700 | 81.4 | glotblastn |
| 6373 | LYD500 b_nigra\|09v1\|GT069886 | 12573 | 700 | 81.4 | glotblastn |
| 6374 | LYD501 canola\|11v1\|SRR019556.29036_T1 | 12574 | 701 | 98.2 | glotblastn |
| 6375 | LYD501 canola\|11v1\|EV042598_T1 | 12575 | 701 | 98.2 | glotblastn |
| 6376 | LYD501 b_juncea\|10v2\|E6ANDIZ01D8S9B_T1 | 12576 | 701 | 97.3 | glotblastn |
| 6377 | LYD501 canola\|11v1\|GR440571XX1_T1 | 12577 | 701 | 96.4 | glotblastn |
| 6378 | LYD501 b_rapa\|gb162\|CO750244_T1 | 12578 | 701 | 96.4 | glotblastn |
| 6379 | LYD501 thellungiella\|gb167\|DN774406 | 12579 | 701 | 96.4 | glotblastn |
| 6380 | LYD501 sarracenia\|11v1\|SRR192669.117763_P1 | 12580 | 701 | 96.4 | globlastp |
| 6381 | LYD501 chelidonium\|11v1\|SRR084752X101765_T1 | 12581 | 701 | 95.6 | glotblastn |
| 6382 | LYD501 euonymus\|11v1\|SRR070038X11091_T1 | 12582 | 701 | 95.5 | glotblastn |
| 6383 | LYD501 tripterygium\|11v1\|SRR098677X110151_T1 | 12583 | 701 | 95.5 | glotblastn |
| 6384 | LYD501 cleome_spinosa\|10v1\|SRR015531S0001215_T1 | 12584 | 701 | 95.5 | glotblastn |
| 6385 | LYD501 melon\|10v1\|AM720686_T1 | 12585 | 701 | 95.5 | glotblastn |
| 6386 | LYD501 nasturtium\|10v1\|SRR032558S0027189 | 12586 | 701 | 95.5 | glotblastn |
| 6387 | LYD501 pigeonpea\|10v1\|GR464364_T1 | 12587 | 701 | 95.5 | glotblastn |
| 6388 | LYD501 cucurbita\|11v1\|SRR091276X220982_T1 | 12588 | 701 | 94.7 | glotblastn |
| 6389 | LYD501 cannabis\|12v1\|JK500263_T1 | 12589 | 701 | 94.6 | glotblastn |
| 6390 | LYD501 canola\|11v1\|SRR329674.174616_T1 | 12590 | 701 | 94.6 | glotblastn |
| 6391 | LYD501 euonymus\|11v1\|SRR070038X133733_T1 | 12591 | 701 | 94.6 | glotblastn |
| 6392 | LYD501 euonymus\|11v1\|SRR070038X357738_T1 | 12592 | 701 | 94.6 | glotblastn |
| 6393 | LYD501 flaveria\|11v1\|SRR149229.58197_T1 | 12593 | 701 | 94.6 | glotblastn |
| 6394 | LYD501 sarracenia\|11v1\|SRR192669.313482_T1 | 12594 | 701 | 94.6 | glotblastn |
| 6395 | LYD501 trigonella\|11v1\|SRR066194X123747_T1 | 12595 | 701 | 94.6 | glotblastn |
| 6396 | LYD501 watermelon\|11v1\|AM720686_T1 | 12596 | 701 | 94.6 | glotblastn |
| 6397 | LYD501 cacao\|10v1\|CU475870_T1 | 12597 | 701 | 94.6 | glotblastn |
| 6398 | LYD501 cassava\|09v1\|DV444116_T1 | 12598 | 701 | 94.6 | glotblastn |
| 6399 | LYD501 castorbean\|09v1\|EE256028 | 12599 | 701 | 94.6 | glotblastn |
| 6400 | LYD501 castorbean\|11v1\|EE256028_T1 | 12599 | 701 | 94.6 | glotblastn |
| 6401 | LYD501 chestnut\|gb170\|SRR006295S0014001_T1 | 12600 | 701 | 94.6 | glotblastn |
| 6402 | LYD501 cucumber\|09v1\|AM720686_T1 | 12601 | 701 | 94.6 | glotblastn |
| 6403 | LYD501 kiwi\|gb166\|FG408237_T1 | 12602 | 701 | 94.6 | glotblastn |
| 6404 | LYD501 oak\|10v1\|FP032780_T1 | 12603 | 701 | 94.6 | glotblastn |
| 6405 | LYD501 peanut\|10v1\|CD037954_T1 | 12604 | 701 | 94.6 | glotblastn |
| 6406 | LYD501 watermelon\|11v1\|AM718583_T1 | 12605 | 701 | 93.9 | glotblastn |
| 6407 | LYD501 avocado\|10v1\|CK765173_T1 | 12606 | 701 | 93.9 | glotblastn |
| 6408 | LYD501 melon\|10v1\|AM718583_T1 | 12607 | 701 | 93.9 | glotblastn |
| 6409 | LYD501 clementine\|11v1\|CK739989_T1 | 12608 | 701 | 93.8 | glotblastn |
| 6410 | LYD501 flax\|11v1\|JG020349_T1 | 12609 | 701 | 93.8 | glotblastn |
| 6411 | LYD501 orange\|11v1\|CK739989_T1 | 12610 | 701 | 93.8 | glotblastn |
| 6412 | LYD501 citrus\|gb166\|CK739989_T1 | 12608 | 701 | 93.8 | glotblastn |
| 6413 | LYD501 ambrosia\|11v1\|SRR346935.113008_T1 | 12611 | 701 | 93.8 | glotblastn |
| 6414 | LYD501 ambrosia\|11v1\|SRR346935.170141_T1 | 12612 | 701 | 93.8 | glotblastn |
| 6415 | LYD501 ambrosia\|11v1\|SRR346935.290744_T1 | 12613 | 701 | 93.8 | glotblastn |
| 6416 | LYD501 flaveria\|11v1\|SRR149229.122354_T1 | 12614 | 701 | 93.8 | glotblastn |
| 6417 | LYD501 flaveria\|11v1\|SRR149229.189966_T1 | 12615 | 701 | 93.8 | glotblastn |
| 6418 | LYD501 utricularia\|11v1\|SRR094438.103084_T1 | 12616 | 701 | 93.8 | glotblastn |
| 6419 | LYD501 cassava\|09v1\|JGICASSAVA29016VALIDM1_T1 | 12617 | 701 | 93.8 | glotblastn |
| 6420 | LYD501 cotton\|10v2\|BG444156_T1 | 12618 | 701 | 93.8 | glotblastn |
| 6421 | LYD501 grape\|11v1\|GSVIVT01013564001_T1 | 12619 | 701 | 93.8 | glotblastn |
| 6422 | LYD501 grape\|gb160\|CB912485 | 12619 | 701 | 93.8 | glotblastn |
| 6423 | LYD501 ipomoea_nil\|10v1\|BJ567033_T1 | 12620 | 701 | 93.8 | glotblastn |
| 6424 | LYD501 poplar\|10v1\|BU897763_T1 | 12621 | 701 | 93.8 | glotblastn |
| 6425 | LYD501 senecio\|gb170\|DY661628 | 12622 | 701 | 93.8 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6426 | LYD501 sunflower\|10v1\|DY920668 | 12623 | 701 | 93.8 | glotblastn |
| 6427 | LYD501 sunflower\|10v1\|DY950267 | 12624 | 701 | 93.8 | glotblastn |
| 6428 | LYD501 ambrosia\|11v1\|SRR346935.166952_T1 | 12625 | 701 | 93.0 | glotblastn |
| 6429 | LYD501 flax\|11v1\|JG018486_T1 | 12626 | 701 | 93.0 | glotblastn |
| 6430 | LYD501 flax\|11v1\|JG083961_T1 | 12627 | 701 | 93.0 | glotblastn |
| 6431 | LYD501 nasturtium\|10v1\|SRR032558S0048292 | 12628 | 701 | 93.0 | glotblastn |
| 6432 | LYD501 cucumber\|09v1\|AM718583_T1 | 12629 | 701 | 93.0 | glotblastn |
| 6433 | LYD501 ambrosia\|11v1\|SRR346935.139527_T1 | 12630 | 701 | 92.9 | glotblastn |
| 6434 | LYD501 ambrosia\|11v1\|SRR346935.186669_T1 | 12631 | 701 | 92.9 | glotblastn |
| 6435 | LYD501 arnica\|11v1\|SRR099034X105547_T1 | 12632 | 701 | 92.9 | glotblastn |
| 6436 | LYD501 arnica\|11v1\|SRR099034X111519_T1 | 12633 | 701 | 92.9 | glotblastn |
| 6437 | LYD501 cirsium\|11v1\|SRR346952.118661_T1 | 12634 | 701 | 92.9 | glotblastn |
| 6438 | LYD501 flaveria\|11v1\|SRR149229.108020_T1 | 12635 | 701 | 92.9 | glotblastn |
| 6439 | LYD501 flaveria\|11v1\|SRR149232.120060_T1 | 12636 | 701 | 92.9 | glotblastn |
| 6440 | LYD501 phyla\|11v2\|SRR099035X12762_T1 | 12637 | 701 | 92.9 | glotblastn |
| 6441 | LYD501 scabiosa\|11v1\|SRR063723X229337_T1 | 12638 | 701 | 92.9 | glotblastn |
| 6442 | LYD501 thalictrum\|11v1\|SRR096787X109593_T1 | 12639 | 701 | 92.9 | glotblastn |
| 6443 | LYD501 aquilegia\|10v2\|DR913203_T1 | 12640 | 701 | 92.9 | glotblastn |
| 6444 | LYD501 artemisia\|10v1\|EY079109_T1 | 12641 | 701 | 92.9 | glotblastn |
| 6445 | LYD501 artemisia\|10v1\|EY100637_T1 | 12642 | 701 | 92.9 | glotblastn |
| 6446 | LYD501 tragopogon\|10v1\|SRR020205S0031906 | 12643 | 701 | 92.9 | glotblastn |
| 6447 | LYD501 poplar\|10v1\|BU889708_T1 | 12644 | 701 | 92.2 | glotblastn |
| 6448 | LYD501 cucurbita\|11v1\|SRR091276X12184_T1 | 12645 | 701 | 92.1 | glotblastn |
| 6449 | LYD501 cucurbita\|11v1\|SRR091276X18592_T1 | 12646 | 701 | 92.1 | glotblastn |
| 6450 | LYD501 momordica\|10v1\|SRR071315S0000463_T1 | 12647 | 701 | 92.1 | glotblastn |
| 6451 | LYD501 cotton\|10v2\|BQ411378_T1 | 12648 | 701 | 92.0 | glotblastn |
| 6452 | LYD501 prunus\|10v1\|BU044562 | 12649 | 701 | 92.0 | glotblastn |
| 6453 | LYD501 ambrosia\|11v1\|SRR346935.142048_T1 | 12650 | 701 | 92.0 | glotblastn |
| 6454 | LYD501 canola\|11v1\|CN830272_T1 | 12651 | 701 | 92.0 | glotblastn |
| 6455 | LYD501 distylium\|11v1\|SRR065077X105467_T1 | 12652 | 701 | 92.0 | glotblastn |
| 6456 | LYD501 euphorbia\|11v1\|DV130999_T1 | 12653 | 701 | 92.0 | glotblastn |
| 6457 | LYD501 silene\|11v1\|SRR096785X113387_T1 | 12654 | 701 | 92.0 | glotblastn |
| 6458 | LYD501 thellungiella_halophilum\|11v1\|DN778619_T1 | 12655 | 701 | 92.0 | glotblastn |
| 6459 | LYD501 thellungiella_parvulum\|11v1\|DN778619_T1 | 12656 | 701 | 92.0 | glotblastn |
| 6460 | LYD501 valeriana\|11v1\|SRR099039X101707_T1 | 12657 | 701 | 92.0 | glotblastn |
| 6461 | LYD501 arabidopsis_lyrata\|09v1\|JGIAL019224_T1 | 12658 | 701 | 92.0 | glotblastn |
| 6462 | LYD501 arabidopsis\|10v1\|AT3G59350_T1 | 12659 | 701 | 92.0 | glotblastn |
| 6463 | LYD501 b_juncea\|10v2\|E6ANDIZ01C52SG_T1 | 12660 | 701 | 92.0 | glotblastn |
| 6464 | LYD501 b_juncea\|10v2\|E6ANDIZ02F8URY_T1 | 12661 | 701 | 92.0 | glotblastn |
| 6465 | LYD501 canola\|10v1\|CN830272 | 12662 | 701 | 92.0 | glotblastn |
| 6466 | LYD501 cichorium\|gb171\|EH678966_T1 | 12663 | 701 | 92.0 | glotblastn |
| 6467 | LYD501 cycas\|gb166\|EX922507_T1 | 12664 | 701 | 92.0 | glotblastn |
| 6468 | LYD501 lettuce\|10v1\|DW055970_T1 | 12665 | 701 | 92.0 | glotblastn |
| 6469 | LYD501 sciadopitys\|10v1\|SRR065035S0010378 | 12666 | 701 | 92.0 | glotblastn |
| 6470 | LYD501 sequoia\|10v1\|SRR065044S0020248 | 12667 | 701 | 92.0 | glotblastn |
| 6471 | LYD501 triphysaria\|10v1\|BM356608 | 12668 | 701 | 92.0 | glotblastn |
| 6472 | LYD501 cirsium\|11v1\|SRR346952.1009668_T1 | 12669 | 701 | 91.4 | glotblastn |
| 6473 | LYD501 cirsium\|11v1\|SRR346952.1035158_T1 | 12670 | 701 | 91.2 | glotblastn |
| 6474 | LYD501 plantago\|11v1\|SRR066373X108282_T1 | 12671 | 701 | 91.2 | glotblastn |
| 6475 | LYD501 cucurbita\|11v1\|SRR091276X219804_P1 | 12672 | 701 | 91.1 | globlastp |
| 6476 | LYD501 flaveria\|11v1\|SRR149229.33632_T1 | 12673 | 701 | 91.1 | glotblastn |
| 6477 | LYD501 flaveria\|11v1\|SRR149232.327394_T1 | 12674 | 701 | 91.1 | glotblastn |
| 6478 | LYD501 phyla\|11v2\|SRR0199037X107165_T1 | 12675 | 701 | 91.1 | glotblastn |
| 6479 | LYD501 silene\|11v1\|SRR096785X226922_T1 | 12676 | 701 | 91.1 | glotblastn |
| 6480 | LYD501 arabidopsis_lyrata\|09v1\|JGIAL015668_T1 | 12677 | 701 | 91.1 | glotblastn |
| 6481 | LYD501 basilicum\|10v1\|DY322775_T1 | 12678 | 701 | 91.1 | glotblastn |
| 6482 | LYD501 centaurea\|gb166\|EL935310_T1 | 12679 | 701 | 91.1 | glotblastn |
| 6483 | LYD501 eucalyptus\|11v2\|ES589063_T1 | 12680 | 701 | 91.1 | glotblastn |
| 6484 | LYD501 eucalyptus\|gb166\|ES589063 | 12680 | 701 | 91.1 | glotblastn |
| 6485 | LYD501 podocarpus\|10v1\|SRR065014S0006434_T1 | 12681 | 701 | 91.1 | glotblastn |
| 6486 | LYD501 radish\|gb164\|EV532297 | 12682 | 701 | 91.1 | glotblastn |
| 6487 | LYD501 sunflower\|10v1\|DY946959 | 12683 | 701 | 91.1 | glotblastn |
| 6488 | LYD501 tobacco\|gb162\|DV161386 | 12684 | 701 | 91.1 | glotblastn |
| 6489 | LYD501 tripterygium\|11v1\|SRR098677X10212_T1 | 12685 | 701 | 90.7 | glotblastn |
| 6490 | LYD501 canola\|10v1\|EE505251 | 12686 | 701 | 90.4 | glotblastn |
| 6491 | LYD501 canola\|10v1\|ES993173 | 12687 | 701 | 90.4 | glotblastn |
| 6492 | LYD501 orobanche\|10v1\|SRR023189S0015650_T1 | 12688 | 701 | 90.4 | glotblastn |
| 6493 | LYD501 safflower\|gb162\|EL374811 | 12689 | 701 | 90.4 | glotblastn |
| 6494 | LYD501 canola\|10v1\|CN728487 | 12690 | 701 | 90.4 | glotblastn |
| 6495 | LYD501 canola\|11v1\|EE505251_T1 | 12690 | 701 | 90.4 | glotblastn |
| 6496 | LYD501 abies\|11v2\|SRR098676X108166_T1 | 12691 | 701 | 90.4 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6497 | LYD501 pseudotsuga\|10v1\|SRR065119S0026297 | 12692 | 701 | 90.4 | glotblastn |
| 6498 | LYD501 spruce\|gb162\|CO219510 | 12693 | 701 | 90.4 | glotblastn |
| 6499 | LYD501 canola\|11v1\|SRR023612.19430_P1 | 12694 | 701 | 90.3 | globlastp |
| 6500 | LYD501 switchgrass\|gb167\|DN141122 | 12695 | 701 | 90.3 | glotblastn |
| 6501 | LYD501 canola\|11v1\|EE471702_T1 | 12696 | 701 | 90.2 | glotblastn |
| 6502 | LYD501 cephalotaxus\|11v1\|SRR064395X109433XX1_T1 | 12697 | 701 | 90.2 | glotblastn |
| 6503 | LYD501 fagopyrum\|11v1\|SRR063689X104361_T1 | 12698 | 701 | 90.2 | glotblastn |
| 6504 | LYD501 fagopyrum\|11v1\|SRR063703X108027_T1 | 12699 | 701 | 90.2 | glotblastn |
| 6505 | LYD501 flaveria\|11v1\|SRR149229.108872_T1 | 12700 | 701 | 90.2 | glotblastn |
| 6506 | LYD501 flaveria\|11v1\|SRR149229.117136_T1 | 12701 | 701 | 90.2 | glotblastn |
| 6507 | LYD501 flaveria\|11v1\|SRR149244.117797_T1 | 12702 | 701 | 90.2 | glotblastn |
| 6508 | LYD501 plantago\|11v1\|SRR066373X115223_T1 | 12703 | 701 | 90.2 | glotblastn |
| 6509 | LYD501 primula\|11v1\|SRR098679X108102_T1 | 12704 | 701 | 90.2 | glotblastn |
| 6510 | LYD501 tomato\|11v1\|BG136954_T1 | 12705 | 701 | 90.2 | glotblastn |
| 6511 | LYD501 b_juncea\|10v2\|BJ1SLX00304793D1_T1 | 12706 | 701 | 90.2 | glotblastn |
| 6512 | LYD501 curcuma\|10v1\|DY389264_T1 | 12707 | 701 | 90.2 | glotblastn |
| 6513 | LYD501 marchantia\|gb166\|BJ846993_T1 | 12708 | 701 | 90.2 | glotblastn |
| 6514 | LYD501 oat\|10v2\|GO592376 | 12709 | 701 | 90.2 | glotblastn |
| 6515 | LYD501 oat\|11v1\|GO592376_T1 | 12709 | 701 | 90.2 | glotblastn |
| 6516 | LYD501 pepper\|gb171\|GD131551_T1 | 12710 | 701 | 90.2 | glotblastn |
| 6517 | LYD501 potato\|10v1\|BG598455_T1 | 12705 | 701 | 90.2 | glotblastn |
| 6518 | LYD501 solanum_phureja\|09v1\|SPHBG136954 | 12711 | 701 | 90.2 | glotblastn |
| 6519 | LYD501 taxus\|10v1\|SRR032523S0011074 | 12712 | 701 | 90.2 | glotblastn |
| 6520 | LYD501 tomato\|09v1\|BG136954 | 12705 | 701 | 90.2 | glotblastn |
| 6521 | LYD501 zostera\|10v1\|SRR057351S0040475 | 12713 | 701 | 90.2 | glotblastn |
| 6522 | LYD501 jatropha\|09v1\|FM893117_P1 | 12714 | 701 | 89.8 | globlastp |
| 6523 | LYD501 pteridium\|11v1\|SRR043594X104552_T1 | 12715 | 701 | 89.6 | glotblastn |
| 6524 | LYD501 b_oleracea\|gb161\|EE530319_T1 | 12716 | 701 | 89.6 | glotblastn |
| 6525 | LYD501 nuphar\|gb166\|CK765136_T1 | 12717 | 701 | 89.6 | glotblastn |
| 6526 | LYD501 cedrus\|11v1\|SRR065007X122812XX2_T1 | 12718 | 701 | 89.5 | glotblastn |
| 6527 | LYD501 chelidonium\|11v1\|SRR084752X103504_T1 | 12719 | 701 | 89.5 | glotblastn |
| 6528 | LYD501 distylium\|11v1\|SRR065077X120250_T1 | 12720 | 701 | 89.5 | glotblastn |
| 6529 | LYD501 maritime_pine\|10v1\|BX252090_T1 | 12721 | 701 | 89.5 | glotblastn |
| 6530 | LYD501 arabidopsis\|10v1\|AT2G43230_T1 | 12722 | 701 | 89.5 | glotblastn |
| 6531 | LYD501 pine\|10v2\|AW010140_T1 | 12723 | 701 | 89.5 | glotblastn |
| 6532 | LYD501 podocarpus\|10v1\|SRR065014S0022714_T1 | 12724 | 701 | 89.5 | glotblastn |
| 6533 | LYD501 taxus\|10v1\|SRR032523S0007007 | 12725 | 701 | 89.5 | glotblastn |
| 6534 | LYD501 sciadopitys\|10v1\|SRR065035S0021406 | 12726 | 701 | 89.4 | glotblastn |
| 6535 | LYD501 abies\|11v2\|SRR098676X102781_T1 | 12727 | 701 | 89.3 | glotblastn |
| 6536 | LYD501 canola\|11v1\|SRR001111.50762_T1 | 12728 | 701 | 89.3 | glotblastn |
| 6537 | LYD501 cephalotaxus\|11v1\|SRR064395X104877_T1 | 12729 | 701 | 89.3 | glotblastn |
| 6538 | LYD501 flaveria\|11v1\|SRR149241.171581_T1 | 12730 | 701 | 89.3 | glotblastn |
| 6539 | LYD501 thellungiella_parvulum\|11v1\|EPCRP016511_T1 | 12731 | 701 | 89.3 | glotblastn |
| 6540 | LYD501 b_juncea\|10v2\|E6ANDIZ01A34CT_T1 | 12732 | 701 | 89.3 | glotblastn |
| 6541 | LYD501 cotton\|10v2\|CO126006_T1 | 12733 | 701 | 89.3 | glotblastn |
| 6542 | LYD501 eggplant\|10v1\|FS076981_T1 | 12734 | 701 | 89.3 | glotblastn |
| 6543 | LYD501 gnetum\|10v1\|SRR064399S0008537_T1 | 12735 | 701 | 89.3 | glotblastn |
| 6544 | LYD501 lettuce\|10v1\|DW051632_T1 | 12736 | 701 | 89.3 | glotblastn |
| 6545 | LYD501 sequoia\|10v1\|SRR065044S0002063 | 12737 | 701 | 89.3 | glotblastn |
| 6546 | LYD501 zostera\|10v1\|SRR057351S0006961 | 12738 | 701 | 89.3 | glotblastn |
| 6547 | LYD501 eucalyptus\|11v2\|CD668543_T1 | 12739 | 701 | 89.3 | glotblastn |
| 6548 | LYD501 cannabis\|12v1\|SOLX00064565_T1 | 12740 | 701 | 89.3 | glotblastn |
| 6549 | LYD501 sorghum\|09v1\|SB02G010180 | 12741 | 701 | 88.8 | glotblastn |
| 6550 | LYD501 sorghum\|11v1\|SB02G010180_T1 | 12741 | 701 | 88.8 | glotblastn |
| 6551 | LYD501 sugarcane\|10v1\|CA087300 | 12742 | 701 | 88.8 | glotblastn |
| 6552 | LYD501 thellungiella_halophilum\|11v1\|EHJGI11009353_T1 | 12743 | 701 | 88.7 | glotblastn |
| 6553 | LYD501 aristolochia\|10v1\|FD760646_T1 | 12744 | 701 | 88.7 | glotblastn |
| 6554 | LYD501 cedrus\|11v1\|SRR065007X109178_T1 | 12745 | 701 | 88.5 | glotblastn |
| 6555 | LYD501 pteridium\|11v1\|SRR043594X12287_T1 | 12746 | 701 | 88.5 | glotblastn |
| 6556 | LYD501 canola\|11v1\|CN729845_T1 | 12747 | 701 | 88.4 | glotblastn |
| 6557 | LYD501 canola\|11v1\|SRR3141920.290244_T1 | 12748 | 701 | 88.4 | glotblastn |
| 6558 | LYD501 catharanthus\|11v1\|EG556048_T1 | 12749 | 701 | 88.4 | glotblastn |
| 6559 | LYD501 maritime_pine\|10v1\|BX250004_T1 | 12750 | 701 | 88.4 | glotblastn |
| 6560 | LYD501 tabernaemontana\|11v1\|SRR098689X120290_T1 | 12751 | 701 | 88.4 | glotblastn |
| 6561 | LYD501 vinca\|11v1\|SRR098690X106945_T1 | 12752 | 701 | 88.4 | glotblastn |
| 6562 | LYD501 vinca\|11v1\|SRR098690X15391_T1 | 12753 | 701 | 88.4 | glotblastn |
| 6563 | LYD501 barley\|10v2\|AV833420_T1 | 12754 | 701 | 88.4 | glotblastn |
| 6564 | LYD501 catharanthus\|gb166\|FD421865 | 12755 | 701 | 88.4 | glotblastn |
| 6565 | LYD501 eucalyptus\|gb166\|CD668543 | 12756 | 701 | 88.4 | glotblastn |
| 6566 | LYD501 pine\|10v2\|AW290119_T1 | 12757 | 701 | 88.4 | glotblastn |
| 6567 | LYD501 pseudoroegneria\|gb167\|FF342576 | 12758 | 701 | 88.4 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6568 | LYD501 pseudotsuga\|10v1\|SRR065119S0015451 | 12759 | 701 | 88.4 | glotblastn |
| 6569 | LYD501 spruce\|gb162\|CO215839 | 12760 | 701 | 88.4 | glotblastn |
| 6570 | LYD501 wheat\|10v2\|BF485109XX1 | 12761 | 701 | 88.4 | glotblastn |
| 6571 | LYD501 maize\|10v1\|AI712057_T1 | 12762 | 701 | 88.1 | glotblastn |
| 6572 | LYD501 monkeyflower\|10v1\|GO944683_T1 | 12763 | 701 | 88.1 | glotblastn |
| 6573 | LYD501 monkeyflower\|10v1\|GO952860_T1 | 12763 | 701 | 88.1 | glotblastn |
| 6574 | LYD501 foxtail_millet\|11v3\|GT228214_T1 | 12764 | 701 | 87.9 | glotblastn |
| 6575 | LYD501 foxtail_millet\|10v2\|FXTRMSLX01082153D2 | 12765 | 701 | 87.9 | glotblastn |
| 6576 | LYD501 millet\|10v1\|EVO454PM005290_T1 | 12766 | 701 | 87.9 | glotblastn |
| 6577 | LYD501 foxtail_millet\|11v3\|PHY7SI030254M_T1 | 12767 | 701 | 87.8 | glotblastn |
| 6578 | LYD501 brachypodium\|09v1\|GT766165_T1 | 12768 | 701 | 87.8 | glotblastn |
| 6579 | LYD501 foxtail_millet\|10v2\|FXTRMSLX01324810D2 | 12769 | 701 | 87.8 | glotblastn |
| 6580 | LYD501 rice\|gb170\|OS09G33860 | 12770 | 701 | 87.8 | glotblastn |
| 6581 | LYD501 sorghum\|09v1\|SB02G029730 | 12771 | 701 | 87.8 | glotblastn |
| 6582 | LYD501 sorghum\|11v1\|SB02G029730_T1 | 12771 | 701 | 87.8 | glotblastn |
| 6583 | LYD501 phalaenopsis\|11v1\|SRR125771.1004990_T1 | 12772 | 701 | 87.7 | glotblastn |
| 6584 | LYD501 platanus\|11v1\|SRR096786X100190_T1 | 12773 | 701 | 87.7 | glotblastn |
| 6585 | LYD501 rice\|gb170\|OS01G67340 | 12774 | 701 | 87.7 | glotblastn |
| 6586 | LYD501 amsonia\|11v1\|SRR098688X100581_T1 | 12775 | 701 | 87.5 | glotblastn |
| 6587 | LYD501 distylium\|11v1\|SRR065077X115659_T1 | 12776 | 701 | 87.5 | glotblastn |
| 6588 | LYD501 humulus\|11v1\|GD252681_T1 | 12777 | 701 | 87.5 | glotblastn |
| 6589 | LYD501 vinca\|11v1\|SRR098690X100758_T1 | 12778 | 701 | 87.5 | glotblastn |
| 6590 | LYD501 vinca\|11v1\|SRR098690X127724_T1 | 12779 | 701 | 87.5 | glotblastn |
| 6591 | LYD501 gnetum\|10v1\|SRR064399S0074700_T1 | 12780 | 701 | 87.5 | glotblastn |
| 6592 | LYD501 spikemoss\|gb165\|FE465784 | 12781 | 701 | 87.5 | glotblastn |
| 6593 | LYD501 spikemoss\|gb165\|FE505299 | 12781 | 701 | 87.5 | glotblastn |
| 6594 | LYD501 maize\|10v1\|AW076405_T1 | 12782 | 701 | 87.3 | glotblastn |
| 6595 | LYD501 rice\|gb170\|OS03G62700 | 12783 | 701 | 87.2 | glotblastn |
| 6596 | LYD501 momordica\|10v1\|GT228214_T1 | 12784 | 701 | 87.1 | glotblastn |
| 6597 | LYD501 brachypodium\|09v1\|GT758946_T1 | 12785 | 701 | 87.0 | glotblastn |
| 6598 | LYD501 nuphar\|gb166\|FD386628_T1 | 12786 | 701 | 87.0 | glotblastn |
| 6599 | LYD501 switchgrass\|gb167\|FE601960 | 12787 | 701 | 87.0 | glotblastn |
| 6600 | LYD501 maize\|10v1\|AI665162_T1 | 12788 | 701 | 86.8 | glotblastn |
| 6601 | LYD501 maize\|10v1\|CF626481_T1 | 12789 | 701 | 86.8 | glotblastn |
| 6602 | LYD501 sorghum\|09v1\|SB07G025590 | 12790 | 701 | 86.8 | glotblastn |
| 6603 | LYD501 sorghum\|11v1\|SB07G025590_T1 | 12790 | 701 | 86.8 | glotblastn |
| 6604 | LYD501 pineapple\|10v1\|DT338265_T1 | 12791 | 701 | 86.7 | glotblastn |
| 6605 | LYD501 phalaenopsis\|11v1\|SRR125771.1043390_T1 | 12792 | 701 | 86.6 | glotblastn |
| 6606 | LYD501 valeriana\|11v1\|SRR099039X107868_T1 | 12793 | 701 | 86.6 | glotblastn |
| 6607 | LYD501 b_rapa\|gb162\|EX038565_T1 | 12794 | 701 | 86.6 | glotblastn |
| 6608 | LYD501 millet\|10v1\|EVO454PM018600_T1 | 12795 | 701 | 86.6 | glotblastn |
| 6609 | LYD501 radish\|gb164\|EV550246 | 12796 | 701 | 86.6 | glotblastn |
| 6610 | LYD501 foxtail_millet\|11v3\|PHY7SI001768M_T1 | 12797 | 701 | 86.6 | glotblastn |
| 6611 | LYD501 amaranthus\|10v1\|SRR039411S0008288_P1 | 12798 | 701 | 86.6 | globlastp |
| 6612 | LYD501 cynodon\|10v1\|ES296224_T1 | 12799 | 701 | 86.1 | glotblastn |
| 6613 | LYD501 millet\|10v1\|EVO454PM007173_T1 | 12800 | 701 | 86.1 | glotblastn |
| 6614 | LYD501 oat\|10v2\|CN814959 | 12801 | 701 | 86.1 | glotblastn |
| 6615 | LYD501 oat\|11v1\|CN814959_T1 | 12801 | 701 | 86.1 | glotblastn |
| 6616 | LYD501 sugarcane\|10v1\|BQ536827 | 12802 | 701 | 86.1 | glotblastn |
| 6617 | LYD501 b_juncea\|10v2\|E6ANDIZ01C0V9W_P1 | 12803 | 701 | 86.0 | globlastp |
| 6618 | LYD501 pteridium\|11v1\|SRR043594X105169_T1 | 12804 | 701 | 86.0 | glotblastn |
| 6619 | LYD501 barley\|10v2\|AV923324_T1 | 12805 | 701 | 86.0 | glotblastn |
| 6620 | LYD501 brachypodium\|09v1\|DV487120_T1 | 12806 | 701 | 86.0 | glotblastn |
| 6621 | LYD501 leymus\|gb166\|EG376522_T1 | 12807 | 701 | 86.0 | glotblastn |
| 6622 | LYD501 pseudoroegneria\|gb167\|FF366306 | 12808 | 701 | 86.0 | glotblastn |
| 6623 | LYD501 sugarcane\|10v1\|CA276460 | 12809 | 701 | 86.0 | glotblastn |
| 6624 | LYD501 switchgrass\|gb167\|FE619829 | 12810 | 701 | 86.0 | glotblastn |
| 6625 | LYD501 flax\|11v1\|JG079201_T1 | 12811 | 701 | 85.8 | glotblastn |
| 6626 | LYD501 humulus\|11v1\|SRR098683X116286_T1 | 12812 | 701 | 85.8 | glotblastn |
| 6627 | LYD501 wheat\|10v2\|BE427614 | 12813 | 701 | 85.8 | glotblastn |
| 6628 | LYD501 scabiosa\|11v1\|SRR063723X219085_T1 | 12814 | 701 | 85.7 | glotblastn |
| 6629 | LYD501 physcomitrella\|10v1\|AW156080_T1 | 12815 | 701 | 85.7 | glotblastn |
| 6630 | LYD501 pseudotsuga\|10v1\|SRR065119S0079234 | 12816 | 701 | 85.7 | glotblastn |
| 6631 | LYD501 sequoia\|10v1\|SRR065044S0235159 | 12817 | 701 | 85.7 | glotblastn |
| 6632 | LYD501 taxus\|10v1\|SRR032523S0034570 | 12818 | 701 | 85.7 | glotblastn |
| 6633 | LYD501 onion\|gb162\|CF441584_P1 | 12819 | 701 | 85.7 | globlastp |
| 6634 | LYD501 radish\|gb164\|EV567059 | 12820 | 701 | 85.5 | glotblastn |
| 6635 | LYD501 millet\|10v1\|EVO454PM014854_T1 | 12821 | 701 | 85.2 | glotblastn |
| 6636 | LYD501 cucurbita\|11v1\|SRR091276X122300_T1 | 12822 | 701 | 85.1 | glotblastn |
| 6637 | LYD501 castorbean\|09v1\|XM002534328 | 12823 | 701 | 85.1 | glotblastn |
| 6638 | LYD501 castorbean\|11v1\|XM_002534328_T1 | 12823 | 701 | 85.1 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6639 | LYD501 poplar\|10v1\|XM002323294_T1 | 12824 | 701 | 85.1 | glotblastn |
| 6640 | LYD501 cannabis\|12v1\|SOLX00057941_P1 | 12825 | 701 | 85.0 | globlastp |
| 6641 | LYD501 pteridium\|11v1\|SRR043594X118194_T1 | 12826 | 701 | 85.0 | glotblastn |
| 6642 | LYD501 maize\|10v1\|AI901334_T1 | 12827 | 701 | 85.0 | glotblastn |
| 6643 | LYD501 cedrus\|11v1\|SRR065007X103091_T1 | 12828 | 701 | 84.8 | glotblastn |
| 6644 | LYD501 cephalotaxus\|11v1\|SRR064395X161006_T1 | 12829 | 701 | 84.8 | glotblastn |
| 6645 | LYD501 canola\|11v1\|GR462897_T1 | 12830 | 701 | 84.8 | glotblastn |
| 6646 | LYD501 ceratodon\|10v1\|SRR074890S0002056_T1 | 12831 | 701 | 84.8 | glotblastn |
| 6647 | LYD501 foxtail_millet\|11v3\|PHY7SI001812M_T1 | 12832 | 701 | 84.6 | glotblastn |
| 6648 | LYD501 canola\|10v1\|EE420797 | 12833 | 701 | 84.6 | glotblastn |
| 6649 | LYD501 foxtail_millet\|11v3\|PHY7SI036340M_T1 | 12834 | 701 | 84.2 | glotblastn |
| 6650 | LYD501 sorghum\|11v1\|SB01G009910_T1 | 12835 | 701 | 84.2 | glotblastn |
| 6651 | LYD501 tomato\|11v1\|BG136651_T1 | 12836 | 701 | 84.2 | glotblastn |
| 6652 | LYD501 solanum_phureja\|09v1\|SPHBG136651 | 12837 | 701 | 84.2 | glotblastn |
| 6653 | LYD501 sorghum\|09v1\|SB01G009910 | 12838 | 701 | 84.2 | glotblastn |
| 6654 | LYD501 tobacco\|gb162\|AJ608157 | 12839 | 701 | 84.2 | glotblastn |
| 6655 | LYD501 tomato\|09v1\|BG136651 | 12836 | 701 | 84.2 | glotblastn |
| 6656 | LYD501 canola\|11v1\|SRR341920.180098_T1 | 12840 | 701 | 84.1 | glotblastn |
| 6657 | LYD501 canola\|11v1\|SRR341920.339688_T1 | 12841 | 701 | 84.1 | glotblastn |
| 6658 | LYD501 thellungiella_halophilum\|11v1\|DN774052_T1 | 12842 | 701 | 84.1 | glotblastn |
| 6659 | LYD501 arabidopsis_lyrata\|09v1\|JGIAL010263_T1 | 12843 | 701 | 84.1 | glotblastn |
| 6660 | LYD501 b_juncea\|10v2\|BJ1SLX00027274D1_T1 | 12844 | 701 | 84.1 | glotblastn |
| 6661 | LYD501 b_juncea\|10v2\|E6ANDIZ01AFV8V_T1 | 12845 | 701 | 84.1 | glotblastn |
| 6662 | LYD501 b_juncea\|10v2\|E6ANDIZ02H7YRF_T1 | 12846 | 701 | 84.1 | glotblastn |
| 6663 | LYD501 cacao\|10v1\|CGD0023908_T1 | 12847 | 701 | 84.1 | glotblastn |
| 6664 | LYD501 cleome_gynandra\|10v1\|SRR015532S0061040_T1 | 12848 | 701 | 84.1 | glotblastn |
| 6665 | LYD501 canola\|11v1\|ES904690_T1 | 12849 | 701 | 84.1 | glotblastn |
| 6666 | LYD501 canola\|11v1\|EV108950_T1 | 12850 | 701 | 84.1 | glotblastn |
| 6667 | LYD501 fraxinus\|11v1\|SRR058827.109141_T1 | 12851 | 701 | 83.9 | glotblastn |
| 6668 | LYD501 maritime_pine\|10v1\|SRR073317S0029934_T1 | 12852 | 701 | 83.9 | glotblastn |
| 6669 | LYD501 bean\|gb167\|CB541648_T1 | 12853 | 701 | 83.9 | glotblastn |
| 6670 | LYD501 cleome_gynandra\|10v1\|SRR015532S0003688_T1 | 12854 | 701 | 83.9 | glotblastn |
| 6671 | LYD501 cryptomeria\|gb166\|BY881522T1 | 12855 | 701 | 83.9 | glotblastn |
| 6672 | LYD501 foxtail_millet\|10v2\|SICRP030781 | 12856 | 701 | 83.9 | glotblastn |
| 6673 | LYD501 millet\|10v1\|EVO454PM033789_T1 | 12857 | 701 | 83.9 | glotblastn |
| 6674 | LYD501 monkeyflower\|10v1\|SRR037227S0019168_T1 | 12858 | 701 | 83.9 | glotblastn |
| 6675 | LYD501 pine\|10v2\|DR047992_T1 | 12859 | 701 | 83.9 | glotblastn |
| 6676 | LYD501 prunus\|10v1\|CO903806 | 12860 | 701 | 83.9 | glotblastn |
| 6677 | LYD501 rice\|gb170\|OS03G51040 | 12861 | 701 | 83.9 | glotblastn |
| 6678 | LYD501 sorghum\|09v1\|SB03G011910 | 12862 | 701 | 83.9 | glotblastn |
| 6679 | LYD501 spruce\|gb162\|DR566499 | 12863 | 701 | 83.9 | glotblastn |
| 6680 | LYD501 sugarcane\|10v1\|BQ804002 | 12864 | 701 | 83.9 | glotblastn |
| 6681 | LYD501 switchgrass\|gb167\|FL754118 | 12865 | 701 | 83.9 | glotblastn |
| 6682 | LYD501 barley\|10v2\|BF623867_T1 | 12866 | 701 | 83.8 | glotblastn |
| 6683 | LYD501 pseudoroegneria\|gb167\|FF343046 | 12867 | 701 | 83.8 | glotblastn |
| 6684 | LYD501 radish\|gb164\|EW724766 | 12868 | 701 | 83.8 | glotblastn |
| 6685 | LYD501 wheat\|10v2\|BE443620 | 12869 | 701 | 83.8 | glotblastn |
| 6686 | LYD501 watermelon\|11v1\|AM716819_T1 | 12870 | 701 | 83.5 | glotblastn |
| 6687 | LYD501 cucumber\|09v1\|AM716819_T1 | 12871 | 701 | 83.5 | glotblastn |
| 6688 | LYD501 sorghum\|09v1\|SB04G023390 | 12872 | 701 | 83.5 | glotblastn |
| 6689 | LYD501 sorghum\|11v1\|SB04G023390_T1 | 12872 | 701 | 83.5 | glotblastn |
| 6690 | LYD501 amorphophallus\|11v2\|SRR089351X106030_T1 | 12873 | 701 | 83.3 | glotblastn |
| 6691 | LYD501 eucalyptus\|11v2\|JGIEG041800_T1 | 12874 | 701 | 83.3 | glotblastn |
| 6692 | LYD501 foxtail_millet\|11v3\|PHY7SI018113M_T1 | 12875 | 701 | 83.3 | glotblastn |
| 6693 | LYD501 foxtail_millet\|11v3\|PHY7SI040473M_T1 | 12876 | 701 | 83.3 | glotblastn |
| 6694 | LYD501 thellungiella_halophilum\|11v1\|EHJGI11001229_T1 | 12877 | 701 | 83.3 | glotblastn |
| 6695 | LYD501 thellungiella_parvulum\|11v1\|EPCRP014654_T1 | 12878 | 701 | 83.3 | glotblastn |
| 6696 | LYD501 arabidopsis_lyrata\|09v1\|JGIAL015517_T1 | 12879 | 701 | 83.3 | glotblastn |
| 6697 | LYD501 arabidopsis\|10v1\|AT2G41970_T1 | 12880 | 701 | 83.3 | glotblastn |
| 6698 | LYD501 sciadopitys\|10v1\|SRR065035S0124453 | 12881 | 701 | 83.3 | glotblastn |
| 6699 | LYD501 switchgrass\|gb167\|FL759588 | 12882 | 701 | 83.3 | glotblastn |
| 6700 | LYD501 fagopyrum\|11v1\|SRR063689X101615_T1 | 12883 | 701 | 83.2 | glotblastn |
| 6701 | LYD501 pteridium\|11v1\|SRR043594X61169_T1 | 12884 | 701 | 83.2 | glotblastn |
| 6702 | LYD501 thellungiella_parvulum\|11v1\|DN774052_T1 | 12885 | 701 | 83.2 | glotblastn |
| 6703 | LYD501 sorghum\|09v1\|SB01G041810 | 12886 | 701 | 83.2 | glotblastn |
| 6704 | LYD501 sorghum\|11v1\|SB01G041810_T1 | 12886 | 701 | 83.2 | glotblastn |
| 6705 | LYD501 switchgrass\|gb167\|FE634135 | 12887 | 701 | 83.2 | glotblastn |
| 6706 | LYD501 ambrosia\|11v1\|SRR346935.120562_T1 | 12888 | 701 | 83.0 | glotblastn |
| 6707 | LYD501 ambrosia\|11v1\|SRR346935.122457_T1 | 12889 | 701 | 83.0 | glotblastn |
| 6708 | LYD501 arnica\|11v1\|SRR099034X10892_T1 | 12890 | 701 | 83.0 | glotblastn |
| 6709 | LYD501 cirsium\|11v1\|SRR1346952.105454_T1 | 12891 | 701 | 83.0 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6710 | LYD501 flaveria\|11v1\|SRR149229.115579_T1 | 12892 | 701 | 83.0 | glotblastn |
| 6711 | LYD501 phalaenopsis\|11v1\|SRR125771.1023922_T1 | 12893 | 701 | 83.0 | glotblastn |
| 6712 | LYD501 plantago\|11v1\|SRRT1066373X136471_T1 | 12894 | 701 | 83.0 | glotblastn |
| 6713 | LYD501 watermelon\|11v1\|AM719850_T1 | 12895 | 701 | 83.0 | glotblastn |
| 6714 | LYD501 aquilegia\|10v2\|DR950025_T1 | 12896 | 701 | 83.0 | glotblastn |
| 6715 | LYD501 artemisia\|10v1\|EY039568_T1 | 12897 | 701 | 83.0 | glotblastn |
| 6716 | LYD501 cucumber\|09v1\|AM735968_T1 | 12898 | 701 | 83.0 | glotblastn |
| 6717 | LYD501 cynara\|gb167\|GE605927_T1 | 12899 | 701 | 83.0 | glotblastn |
| 6718 | LYD501 eggplant\|10v1\|FS076888_T1 | 12900 | 701 | 83.0 | glotblastn |
| 6719 | LYD501 maize\|10v1\|ZMCRP2V120448_T1 | 12901 | 701 | 83.0 | glotblastn |
| 6720 | LYD501 medicago\|09v1\|CRPMT033988_T1 | 12902 | 701 | 83.0 | glotblastn |
| 6721 | LYD501 melon\|10v1\|AM719850_T1 | 12903 | 701 | 83.0 | glotblastn |
| 6722 | LYD501 oat\|10v2\|CN814884 | 12904 | 701 | 83.0 | glotblastn |
| 6723 | LYD501 oat\|11v1\|CN814884_T1 | 12904 | 701 | 83.0 | glotblastn |
| 6724 | LYD501 peanut\|10v1\|ES721022_T1 | 12905 | 701 | 83.0 | glotblastn |
| 6725 | LYD501 peanut\|10v1\|GO326528_T1 | 12906 | 701 | 83.0 | glotblastn |
| 6726 | LYD501 poplar\|10v1\|CK108679_T1 | 12907 | 701 | 83.0 | glotblastn |
| 6727 | LYD501 poplar\|10v1\|XM002308322_T1 | 12908 | 701 | 83.0 | glotblastn |
| 6728 | LYD501 pseudotsuga\|10v1\|SRR065119S0052282 | 12909 | 701 | 83.0 | glotblastn |
| 6729 | LYD501 rice\|gb170\|OS03G12520 | 12910 | 701 | 83.0 | glotblastn |
| 6730 | LYD501 soybean\|11v1\|GLYMA03G30260 | 12911 | 701 | 83.0 | glotblastn |
| 6731 | LYD501 soybean\|11v1\|GLYMA09G16640 | 12912 | 701 | 83.0 | glotblastn |
| 6732 | LYD501 sunflower\|10v1\|CD856673 | 12913 | 701 | 83.0 | glotblastn |
| 6733 | LYD501 tobacco\|gb162\|EB427489 | 12914 | 701 | 83.0 | glotblastn |
| 6734 | LYD501 tragopogon\|10v1\|SRR020205S0001042 | 12915 | 701 | 83.0 | glotblastn |
| 6735 | LYD501 rice\|gb170\|OS01G21970 | 12916 | 701 | 82.9 | glotblastn |
| 6736 | LYD501 leymus\|gb166\|EG390720_T1 | 12917 | 701 | 82.8 | glotblastn |
| 6737 | LYD501 silene\|11v1\|SRR096785X105709_T1 | 12918 | 701 | 82.5 | glotblastn |
| 6738 | LYD501 tomato\|11v1\|BG137599_T1 | 12919 | 701 | 82.5 | glotblastn |
| 6739 | LYD501 foxtail_millet\|10v2\|SICRP028174 | 12920 | 701 | 82.5 | glotblastn |
| 6740 | LYD501 foxtail_millet\|11v3\|PHY7SI036290M_T1 | 12921 | 701 | 82.5 | glotblastn |
| 6741 | LYD501 maize\|10v1\|AW562890_T1 | 12922 | 701 | 82.5 | glotblastn |
| 6742 | LYD501 maize\|10v1\|BQ486315_T1 | 12923 | 701 | 82.5 | glotblastn |
| 6743 | LYD501 rice\|gb170\|OS02G35760 | 12924 | 701 | 82.5 | glotblastn |
| 6744 | LYD501 soybean\|11v1\|GLYMA19G33180 | 12925 | 701 | 82.5 | glotblastn |
| 6745 | LYD501 tobacco\|gb162\|AJ608156 | 12926 | 701 | 82.5 | glotblastn |
| 6746 | LYD501 thellungiella_halophilum\|11v1\|EHJGI11005226_T1 | 12927 | 701 | 82.3 | glotblastn |
| 6747 | LYD501 thellungiella_parvulum\|11v1\|EPCRP005167_T1 | 12928 | 701 | 82.3 | glotblastn |
| 6748 | LYD501 cirsium\|11v1\|SRR346952.1011887_T1 | 12929 | 701 | 82.1 | glotblastn |
| 6749 | LYD501 clementine\|11v1\|BQ623394_T1 | 12930 | 701 | 82.1 | glotblastn |
| 6750 | LYD501 clementine\|11v1\|JGICC016928_T1 | 12931 | 701 | 82.1 | glotblastn |
| 6751 | LYD501 eucalyptus\|11v2\|CD668259_T1 | 12932 | 701 | 82.1 | glotblastn |
| 6752 | LYD501 eucalyptus\|11v2\|JGIEG014547_T1 | 12933 | 701 | 82.1 | glotblastn |
| 6753 | LYD501 euonymus\|11v1\|SRR070038X173263_T1 | 12934 | 701 | 82.1 | glotblastn |
| 6754 | LYD501 orange\|11v1\|BQ623394_T1 | 12930 | 701 | 82.1 | glotblastn |
| 6755 | LYD501 orange\|11v1\|JGICC016928_T1 | 12935 | 701 | 82.1 | glotblastn |
| 6756 | LYD501 phalaenopsis\|11v1\|SRR125771.1004831_T1 | 12936 | 701 | 82.1 | glotblastn |
| 6757 | LYD501 phalaenopsis\|11v1\|SRR125771.1006136_T1 | 12936 | 701 | 82.1 | glotblastn |
| 6758 | LYD501 platanus\|11v1\|SRR096786X206803_T1 | 12937 | 701 | 82.1 | glotblastn |
| 6759 | LYD501 scabiosa\|11v1\|SRR063723X148331_T1 | 12938 | 701 | 82.1 | glotblastn |
| 6760 | LYD501 silene\|11v1\|SRR096785X107268_T1 | 12939 | 701 | 82.1 | glotblastn |
| 6761 | LYD501 tomato\|11v1\|BQ518958_T1 | 12940 | 701 | 82.1 | glotblastn |
| 6762 | LYD501 tomato\|11v1\|LEU28007_T1 | 12941 | 701 | 82.1 | glotblastn |
| 6763 | LYD501 trigonella\|11v1\|SRR066194X234165_T1 | 12942 | 701 | 82.1 | glotblastn |
| 6764 | LYD501 tripterygium\|11v1\|SRR098677X109433_T1 | 12943 | 701 | 82.1 | glotblastn |
| 6765 | LYD501 valeriana\|11v1\|SRR099039X119728_T1 | 12944 | 701 | 82.1 | glotblastn |
| 6766 | LYD501 aquilegia\|10v2\|DR939004_T1 | 12945 | 701 | 82.1 | glotblastn |
| 6767 | LYD501 arabidopsis_lyrata\|09v1\|JGIAL019571_T1 | 12946 | 701 | 82.1 | glotblastn |
| 6768 | LYD501 arabidopsis\|10v1\|AT3G62220_T1 | 12947 | 701 | 82.1 | glotblastn |
| 6769 | LYD501 aristolochia\|10v1\|FD760252_T1 | 12948 | 701 | 82.1 | glotblastn |
| 6770 | LYD501 barley\|10v2\|AV835239_T1 | 12949 | 701 | 82.1 | glotblastn |
| 6771 | LYD501 bean\|gb167\|CV529402_T1 | 12950 | 701 | 82.1 | glotblastn |
| 6772 | LYD501 beet\|gb162\|BI543314_T1 | 12951 | 701 | 82.1 | glotblastn |
| 6773 | LYD501 brachypodium\|09v1\|BRADI1G10500_T1 | 12952 | 701 | 82.1 | glotblastn |
| 6774 | LYD501 cacao\|10v1\|CU493885_T1 | 12953 | 701 | 82.1 | glotblastn |
| 6775 | LYD501 citrus\|gb166\|BQ623394_T1 | 12930 | 701 | 82.1 | glotblastn |
| 6776 | LYD501 cotton\|10v2\|DR458877_T1 | 12954 | 701 | 82.1 | glotblastn |
| 6777 | LYD501 eggplant\|10v1\|FS027436_T1 | 12955 | 701 | 82.1 | glotblastn |
| 6778 | LYD501 fescue\|gb161\|DT686745_T1 | 12956 | 701 | 82.1 | glotblastn |
| 6779 | LYD501 foxtail_millet\|10v2\|FXTSLX00265159 | 12957 | 701 | 82.1 | glotblastn |
| 6780 | LYD501 liquorice\|gb171\|FS268104_T1 | 12958 | 701 | 82.1 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6781 | LYD501 lotus\|09v1\|CB827659_T1 | 12959 | 701 | 82.1 | glotblastn |
| 6782 | LYD501 maize\|10v1\|AI491549_T1 | 12960 | 701 | 82.1 | glotblastn |
| 6783 | LYD501 maize\|10v1\|AI987228_T1 | 12961 | 701 | 82.1 | glotblastn |
| 6784 | LYD501 millet\|10v1\|PMSLX0096074D1_T1 | 12962 | 701 | 82.1 | glotblastn |
| 6785 | LYD501 monkeyflower\|10v1\|GR009251_T1 | 12963 | 701 | 82.1 | glotblastn |
| 6786 | LYD501 nicotiana_benthamiana\|gb162\|CK290452_T1 | 12964 | 701 | 82.1 | glotblastn |
| 6787 | LYD501 pigeonpea\|10v1\|SRR054580S0006991_T1 | 12965 | 701 | 82.1 | glotblastn |
| 6788 | LYD501 pigeonpea\|10v1\|SRR054580S0007934_T1 | 12966 | 701 | 82.1 | glotblastn |
| 6789 | LYD501 poplar\|10v1\|BI129134_T1 | 12967 | 701 | 82.1 | glotblastn |
| 6790 | LYD501 potato\|10v1\|B1405324_T1 | 12968 | 701 | 82.1 | glotblastn |
| 6791 | LYD501 solanum_phureja\|09v1\|SPHBQ518958 | 12969 | 701 | 82.1 | glotblastn |
| 6792 | LYD501 solanum_phureja\|09v1\|SPHLEU28007 | 12968 | 701 | 82.1 | glotblastn |
| 6793 | LYD501 sorghum\|09v1\|SB03G042760 | 12970 | 701 | 82.1 | glotblastn |
| 6794 | LYD501 sorghum\|09v1\|SB09G002850 | 12971 | 701 | 82.1 | glotblastn |
| 6795 | LYD501 sorghum\|11v1\|SB09G002850_T1 | 12971 | 701 | 82.1 | glotblastn |
| 6796 | LYD501 soybean\|11v1\|GLYMA02G01150 | 12972 | 701 | 82.1 | glotblastn |
| 6797 | LYD501 soybean\|11v1\|GLYMA10G01200 | 12973 | 701 | 82.1 | glotblastn |
| 6798 | LYD501 soybean\|11v1\|GLYMA19G40820 | 12974 | 701 | 82.1 | glotblastn |
| 6799 | LYD501 strawberry\|11v1\|SRR034859S0004247 | 12975 | 701 | 82.1 | glotblastn |
| 6800 | LYD501 sugarcane\|10v1\|AA577641 | 12976 | 701 | 82.1 | glotblastn |
| 6801 | LYD501 tomato\|09v1\|BQ518958 | 12977 | 701 | 82.1 | glotblastn |
| 6802 | LYD501 tomato\|09v1\|LEU28007 | 12941 | 701 | 82.1 | glotblastn |
| 6803 | LYD501 triphysaria\|10v1\|BM357128 | 12978 | 701 | 82.1 | glotblastn |
| 6804 | LYD501 wheat\|10v2\|BE404390 | 12979 | 701 | 82.1 | glotblastn |
| 6805 | LYD501 medicago\|09v1\|AW689792_T1 | 12980 | 701 | 82.1 | glotblastn |
| 6806 | LYD501 petunia\|gb171\|FN011365_P1 | 12981 | 701 | 82.1 | globlastp |
| 6807 | LYD501 barley\|10v2\|BM442672_T1 | 12982 | 701 | 82.1 | glotblastn |
| 6808 | LYD501 brachypodium\|09v1\|BRADI3G46280_T1 | 12983 | 701 | 82.1 | glotblastn |
| 6809 | LYD501 fagopyrum\|11v1\|SRR063689X126034_T1 | 12984 | 701 | 81.9 | glotblastn |
| 6810 | LYD501 fagopyrum\|11v1\|SRR063689X139486_T1 | 12985 | 701 | 81.9 | glotblastn |
| 6811 | LYD501 oil_palm\|gb166\|EL682307_T1 | 12986 | 701 | 81.9 | glotblastn |
| 6812 | LYD501 foxtail_millet\|11v3\|PHY7SI001961M_T1 | 12987 | 701 | 81.7 | glotblastn |
| 6813 | LYD501 silene\|11v1\|GH295042_T1 | 12988 | 701 | 81.7 | glotblastn |
| 6814 | LYD501 foxtail_millet\|10v2\|FXTRMSLX00062108D1 | 12987 | 701 | 81.7 | glotblastn |
| 6815 | LYD501 onion\|gb162\|BI095633_T1 | 12989 | 701 | 81.7 | glotblastn |
| 6816 | LYD501 cirsium\|11v1\|SRR346952.718843_T1 | 12990 | 701 | 81.6 | glotblastn |
| 6817 | LYD501 monkeyflower\|10v1\|GR112379_T1 | 12991 | 701 | 81.6 | glotblastn |
| 6818 | LYD501 triphysaria\|10v1\|SRR023501S0045209 | 12992 | 701 | 81.6 | glotblastn |
| 6819 | LYD501 pineapple\|10v1\|DT338006_T1 | 12993 | 701 | 81.6 | glotblastn |
| 6820 | LYD501 cheliclonium\|11v1\|SRR084752X101024_T1 | 12994 | 701 | 81.4 | glotblastn |
| 6821 | LYD501 flaveria\|11v1\|SRR149244.109348_T1 | 12995 | 701 | 81.4 | glotblastn |
| 6822 | LYD501 canola\|10v1\|CX278279 | 12996 | 701 | 81.4 | glotblastn |
| 6823 | LYD501 ipomoea_batatas\|10v1\|EE875015_T1 | 12997 | 701 | 81.4 | glotblastn |
| 6824 | LYD501 ipomoea_nil\|10v1\|CJ760692_T1 | 12998 | 701 | 81.4 | glotblastn |
| 6825 | LYD501 amsonia\|11v1\|SRR098688X142027_T1 | 12999 | 701 | 81.3 | glotblastn |
| 6826 | LYD501 apple\|11v1\|CO866258_T1 | 13000 | 701 | 81.3 | glotblastn |
| 6827 | LYD501 apple\|11v1\|EB110697_T1 | 13001 | 701 | 81.3 | glotblastn |
| 6828 | LYD501 canola\|11v1\|EG021170_T1 | 13002 | 701 | 81.3 | glotblastn |
| 6829 | LYD501 castorbean\|11v1\|EG657546_T1 | 13003 | 701 | 81.3 | glotblastn |
| 6830 | LYD501 cucurbita\|11v1\|SRR091276X100504_T1 | 13004 | 701 | 81.3 | glotblastn |
| 6831 | LYD501 euphorbia\|11v1\|DV116440_T1 | 13005 | 701 | 81.3 | glotblastn |
| 6832 | LYD501 flax\|11v1\|CA482925_T1 | 13006 | 701 | 81.3 | glotblastn |
| 6833 | LYD501 fraxinus\|11v1\|SRR058827.100436_T1 | 13007 | 701 | 81.3 | glotblastn |
| 6834 | LYD501 grape\|11v1\|GSVT1701033472001_T1 | 13008 | 701 | 81.3 | glotblastn |
| 6835 | LYD501 maritime_pine\|10v1\|SRR073317S0028767_T1 | 13009 | 701 | 81.3 | glotblastn |
| 6836 | LYD501 sarracenia\|11v1\|SRR192669.144509_T1 | 13010 | 701 | 81.3 | glotblastn |
| 6837 | LYD501 amaranthus\|10v1\|SRR039411S0007133_T1 | 13011 | 701 | 81.3 | glotblastn |
| 6838 | LYD501 apple\|gb171\|CN579477 | 13012 | 701 | 81.3 | glotblastn |
| 6839 | LYD501 b_juncea\|10v2\|E6ANDIZ01ENCJB_T1 | 13013 | 701 | 81.3 | glotblastn |
| 6840 | LYD501 bean\|gb167\|CA916087_T1 | 13014 | 701 | 81.3 | glotblastn |
| 6841 | LYD501 brachypodium\|09v1\|DV475658_T1 | 13015 | 701 | 81.3 | glotblastn |
| 6842 | LYD501 cacao\|10v1\|CU540382_T1 | 13016 | 701 | 81.3 | glotblastn |
| 6843 | LYD501 cassava\|09v1\|CK642609_T1 | 13017 | 701 | 81.3 | glotblastn |
| 6844 | LYD501 cassava\|09v1\|DR086867_T1 | 13018 | 701 | 81.3 | glotblastn |
| 6845 | LYD501 castorbean\|09v1\|EG657546 | 13019 | 701 | 81.3 | glotblastn |
| 6846 | LYD501 centaurea\|gb166\|EL931320_T1 | 13020 | 701 | 81.3 | glotblastn |
| 6847 | LYD501 chestnut\|gb170\|SRR006295S0006440_T1 | 13021 | 701 | 81.3 | glotblastn |
| 6848 | LYD501 cichorium\|gb171\|EH682586_T1 | 13022 | 701 | 81.3 | glotblastn |
| 6849 | LYD501 cotton\|10v2\|BF278036_T1 | 13023 | 701 | 81.3 | glotblastn |
| 6850 | LYD501 cowpea\|gb166\|FF394649_T1 | 13024 | 701 | 81.3 | glotblastn |
| 6851 | LYD501 cyamopsis\|10v1\|EG976753_T1 | 13025 | 701 | 81.3 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name | cluster name | Polyp. SEQ ID NO: | Hom to SEQ ID NO: | % glob. iden. | Algor. |
|---|---|---|---|---|---|---|
| 6852 | LYD501 | foxtail_millet\|10v2\|FXTRMSLX00534304 | 13026 | 701 | 81.3 | glotblastn |
| 6853 | LYD501 | foxtail_millet\|11v3\|PHY7SI022446M_T1 | 13026 | 701 | 81.3 | glotblastn |
| 6854 | LYD501 | lettuce\|10v1\|DW058707_T1 | 13027 | 701 | 81.3 | glotblastn |
| 6855 | LYD501 | millet\|10v1\|CD725591_T1 | 13028 | 701 | 81.3 | glotblastn |
| 6856 | LYD501 | momordica\|10v1\|SRR071315S0009178_T1 | 13029 | 701 | 81.3 | glotblastn |
| 6857 | LYD501 | nasturtium\|10v1\|SRR032558S0007554 | 13030 | 701 | 81.3 | glotblastn |
| 6858 | LYD501 | nasturtium\|10v1\|SRR032558S0091869 | 13031 | 701 | 81.3 | glotblastn |
| 6859 | LYD501 | oak\|10v1\|CU656232_T1 | 13032 | 701 | 81.3 | glotblastn |
| 6860 | LYD501 | orobanche\|10v1\|SRR023189S0005258_T1 | 13033 | 701 | 81.3 | glotblastn |
| 6861 | LYD501 | pineapple\|10v1\|DV190737_T1 | 13034 | 701 | 81.3 | glotblastn |
| 6862 | LYD501 | rice\|gb170\|OS05G04520 | 13035 | 701 | 81.3 | glotblastn |
| 6863 | LYD501 | solanum_phureja\|09v1\|SPHBI435514 | 13036 | 701 | 81.3 | glotblastn |
| 6864 | LYD501 | soybean\|11v1\|GLYMA03G38200 | 13037 | 701 | 81.3 | glotblastn |
| 6865 | LYD501 | strawberry\|11v1\|DY675883 | 13038 | 701 | 81.3 | glotblastn |
| 6866 | LYD501 | switchgrass\|gb167\|DN151255 | 13039 | 701 | 81.3 | glotblastn |
| 6867 | LYD501 | switchgrass\|gb167\|FL786664 | 13040 | 701 | 81.3 | glotblastn |
| 6868 | LYD501 | petunia\|gb171\|DY396104_T1 | — | 701 | 81.3 | glotblastn |
| 6869 | LYD501 | sorghum\|09v1\|SB03G013140 | 13041 | 701 | 81.2 | glotblastn |
| 6870 | LYD501 | sorghum\|11v1\|SB03G013140_T1 | 13041 | 701 | 81.2 | glotblastn |
| 6871 | LYD501 | tobacco\|gb162\|BP530623 | 13042 | 701 | 81.2 | globlastp |
| 6872 | LYD501 | primula\|11v1\|SRR098679X106133_T1 | 13043 | 701 | 81.0 | glotblastn |
| 6873 | LYD501 | brachypodium\|09v1\|DV470851_T1 | 13044 | 701 | 81.0 | glotblastn |
| 6874 | LYD501 | grape\|11v1\|GSVIVT01017680001_T1 | 13045 | 701 | 81.0 | glotblastn |
| 6875 | LYD501 | grape\|gb160\|BQ795653 | 13046 | 701 | 81.0 | glotblastn |
| 6876 | LYD501 | wheat\|10v2\|BE415417 | 13047 | 701 | 81.0 | glotblastn |
| 6877 | LYD501 | primula\|11v1\|SRR098679X105062_P1 | 13048 | 701 | 81.0 | globlastp |
| 6878 | LYD501 | thellungiella_halophilum\|11v1\|EHJGI11010829_T1 | 13049 | 701 | 80.9 | glotblastn |
| 6879 | LYD501 | chestnut\|gb170\|SRR006296S0053275_T1 | 13050 | 701 | 80.7 | glotblastn |
| 6880 | LYD501 | kiwi\|gb166\|FG422741_T1 | 13051 | 701 | 80.7 | glotblastn |
| 6881 | LYD501 | soybean\|11v1\|GLYMA17G04410 | 13052 | 701 | 80.7 | glotblastn |
| 6882 | LYD501 | cichorium\|gb171\|DT211534_T1 | 13053 | 701 | 80.7 | glotblastn |
| 6883 | LYD501 | utricularia\|11v1\|SRR094438.112663_P1 | 13054 | 701 | 80.6 | globlastp |
| 6884 | LYD501 | canola\|11v1\|EV117604_T1 | 13055 | 701 | 80.5 | glotblastn |
| 6885 | LYD501 | thalictrum\|11v1\|SRR096787X113596_T1 | 13056 | 701 | 80.5 | glotblastn |
| 6886 | LYD501 | vinca\|11v1\|SRR098690X129395_T1 | 13057 | 701 | 80.5 | glotblastn |
| 6887 | LYD501 | cotton\|10v2\|BG442655_T1 | 13058 | 701 | 80.5 | glotblastn |
| 6888 | LYD501 | cotton\|10v2\|DR453534_T1 | 13059 | 701 | 80.5 | glotblastn |
| 6889 | LYD501 | switchgrass\|gb167\|DN142163 | 13060 | 701 | 80.5 | glotblastn |
| 6890 | LYD501 | switchgrass\|gb167\|FE626595 | 13061 | 701 | 80.5 | glotblastn |
| 6891 | LYD501 | olea\|11v1\|SRR014463.34522XX1_P1 | 13062 | 701 | 80.4 | globlastp |
| 6892 | LYD501 | amorphophallus\|11v2\|SRR089351X10240XX1_T1 | 13063 | 701 | 80.4 | glotblastn |
| 6893 | LYD501 | arnica\|11v1\|SRR099034X107501_T1 | 13064 | 701 | 80.4 | glotblastn |
| 6894 | LYD501 | catharanthus\|11v1\|SRR098691X101336_T1 | 13065 | 701 | 80.4 | glotblastn |
| 6895 | LYD501 | euonymus\|11v1\|SRR070038X634481_T1 | 13066 | 701 | 80.4 | glotblastn |
| 6896 | LYD501 | flaveria\|11v1\|SRR149229.262100XX2_T1 | 13067 | 701 | 80.4 | glotblastn |
| 6897 | LYD501 | oat\|11v1\|GR330195_T1 | 13068 | 701 | 80.4 | glotblastn |
| 6898 | LYD501 | phalaenopsis\|11v1\|SRR125771.1002583_T1 | 13069 | 701 | 80.4 | glotblastn |
| 6899 | LYD501 | plantago\|11v1\|SRRT1066373X101008_T1 | 13070 | 701 | 80.4 | glotblastn |
| 6900 | LYD501 | scabiosa\|11v1\|SRR063723X112974_T1 | 13071 | 701 | 80.4 | glotblastn |
| 6901 | LYD501 | tabernaemontana\|11v1\|SRR098689X103838_T1 | 13072 | 701 | 80.4 | glotblastn |
| 6902 | LYD501 | tabernaemontana\|11v1\|SRR098689X115418_T1 | 13073 | 701 | 80.4 | glotblastn |
| 6903 | LYD501 | trigonella\|11v1\|SRR066194X143892_T1 | 13074 | 701 | 80.4 | glotblastn |
| 6904 | LYD501 | arabidopsis\|10v1\|AT2G30730_T1 | 13075 | 701 | 80.4 | glotblastn |
| 6905 | LYD501 | brachypodium\|09v1\|GT762793_T1 | 13076 | 701 | 80.4 | glotblastn |
| 6906 | LYD501 | catharanthus\|gb166\|FD416078 | 13077 | 701 | 80.4 | glotblastn |
| 6907 | LYD501 | cenchrus\|gb166\|EB661212_T1 | 13078 | 701 | 80.4 | glotblastn |
| 6908 | LYD501 | kiwi\|gb166\|FG397290_T1 | 13079 | 701 | 80.4 | glotblastn |
| 6909 | LYD501 | liriodendron\|gb166\|FD495051_T1 | 13080 | 701 | 80.4 | glotblastn |
| 6910 | LYD501 | medicago\|09v1\|AW684813_T1 | 13081 | 701 | 80.4 | glotblastn |
| 6911 | LYD501 | oat\|10v2\|GO589888 | 13082 | 701 | 80.4 | glotblastn |
| 6912 | LYD501 | prunus\|10v1\|BU042095 | 13083 | 701 | 80.4 | glotblastn |
| 6913 | LYD501 | senecio\|gb170\|DY665675 | 13084 | 701 | 80.2 | globlastp |
| 6914 | LYD501 | valeriana\|11v1\|SRR099039X104387XX1_T1 | 13085 | 701 | 80.2 | glotblastn |
| 6915 | LYD501 | aquilegia\|10v2\|DR917214_T1 | 13086 | 701 | 80.2 | glotblastn |
| 6916 | LYD501 | barley\|10v2\|AV832515_T1 | 13087 | 701 | 80.2 | glotblastn |
| 6917 | LYD501 | oat\|10v2\|GR326255 | 13088 | 701 | 80.2 | glotblastn |
| 6918 | LYD501 | oat\|11v1\|GR326255_T1 | 13088 | 701 | 80.2 | glotblastn |
| 6919 | LYD501 | pine\|10v2\|BQ696329_T1 | 13089 | 701 | 80.2 | glotblastn |
| 6920 | LYD501 | switchgrass\|gb167\|FE615870 | 13090 | 701 | 80.0 | glotblastn |
| 6921 | LYD514 | soybean\|11v1\|GLYMA17G15380 | 13091 | 702 | 91.6 | globlastp |
| 6922 | LYD514 | cowpea\|gb166\|FG813581_P1 | 13092 | 702 | 87.9 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6923 | LYD514 clover\|gb162\|BB913334_P1 | 13093 | 702 | 81.3 | globlastp |
| 6924 | LYD514 medicago\|09v1\|AW257356_T1 | 13094 | 702 | 80.1 | glotblastn |
| 6925 | LYD306 radish\|gb164\|EV544503 | 13095 | 704 | 93.3 | globlastp |
| 6926 | LYD306 flaveria\|11v1\|SRR149229.509874_P1 | 13096 | 704 | 90.8 | globlastp |
| 6927 | LYD306 safflower\|gb162\|DQ534204 | 13097 | 704 | 90.8 | globlastp |
| 6928 | LYD306 ambrosia\|11v1\|SRR346935.260049_T1 | 13098 | 704 | 90.8 | glotblastn |
| 6929 | LYD306 cirsium\|11v1\|SRR346952.100256_T1 | 13099 | 704 | 90.8 | glotblastn |
| 6930 | LYD306 artemisia\|10v1\|SRR019254S0009872_T1 | 13100 | 704 | 90.8 | glotblastn |
| 6931 | LYD306 foxtail_millet\|10v2\|OXFXTRMSLX00001012D1T1 | 13101 | 704 | 90.8 | glotblastn |
| 6932 | LYD306 guizotia\|10v1\|GE553022_T1 | 13102 | 704 | 90.8 | glotblastn |
| 6933 | LYD306 millet\|10v1\|EVO454PM721643_T1 | 13101 | 704 | 90.8 | glotblastn |
| 6934 | LYD306 tragopogon\|10v1\|SRR020205S0000115 | 13103 | 704 | 90.8 | glotblastn |
| 6935 | LYD306 cotton\|10v2\|BF270030_T1 | 13104 | 704 | 89.9 | glotblastn |
| 6936 | LYD306 sunflower\|10v1\|Z49775 | 13105 | 704 | 89.9 | glotblastn |
| 6937 | LYD306 eucalyptus\|gb166\|CT988295 | 13106 | 704 | 89.9 | globlastp |
| 6938 | LYD306 poppy\|gb166\|FE965747_P1 | 13107 | 704 | 89.9 | globlastp |
| 6939 | LYD306 phyla\|11v2\|SRR099037X10112XX1_P1 | 13108 | 704 | 89.1 | globlastp |
| 6940 | LYD306 silene\|11v1\|HM099805_P1 | 13109 | 704 | 89.1 | globlastp |
| 6941 | LYD306 acacia\|10v1\|FS585063_P1 | 13110 | 704 | 89.1 | globlastp |
| 6942 | LYD306 amorphophallus\|11v2\|SRR089351X152955_T1 | 13111 | 704 | 89.1 | glotblastn |
| 6943 | LYD306 cirsium\|11v1\|SRR346952.1004757_T1 | 13112 | 704 | 89.1 | glotblastn |
| 6944 | LYD306 beet\|gb162\|BI543693_T1 | 13113 | 704 | 89.1 | glotblastn |
| 6945 | LYD306 onion\|gb162\|Z49772_T1 | 13114 | 704 | 89.1 | glotblastn |
| 6946 | LYD306 amsonia\|11v1\|SRR098688X113969_T1 | 13115 | 704 | 88.2 | glotblastn |
| 6947 | LYD306 maritime_pine\|10v1\|SRR073317S0084939_P1 | 13116 | 704 | 88.2 | globlastp |
| 6948 | LYD306 triphysaria\|10v1\|EY129772 | 13117 | 704 | 88.2 | globlastp |
| 6949 | LYD306 flax\|11v1\|JG032950_P1 | 13118 | 704 | 87.4 | globlastp |
| 6950 | LYD306 euonymus\|11v1\|SRR070038X114200_T1 | 13119 | 704 | 87.4 | glotblastn |
| 6951 | LYD306 oak\|10v1\|SRR006309S0021947_T1 | 13120 | 704 | 87.4 | glotblastn |
| 6952 | LYD306 citrus\|gb166\|CX046781_T1 | 13121 | 704 | 86.6 | glotblastn |
| 6953 | LYD306 peanut\|10v1\|SRR042413 S0027002_T1 | 13122 | 704 | 85.7 | glotblastn |
| 6954 | LYD306 phalaenopsis\|11v1\|SRR125771.1304731_P1 | 13123 | 704 | 85.7 | globlastp |
| 6955 | LYD306 poplar\|10v1\|XM002338219_P1 | 13124 | 704 | 85.7 | globlastp |
| 6956 | LYD306 fagopyrum\|11v1\|SRR063689X103218_T1 | 13125 | 704 | 84.9 | glotblastn |
| 6957 | LYD306 distylium\|11v1\|SRR065077X213098_P1 | 13126 | 704 | 84.0 | globlastp |
| 6958 | LYD308 thellungiella_halophilum\|11v1\|BY801512_P1 | 13127 | 705 | 83.4 | globlastp |
| 6959 | LYD310 arabidopsis_lyrata\|09v1\|JGIAL015317_P1 | 13128 | 706 | 96.5 | globlastp |
| 6960 | LYD310 radish\|gb164\|EV566941 | 13129 | 706 | 88.4 | globlastp |
| 6961 | LYD310 radish\|gb164\|EV536862 | 13130 | 706 | 87.7 | glotblastn |
| 6962 | LYD310 canola\|10v1\|CD818340 | 13131 | 706 | 87.3 | globlastp |
| 6963 | LYD310 canola\|11v1\|DY020145_P1 | 13131 | 706 | 87.3 | globlastp |
| 6964 | LYD310 thellungiella_halophilum\|11v1\|DN773273_P1 | 13132 | 706 | 86.1 | globlastp |
| 6965 | LYD310 thellungiella_parvulum\|11v1\|DN773273_P1 | 13133 | 706 | 85.3 | globlastp |
| 6966 | LYD347 canola\|11v1\|CN827902_P1 | 13134 | 708 | 97.4 | globlastp |
| 6966 | LYD382 canola\|11v1\|CN827902_P1 | 13134 | 730 | 82.8 | globlastp |
| 6967 | LYD347 canola\|10v1\|CD817392 | 13134 | 708 | 97.4 | globlastp |
| 6967 | LYD382 canola\|10v1\|CD817392 | 13134 | 730 | 82.8 | globlastp |
| 6968 | LYD347 canola\|11v1\|CN729912_P1 | 13135 | 708 | 97.1 | globlastp |
| 6968 | LYD382 canola\|11v1\|CN729912_P1 | 13135 | 730 | 82.6 | globlastp |
| 6969 | LYD347 b_rapa\|gb162\|CA992216_P1 | 13135 | 708 | 97.1 | globlastp |
| 6969 | LYD382 b_rapa\|gb162\|CA992216_P1 | 13135 | 730 | 82.6 | globlastp |
| 6970 | LYD347 canola\|10v1\|CN729912 | 13135 | 708 | 97.1 | globlastp |
| 6970 | LYD382 canola\|10v1\|CN729912 | 13135 | 730 | 82.6 | globlastp |
| 6971 | LYD347 thellungiella_parvulum\|11v1\|DN772935_P1 | 13136 | 708 | 95.3 | globlastp |
| 6971 | LYD382 thellungiella_parvulum\|11v1\|DN772935_P1 | 13136 | 730 | 83.0 | globlastp |
| 6972 | LYD347 thellungiella_halophilum\|11v1\|DN772935_P1 | 13137 | 708 | 95.0 | globlastp |
| 6972 | LYD382 thellungiella_halophilum\|11v1\|DN772935_P1 | 13137 | 730 | 82.8 | globlastp |
| 6973 | LYD347 arabidopsis_lyrata\|09v1\|JGIAL021172_P1 | 13138 | 708 | 93.2 | globlastp |
| 6973 | LYD382 arabidopsis_lyrata\|09v1\|JGIAL021172_P1 | 13138 | 730 | 83.6 | globlastp |
| 6974 | LYD347 canola\|11v1\|EV078870_P1 | 13139 | 708 | 92.2 | globlastp |
| 6974 | LYD382 canola\|11v1\|EV078870_P1 | 13139 | 730 | 80.4 | globlastp |
| 6975 | LYD347 thellungiella_parvulum\|11v1\|EPCRP013529_P1 | 13140 | 708 | 87.5 | globlastp |
| 6976 | LYD347 thellungiella_halophilum\|11v1\|EHJGI11004548_P1 | 13141 | 708 | 86.9 | globlastp |
| 6977 | LYD347 iceplant\|gb164\|BE035085_P1 | 13142 | 708 | 84.7 | globlastp |
| 6977 | LYD382 iceplant\|gb164\|BE035085_P1 | 13142 | 730 | 86.5 | globlastp |
| 6978 | LYD347 fraxinus\|11v1\|SRR058827.105118_T1 | 13143 | 708 | 81.7 | glotblastn |
| 6978 | LYD382 fraxinus\|11v1\|SRR058827.105118_T1 | 13143 | 730 | 87.4 | glotblastn |
| 6979 | LYD347 phalaenopsis\|11v1\|SRR125771.100024_P1 | 13144 | 708 | 80.7 | globlastp |
| 6979 | LYD382 phalaenopsis\|11v1\|SRR125771.100024_P1 | 13144 | 730 | 83.2 | globlastp |
| 6980 | LYD347 phalaenopsis\|11v1\|SRR125771.1001147_P1 | 13144 | 708 | 80.7 | globlastp |
| 6980 | LYD382 phalaenopsis\|11v1\|SRR125771.1001147_P1 | 13144 | 730 | 83.2 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 6981 | LYD347 phalaenopsis\|11v1\|SRR125771.1040645_P1 | 13144 | 708 | 80.7 | globlastp |
| 6981 | LYD382 phalaenopsis\|11v1\|SRR125771.1040645_P1 | 13144 | 730 | 83.2 | globlastp |
| 6982 | LYD348 canola\|10v1\|AI352748 | 13145 | 709 | 96.4 | globlastp |
| 6983 | LYD348 canola\|11v1\|AI352748_P1 | 13146 | 709 | 95.5 | globlastp |
| 6984 | LYD348 thellungiella_parvulum\|11v1\|EPCRP018865_P1 | 13147 | 709 | 90.3 | globlastp |
| 6985 | LYD348 thellungiella_halophilum\|11v1\|EHJGI11011405_P1 | 13148 | 709 | 89.2 | globlastp |
| 6986 | LYD348 arabidopsis_lyrata\|09v1\|GFXEU351066X1_P1 | 13149 | 709 | 85.7 | globlastp |
| 6987 | LYD348 arabidopsis\|10v1\|AT1G67070_P1 | 13150 | 709 | 84.7 | globlastp |
| 6988 | LYD349 canola\|11v1\|EE472700_P1 | 13151 | 710 | 81.9 | globlastp |
| 6989 | LYD349 canola\|10v1\|CD824560 | 13152 | 710 | 80.9 | globlastp |
| 6990 | LYD351 b_rapa\|gb162\|DN960551_P1 | 13153 | 711 | 99.5 | globlastp |
| 6991 | LYD351 thellungiella_halophilum\|11v1\|BY818615_P1 | 13154 | 711 | 95.0 | globlastp |
| 6992 | LYD351 thellungiella_parvulum\|11v1\|BY818616_P1 | 13155 | 711 | 93.5 | globlastp |
| 6993 | LYD351 canola\|11v1\|ES978033_P1 | 13156 | 711 | 89.2 | globlastp |
| 6994 | LYD351 arabidopsis_lyrata\|09v1\|JGIAL003298_P1 | 13157 | 711 | 80.9 | globlastp |
| 6995 | LYD352 canola\|11v1\|EE425385_P1 | 13158 | 712 | 99.0 | globlastp |
| 6996 | LYD352 canola\|11v1\|CN827475_P1 | 13159 | 712 | 99.0 | globlastp |
| 6997 | LYD352 canola\|10v1\|E174560 | 13160 | 712 | 98.6 | globlastp |
| 6998 | LYD352 thellungiella_halophilum\|11v1\|EC598964_P1 | 13161 | 712 | 96.7 | globlastp |
| 6999 | LYD352 thellungiella_parvulum\|11v1\|BY824747_P1 | 13162 | 712 | 96.7 | globlastp |
| 7000 | LYD352 arabidopsis\|10v1\|AT1G23190_P1 | 13163 | 712 | 96.6 | globlastp |
| 7001 | LYD352 arabidopsis_lyrata\|09v1\|JGIAL002495_P1 | 13164 | 712 | 96.2 | globlastp |
| 7002 | LYD352 b_rapa\|gb162\|CV432482_P1 | 13165 | 712 | 96.1 | globlastp |
| 7003 | LYD352 canola\|10v1\|CD814120 | 13165 | 712 | 96.1 | globlastp |
| 7004 | LYD352 canola\|11v1\|DY000898_P1 | 13166 | 712 | 96.1 | globlastp |
| 7005 | LYD352 canola\|11v1\|DY025603_P1 | 13167 | 712 | 95.4 | globlastp |
| 7006 | LYD352 canola\|10v1\|CD816377 | 13168 | 712 | 94.9 | globlastp |
| 7007 | LYD352 thellungiella_halophilum\|11v1\|DN775664_P1 | 13169 | 712 | 91.6 | globlastp |
| 7008 | LYD352 arabidopsis_lyrata\|09v1\|JGIAL007312_P1 | 13170 | 712 | 91.6 | globlastp |
| 7009 | LYD352 arabidopsis\|10v1\|AT1G70730_P1 | 13171 | 712 | 91.5 | globlastp |
| 7010 | LYD352 thellungiella_parvulum\|11v1\|DN775664_P1 | 13172 | 712 | 89.6 | globlastp |
| 7011 | LYD352 melon\|10v1\|ES597113_T1 | 13173 | 712 | 88.7 | glotblastn |
| 7012 | LYD352 watermelon\|11v1\|ES597113_P1 | 13174 | 712 | 88.5 | globlastp |
| 7013 | LYD352 cassava\|09v1\|CK645485_P1 | 13175 | 712 | 88.4 | globlastp |
| 7014 | LYD352 chestnut\|gb170\|SRR006295S0001891_P1 | 13176 | 712 | 88.3 | globlastp |
| 7015 | LYD352 cassava\|09v1\|CK646348_P1 | 13177 | 712 | 88.2 | globlastp |
| 7016 | LYD352 citrus\|gb166\|AY112996_P1 | 13178 | 712 | 88.2 | globlastp |
| 7017 | LYD352 cotton\|10v2\|AI054958_P1 | 13179 | 712 | 88.2 | globlastp |
| 7018 | LYD352 oak\|10v1\|FP028010_P1 | 13180 | 712 | 88.2 | globlastp |
| 7019 | LYD352 nasturtium\|10v1\|SRR032558S0012721 | 13181 | 712 | 88.0 | globlastp |
| 7020 | LYD352 cacao\|10v1\|CU491225_P1 | 13182 | 712 | 88.0 | globlastp |
| 7021 | LYD352 castorbean\|09v1\|EE260732 | 13183 | 712 | 87.8 | globlastp |
| 7022 | LYD352 castorbean\|11v1\|EE260732_P1 | 13183 | 712 | 87.8 | globlastp |
| 7023 | LYD352 cucumber\|09v1\|DN909403_T1 | 13184 | 712 | 87.7 | glotblastn |
| 7024 | LYD352 clementine\|11v1\|AY112996_P1 | 13185 | 712 | 87.7 | globlastp |
| 7025 | LYD352 cotton\|10v2\|BQ402877_P1 | 13186 | 712 | 87.7 | globlastp |
| 7026 | LYD352 peanut\|10v1\|EE125729_P1 | 13187 | 712 | 87.3 | globlastp |
| 7027 | LYD352 euonymus\|11v1\|SRR070038X103220_P1 | 13188 | 712 | 87.2 | globlastp |
| 7028 | LYD352 flaveria\|11v1\|SRR149229.101466_P1 | 13189 | 712 | 87.0 | globlastp |
| 7029 | LYD352 eucalyptus\|11v2\|CB967512_P1 | 13190 | 712 | 86.8 | globlastp |
| 7030 | LYD352 flaveria\|11v1\|SRR149229.401544_P1 | 13191 | 712 | 86.8 | globlastp |
| 7031 | LYD352 flaveria\|11v1\|SRR149238.271423_P1 | 13192 | 712 | 86.8 | globlastp |
| 7032 | LYD352 aquilegia\|10v2\|DR920183_P1 | 13193 | 712 | 86.6 | globlastp |
| 7033 | LYD352 euonymus\|11v1\|SRR070038X156938_P1 | 13194 | 712 | 86.5 | globlastp |
| 7034 | LYD352 chelidonium\|11v1\|SRR084752X110277_P1 | 13195 | 712 | 86.3 | globlastp |
| 7035 | LYD352 sunflower\|10v1\|DY940715 | 13196 | 712 | 86.3 | globlastp |
| 7036 | LYD352 platanus\|11v1\|SRPR1096786X111135_P1 | 13197 | 712 | 86.1 | globlastp |
| 7037 | LYD352 flaveria\|11v1\|SRR149229.11664_P1 | 13198 | 712 | 86.0 | globlastp |
| 7038 | LYD352 phyla\|11v2\|SRR099035X106669_P1 | 13199 | 712 | 86.0 | globlastp |
| 7039 | LYD352 trigonella\|11v1\|SRR066194X114438_P1 | 13200 | 712 | 86.0 | globlastp |
| 7040 | LYD352 grape\|11v1\|GSVIVT01011700001_P1 | 13201 | 712 | 86.0 | globlastp |
| 7041 | LYD352 grape\|gb160\|BQ793452 | 13201 | 712 | 86.0 | globlastp |
| 7042 | LYD352 amsonia\|11v1\|SRR098688X113486_P1 | 13202 | 712 | 85.9 | globlastp |
| 7043 | LYD352 cirsium\|11v1\|SRR346952.1000280_P1 | 13203 | 712 | 85.8 | globlastp |
| 7044 | LYD352 valeriana\|11v1\|SRR099039X10581_P1 | 13204 | 712 | 85.8 | globlastp |
| 7045 | LYD352 monkeyflower\|10v1\|DV206089_P1 | 13205 | 712 | 85.8 | globlastp |
| 7046 | LYD352 triphysaria\|10v1\|EX984750 | 13206 | 712 | 85.6 | globlastp |
| 7047 | LYD352 ambrosia\|11v1\|SRR346935.151767_P1 | 13207 | 712 | 85.4 | globlastp |
| 7048 | LYD352 centaurea\|gb166\|EH711873_P1 | 13208 | 712 | 85.4 | globlastp |
| 7049 | LYD352 poplar\|10v1\|BI122177_P1 | 13209 | 712 | 85.4 | globlastp |
| 7050 | LYD352 arnica\|11v1\|SRR099034X102901_P1 | 13210 | 712 | 85.3 | globlastp |

TABLE 54-continued

Homologous polynucleotides and polypeptides which can increase plant yield, seed
yield, oil yield, oil content, growth rate, fiber yield, fiber quality, biomass, vigor,
ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 7051 | LYD352 cynara\|gb167\|GE579086_P1 | 13211 | 712 | 85.3 | globlastp |
| 7052 | LYD352 soybean\|11v1\|GLYMA05G34790 | 13212 | 712 | 85.3 | globlastp |
| 7053 | LYD352 ambrosia\|11v1\|SRR346943.100221_P1 | 13213 | 712 | 85.1 | globlastp |
| 7054 | LYD352 vinca\|11v1\|SRR098690X109122_P1 | 13214 | 712 | 85.1 | globlastp |
| 7055 | LYD352 vinca\|11v1\|SRR098690X134419_P1 | 13215 | 712 | 85.1 | globlastp |
| 7056 | LYD352 lettuce\|10v1\|DW044063_P1 | 13216 | 712 | 85.1 | globlastp |
| 7057 | LYD352 prunus\|10v1\|BU039293 | 13217 | 712 | 85.1 | globlastp |
| 7058 | LYD352 soybean\|11v1\|GLYMA08G04890 | 13218 | 712 | 85.1 | globlastp |
| 7059 | LYD352 cowpea\|gb166\|ES884082_P1 | 13219 | 712 | 85.1 | globlastp |
| 7060 | LYD352 medicago\|09v1\|AW299179_P1 | 13220 | 712 | 85.1 | globlastp |
| 7061 | LYD352 cirsium\|11v1\|SRR346952.101576_P1 | 13221 | 712 | 84.9 | globlastp |
| 7062 | LYD352 eucalyptus\|11v2\|CD668683_P1 | 13222 | 712 | 84.9 | globlastp |
| 7063 | LYD352 flaveria\|11v1\|SRR149229.226355_P1 | 13223 | 712 | 84.9 | globlastp |
| 7064 | LYD352 cichorium\|gb171\|EH673920_P1 | 13224 | 712 | 84.8 | globlastp |
| 7065 | LYD352 pea\|09v1\|AJ250769 | 13225 | 712 | 84.8 | globlastp |
| 7066 | LYD352 pea\|11v1\|AJ250769_P1 | 13225 | 712 | 84.8 | globlastp |
| 7067 | LYD352 strawberry\|11v1\|CO379511 | 13226 | 712 | 84.6 | globlastp |
| 7068 | LYD352 tabernaemontana\|11v1\|SRR098689X104686_P1 | 13227 | 712 | 84.4 | globlastp |
| 7069 | LYD352 catharanthus\|11v1\|EG556386_P1 | 13228 | 712 | 84.2 | globlastp |
| 7070 | LYD352 apple\|gb171\|CN887990 | 13229 | 712 | 84.2 | globlastp |
| 7071 | LYD352 rice\|gb170\|OS03G50480 | 13230 | 712 | 84.2 | globlastp |
| 7072 | LYD352 switchgrass\|gb167\|DN150596 | 13231 | 712 | 83.9 | globlastp |
| 7073 | LYD352 switchgrass\|gb167\|FE598837 | 13232 | 712 | 83.9 | globlastp |
| 7074 | LYD352 millet\|10v1\|EVO454PM004450P1 | 13233 | 712 | 83.9 | globlastp |
| 7075 | LYD352 sunflower\|10v1\|CD857473 | 13234 | 712 | 83.7 | globlastp |
| 7076 | LYD352 potato\|10v1\|BF459951_P1 | 13235 | 712 | 83.7 | globlastp |
| 7077 | LYD352 maize\|10v1\|ZMU89342_P1 | 13236 | 712 | 83.7 | globlastp |
| 7078 | LYD352 tomato\|11v1\|BG132150_P1 | 13237 | 712 | 83.6 | globlastp |
| 7079 | LYD352 maize\|10v1\|ZMU89341_P1 | 13238 | 712 | 83.6 | globlastp |
| 7080 | LYD352 sorghum\|09v1\|SB01G010280 | 13239 | 712 | 83.6 | globlastp |
| 7081 | LYD352 sorghum\|11v1\|SB01G010280_P1 | 13239 | 712 | 83.6 | globlastp |
| 7082 | LYD352 cephalotaxus\|11v1\|SRR064395X100946_P1 | 13240 | 712 | 83.4 | globlastp |
| 7083 | LYD352 tobacco\|gb162\|AB055503 | 13241 | 712 | 83.4 | globlastp |
| 7084 | LYD352 tomato\|09v1\|BG132150 | 13242 | 712 | 83.4 | globlastp |
| 7085 | LYD352 fescue\|gb161\|DT681692_P1 | 13243 | 712 | 83.4 | globlastp |
| 7086 | LYD352 sugarcane\|10v1\|BU925781 | 13244 | 712 | 83.4 | globlastp |
| 7087 | LYD352 barley\|10v2\|BE412460_P1 | 13245 | 712 | 83.0 | globlastp |
| 7088 | LYD352 iceplant\|gb164\|MCU84888_P1 | 13246 | 712 | 82.9 | globlastp |
| 7089 | LYD352 apple\|gb171\|CN496969 | 13247 | 712 | 82.9 | globlastp |
| 7090 | LYD352 wheat\|10v2\|BF200900 | 13248 | 712 | 82.8 | globlastp |
| 7091 | LYD352 wheat\|10v2\|BE406973 | 13249 | 712 | 82.7 | globlastp |
| 7092 | LYD352 flaveria\|11v1\|SRR149232.100742_T1 | 13250 | 712 | 82.6 | glotblastn |
| 7093 | LYD352 spruce\|gb162\|CO218052 | 13251 | 712 | 82.4 | globlastp |
| 7094 | LYD352 podocarpus\|10v1\|SRR065014S0004087_P1 | 13252 | 712 | 82.4 | globlastp |
| 7095 | LYD352 zostera\|10v1\|AM767609 | 13253 | 712 | 82.3 | globlastp |
| 7096 | LYD352 brachypodium\|09v1\|DV471917_P1 | 13254 | 712 | 82.2 | globlastp |
| 7097 | LYD352 flaveria\|11v1\|SRR149229.103711_P1 | 13255 | 712 | 82.0 | globlastp |
| 7098 | LYD352 oat\|11v1\|CN821643_P1 | 13256 | 712 | 82.0 | globlastp |
| 7099 | LYD352 oat\|10v2\|CN815680 | 13256 | 712 | 82.0 | globlastp |
| 7100 | LYD352 oat\|11v1\|CN815680_P1 | 13257 | 712 | 82.0 | globlastp |
| 7101 | LYD352 pseudotsuga\|10v1\|SRR065119S0006408 | 13258 | 712 | 81.8 | globlastp |
| 7102 | LYD352 maritime_pine\|10v1\|BX252576_P1 | 13259 | 712 | 81.7 | globlastp |
| 7103 | LYD352 pine\|10v2\|AA739897_P1 | 13260 | 712 | 81.7 | globlastp |
| 7104 | LYD352 coffea\|10v1\|DV664147_P1 | 13261 | 712 | 80.5 | globlastp |
| 7105 | LYD352 euphorbia\|11v1\|DV127964_P1 | 13262 | 712 | 80.4 | globlastp |
| 7106 | LYD352 abies\|11v2\|SRR098676X105259_P1 | 13263 | 712 | 80.3 | globlastp |
| 7107 | LYD353 canola\|11v1\|EV044918_P1 | 13264 | 713 | 99.8 | globlastp |
| 7108 | LYD353 canola\|11v1\|EE447036_P1 | 13265 | 713 | 97.9 | globlastp |
| 7109 | LYD353 canola\|10v1\|CD827120 | 13266 | 713 | 91.6 | globlastp |
| 7110 | LYD353 canola\|11v1\|DY005537_P1 | 13267 | 713 | 86.0 | globlastp |
| 7111 | LYD353 canola\|11v1\|EE490789_P1 | 13268 | 713 | 86.0 | globlastp |
| 7112 | LYD354 canola\|11v1\|DY010870_P1 | 13269 | 714 | 98.9 | globlastp |
| 7113 | LYD354 canola\|11v1\|CN829982_P1 | 13270 | 714 | 98.6 | globlastp |
| 7114 | LYD354 thellungiella_parvulum\|11v1\|DN77 6813_P1 | 13271 | 714 | 94.1 | globlastp |
| 7115 | LYD354 thellungiella_halophilum\|11v1\|DN776813_P1 | 13272 | 714 | 93.7 | globlastp |
| 7116 | LYD354 arabidopsis\|10v1\|AT5G15410_P1 | 13273 | 714 | 93.0 | globlastp |
| 7117 | LYD354 arabidopsis_lyrata\|09v1\|JGIAL021237_P1 | 13274 | 714 | 92.3 | globlastp |
| 7118 | LYD356 canola\|11v1\|EE455553_P1 | 13275 | 715 | 97.3 | globlastp |
| 7119 | LYD356 canola\|10v1\|CD820930 | 13276 | 715 | 84.4 | globlastp |
| 7120 | LYD358 thellungiella_halophilum\|11v1\|DN778236_P1 | 13277 | 717 | 96.9 | globlastp |
| 7121 | LYD358 thellungiella_parvulum\|11v1\|DN778236_P1 | 13278 | 717 | 96.9 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 7122 | LYD358 radish\|gb164\|EX777392 | 13279 | 717 | 96.7 | globlastp |
| 7123 | LYD358 canola\|11v1\|ES912660_P1 | 13280 | 717 | 96.5 | globlastp |
| 7124 | LYD358 canola\|11v1\|DY016227_T1 | 13281 | 717 | 96.5 | glotblastn |
| 7125 | LYD358 arabidopsis_lyrata\|09v1\|JGIAL025650_P1 | 13282 | 717 | 96.0 | globlastp |
| 7126 | LYD358 arabidopsis\|10v1\|AT4G24550_T1 | 13283 | 717 | 95.8 | glotblastn |
| 7127 | LYD358 canola\|11v1\|EG020096_P1 | 13284 | 717 | 95.3 | globlastp |
| 7128 | LYD358 canola\|11v1\|H07818_P1 | 13285 | 717 | 94.9 | globlastp |
| 7129 | LYD358 cotton\|10v2\|DW239378_P1 | 13286 | 717 | 88.1 | globlastp |
| 7130 | LYD358 castorbean\|09v1\|XM002513985 | 13287 | 717 | 87.0 | globlastp |
| 7131 | LYD358 castorbean\|11v1\|XM_002513985_P1 | 13287 | 717 | 87.0 | globlastp |
| 7132 | LYD358 poplar\|10v1\|BI128436_P1 | 13288 | 717 | 85.8 | globlastp |
| 7133 | LYD358 cassava\|09v1\|DB923069_P1 | 13289 | 717 | 85.7 | globlastp |
| 7134 | LYD358 tragopogon\|10v1\|SRR020205S0003750 | 13290 | 717 | 85.4 | globlastp |
| 7135 | LYD358 nasturtium\|10v1\|SRR032558S0018798 | 13291 | 717 | 85.1 | globlastp |
| 7136 | LYD358 ambrosia\|11v1\|SRR346935.111555_P1 | 13292 | 717 | 85.0 | globlastp |
| 7137 | LYD358 centaurea\|gb166\|EH745185_T1 | 13293 | 717 | 85.0 | glotblastn |
| 7138 | LYD358 ambrosia\|11v1\|SRR346935.112597_T1 | 13294 | 717 | 84.7 | glotblastn |
| 7139 | LYD358 cotton\|10v2\|DT462230_T1 | 13295 | 717 | 84.7 | glotblastn |
| 7140 | LYD358 papaya\|gb165\|EX228531_P1 | 13296 | 717 | 84.7 | globlastp |
| 7141 | LYD358 cichorium\|gb171\|EH674732_P1 | 13297 | 717 | 84.7 | globlastp |
| 7142 | LYD358 kiwi\|gb166\|FG472017_P1 | 13298 | 717 | 84.7 | globlastp |
| 7143 | LYD358 ambrosia\|11v1\|SRR346935.137750_T1 | 13299 | 717 | 84.5 | glotblastn |
| 7144 | LYD358 flaveria\|11v1\|SRR149229.100882_P1 | 13300 | 717 | 84.5 | globlastp |
| 7145 | LYD358 flaveria\|11v1\|SRR149229.439637_P1 | 13301 | 717 | 84.5 | globlastp |
| 7146 | LYD358 tabernaemontana\|11v1\|SRR098689X111546_P1 | 13302 | 717 | 84.5 | globlastp |
| 7147 | LYD358 sunflower\|10v1\|DY905409 | 13303 | 717 | 84.5 | globlastp |
| 7148 | LYD358 artemisia\|10v1\|EY032569_P1 | 13304 | 717 | 84.3 | globlastp |
| 7149 | LYD358 aquilegia\|10v2\|DR928698_P1 | 13305 | 717 | 84.3 | globlastp |
| 7150 | LYD358 sarracenia\|11v1\|SRR192669.101663_T1 | 13306 | 717 | 84.3 | glotblastn |
| 7151 | LYD358 melon\|10v1\|AM728198_P1 | 13307 | 717 | 84.1 | globlastp |
| 7152 | LYD358 watermelon\|11v1\|VMEL00186708740577_P1 | 13308 | 717 | 84.1 | globlastp |
| 7153 | LYD358 strawberry\|11v1\|DY667286 | 13309 | 717 | 84.1 | globlastp |
| 7154 | LYD358 grape\|11v1\|GSVIVT01009764001_P1 | 13310 | 717 | 84.1 | globlastp |
| 7155 | LYD358 grape\|gb160\|BQ793335 | 13310 | 717 | 84.1 | globlastp |
| 7156 | LYD358 ambrosia\|11v1\|SRR346935.124338_T1 | 13311 | 717 | 84.1 | glotblastn |
| 7157 | LYD358 arnica\|11v1\|SRR099034X10855_T1 | 13312 | 717 | 84.1 | glotblastn |
| 7158 | LYD358 euphorbia\|11v1\|DV128097_P1 | 13313 | 717 | 83.9 | globlastp |
| 7159 | LYD358 tomato\|11v1\|BG126403_P_1 | 13314 | 717 | 83.9 | globlastp |
| 7160 | LYD358 tomato\|09v1\|BG126403 | 13314 | 717 | 83.9 | globlastp |
| 7161 | LYD358 oak\|10v1\|FP036824_P1 | 13315 | 717 | 83.8 | globlastp |
| 7162 | LYD358 solanum_phureja\|09v1\|SPHBG126403 | 13316 | 717 | 83.7 | globlastp |
| 7163 | LYD358 cannabis\|12v1\|JK500389_P1 | 13317 | 717 | 83.4 | globlastp |
| 7164 | LYD358 prunus\|10v1\|CN493589 | 13318 | 717 | 83.4 | globlastp |
| 7165 | LYD358 clementine\|11v1\|CX074086_T1 | 13319 | 717 | 83.3 | glotblastn |
| 7166 | LYD358 orange\|11v1\|CX074086_T1 | 13319 | 717 | 83.3 | glotblastn |
| 7167 | LYD358 cirsium\|11v1\|SRR346952.101264_P1 | 13320 | 717 | 83.2 | globlastp |
| 7168 | LYD358 oak\|10v1\|DN950828_P1 | 13321 | 717 | 82.8 | globlastp |
| 7169 | LYD358 apple\|11v1\|CN493589_P1 | 13322 | 717 | 82.7 | globlastp |
| 7170 | LYD358 fagopyrum\|11v1\|SRR063689X124568_T1 | 13323 | 717 | 82.6 | glotblastn |
| 7171 | LYD358 medicago\|09v1\|AL366036_P1 | 13324 | 717 | 81.7 | globlastp |
| 7172 | LYD358 peanut\|10v1\|GO264557_P1 | 13325 | 717 | 81.6 | globlastp |
| 7173 | LYD358 phalaenopsis\|11v1\|SRR125771.1000629_P1 | 13326 | 717 | 81.5 | globlastp |
| 7174 | LYD358 amorphophallus\|11v2\|SRR089351X106804_P1 | 13327 | 717 | 81.4 | globlastp |
| 7175 | LYD358 cirsium\|11v1\|SRR346952.11143_P1 | 13328 | 717 | 81.3 | globlastp |
| 7176 | LYD358 platanus\|11v1\|SRR096786X210793_T1 | 13329 | 717 | 81.2 | glotblastn |
| 7177 | LYD358 trigonella\|11v1\|SRR066194X197002_T1 | 13330 | 717 | 81.2 | glotblastn |
| 7178 | LYD358 lotus\|09v1\|LLAW720494_P1 | 13331 | 717 | 80.8 | globlastp |
| 7179 | LYD358 pine\|10v2\|BF010789_P1 | 13332 | 717 | 80.8 | globlastp |
| 7180 | LYD358 soybean\|11v1\|GLYMA04G03220_P1 | 13333 | 717 | 80.8 | globlastp |
| 7181 | LYD358 sorghum\|11v1\|SB02G039530_P1 | 13334 | 717 | 80.5 | globlastp |
| 7182 | LYD358 monkeyflower\|10v1\|GO957776_P1 | 13335 | 717 | 80.4 | globlastp |
| 7183 | LYD358 cephalotaxus\|11v1\|SRR064395X108425_P1 | 13336 | 717 | 80.3 | globlastp |
| 7184 | LYD358 maize\|10v1\|AI861491_P1 | 13337 | 717 | 80.3 | globlastp |
| 7185 | LYD358 maritime_pine\|10v1\|CT575375_P1 | 13338 | 717 | 80.3 | globlastp |
| 7186 | LYD358 orobanche\|10v1\|SRR023189S0012328_P1 | 13339 | 717 | 80.3 | globlastp |
| 7187 | LYD358 triphysaria\|10v1\|EY135060_P1 | 13340 | 717 | 80.3 | globlastp |
| 7188 | LYD358 sugarcane\|10v1\|CA080454_P1 | 13341 | 717 | 80.1 | globlastp |
| 7189 | LYD359 canola\|10v1\|CD837791 | 13342 | 718 | 99.3 | globlastp |
| 7190 | LYD359 b_rapa\|gb162\|DQ452297_P1 | 13343 | 718 | 98.9 | globlastp |
| 7191 | LYD359 canola\|11v1\|EE439147_P1 | 13344 | 718 | 98.5 | globlastp |
| 7192 | LYD359 thellungiella_parvulum\|11v1\|DN776586_P1 | 13345 | 718 | 97.3 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 7193 | LYD359 canola\|11v1\|ES911658_P1 | 13346 | 718 | 96.5 | globlastp |
| 7194 | LYD359 canola\|11v1\|ES976488_P1 | 13347 | 718 | 96.5 | globlastp |
| 7195 | LYD359 thellungiella_halophilum\|11v1\|DN776731_P1 | 13348 | 718 | 96.5 | globlastp |
| 7196 | LYD359 arabidopsis\|10v1\|AT4G15560_P1 | 13349 | 718 | 96.0 | globlastp |
| 7197 | LYD359 arabidopsis_lyrata\|09v1\|GIAL026709_T1 | 13350 | 718 | 95.4 | glotblastn |
| 7198 | LYD359 cleome_spinosa\|10v1\|GR931196_P1 | 13351 | 718 | 88.7 | globlastp |
| 7199 | LYD359 cleome_gynandra\|10v1\|SRR015532S0002084_P1 | 13352 | 718 | 88.0 | globlastp |
| 7200 | LYD359 castorbean\|09v1\|T14878 | 13353 | 718 | 84.9 | globlastp |
| 7201 | LYD359 castorbean\|11v1\|T14878_P1 | 13354 | 718 | 84.8 | globlastp |
| 7202 | LYD359 pepper\|gb171\|Y15782_P1 | 13355 | 718 | 84.1 | globlastp |
| 7203 | LYD359 oak\|10v1\|FP027361_P1 | 13356 | 718 | 84.0 | globlastp |
| 7204 | LYD359 tabernaemontana\|11v1\|SRR098689X102047_P1 | 13357 | 718 | 84.0 | globlastp |
| 7205 | LYD359 tobacco\|gb162\|AJ291721 | 13358 | 718 | 83.9 | globlastp |
| 7206 | LYD359 poplar\|10v1\|BI069093_P1 | 13359 | 718 | 83.9 | globlastp |
| 7207 | LYD359 tomato\|11v1\|BG126679_P1 | 13360 | 718 | 83.8 | globlastp |
| 7208 | LYD359 cotton\|10v2\|ES795906_P1 | 13361 | 718 | 83.5 | globlastp |
| 7209 | LYD359 hevea\|10v1\|AY502939_P1 | 13362 | 718 | 83.3 | globlastp |
| 7210 | LYD359 citrus\|gb166\|CF417125_P1 | 13363 | 718 | 83.3 | globlastp |
| 7211 | LYD359 melon\|10v1\|VMEL00244637940219_P1 | 13364 | 718 | 83.3 | globlastp |
| 7212 | LYD359 clementine\|11v1\|CF417125_P1 | 13365 | 718 | 83.2 | globlastp |
| 7213 | LYD359 orange\|11v1\|CF417125_P1 | 13366 | 718 | 83.2 | globlastp |
| 7214 | LYD359 vinca\|11v1\|SRR098690X102700_P1 | 13367 | 718 | 83.2 | globlastp |
| 7215 | LYD359 arnica\|11v1\|SRR099034X102346_P1 | 13368 | 718 | 83.1 | globlastp |
| 7216 | LYD359 humulus\|11v1\|ES652578_P1 | 13369 | 718 | 83.1 | globlastp |
| 7217 | LYD359 phyla\|11v2\|SRR099035X104029_P1 | 13370 | 718 | 83.1 | globlastp |
| 7218 | LYD359 watermelon\|11v1\|VMEL00244637940219_P1 | 13371 | 718 | 83.1 | globlastp |
| 7219 | LYD359 catharanthus\|11v1\|SRR098691X106429_P1 | 13372 | 718 | 83.0 | globlastp |
| 7220 | LYD359 eucalyptus\|11v2\|ES590054_P1 | 13373 | 718 | 82.9 | globlastp |
| 7221 | LYD359 lotus\|09v1\|AV776968_P1 | 13374 | 718 | 82.9 | globlastp |
| 7222 | LYD359 soybean\|11v1\|GLYMA17G02480_P1 | 13375 | 718 | 82.9 | globlastp |
| 7223 | LYD359 triphysaria\|10v1\|DR172879 | 13376 | 718 | 82.9 | globlastp |
| 7224 | LYD359 cacao\|10v1\|CU477096_T1 | 13377 | 718 | 82.8 | glotblastn |
| 7225 | LYD359 apple\|gb171\|CN444902 | 13378 | 718 | 82.8 | globlastp |
| 7226 | LYD359 euphorbia\|11v1\|DV132442_P1 | 13379 | 718 | 82.7 | globlastp |
| 7227 | LYD359 soybean\|11v1\|GLYMA13G28470 | 13380 | 718 | 82.7 | globlastp |
| 7228 | LYD359 cassava\|09v1\|DV445486_P1 | 13381 | 718 | 82.7 | globlastp |
| 7229 | LYD359 sunflower\|10v1\|CX943837 | 13382 | 718 | 82.6 | globlastp |
| 7230 | LYD359 apple\|11v1\|CN443984_P1 | 13383 | 718 | 82.6 | globlastp |
| 7231 | LYD359 strawberry\|11v1\|DV440264 | 13384 | 718 | 82.6 | globlastp |
| 7232 | LYD359 prunus\|10v1\|CB823779 | 13385 | 718 | 82.5 | glotblastn |
| 7233 | LYD359 grape\|11v1\|GSVIVT01017832001_P1 | 13386 | 718 | 82.5 | globlastp |
| 7234 | LYD359 tripterygium\|11v1\|SRR098677X133991_P1 | 13387 | 718 | 82.5 | globlastp |
| 7235 | LYD359 ambrosia\|11v1\|SRR346935.112476_T1 | 13388 | 718 | 82.4 | glotblastn |
| 7236 | LYD359 monkeyflower\|10v1\|DV209763_P1 | 13389 | 718 | 82.4 | globlastp |
| 7237 | LYD359 amorphophallus\|11v2\|SRR089351X1206_T1 | 13390 | 718 | 82.4 | glotblastn |
| 7238 | LYD359 vinca\|11v1\|SRR098690X112363_P1 | 13391 | 718 | 82.2 | globlastp |
| 7239 | LYD359 aquilegia\|10v2\|DR917919_T1 | 13392 | 718 | 82.2 | glotblastn |
| 7240 | LYD359 apple\|11v1\|CN883362_P1 | 13393 | 718 | 82.1 | globlastp |
| 7241 | LYD359 flaveria\|11v1\|SRR149229.154114_P1 | 13394 | 718 | 82.1 | globlastp |
| 7242 | LYD359 plantago\|11v1\|SRR066374X117405_T1 | 13395 | 718 | 82.0 | glotblastn |
| 7243 | LYD359 amsonia\|11v1\|SRR098688X106820_P1 | 13396 | 718 | 82.0 | globlastp |
| 7244 | LYD359 medicago\|09v1\|AW689301_P1 | 13397 | 718 | 82.0 | globlastp |
| 7245 | LYD359 tomato\|09v1\|BG126679 | 13398 | 718 | 82.0 | globlastp |
| 7246 | LYD359 oil_palm\|gb166\|AY583783_P1 | 13399 | 718 | 81.9 | globlastp |
| 7247 | LYD359 flaveria\|11v1\|SRR149229.143002_T1 | 13400 | 718 | 81.8 | glotblastn |
| 7248 | LYD359 thellungiella_parvulum\|11v1\|EPCRP012424_P1 | 13401 | 718 | 81.7 | globlastp |
| 7249 | LYD359 ambrosia\|11v1\|SRR346935.612310_T1 | 13402 | 718 | 81.6 | glotblastn |
| 7250 | LYD359 salvia\|10v1\|EU670744_P1 | 13403 | 718 | 81.5 | globlastp |
| 7251 | LYD359 solanum_phureja\|09v1\|SPHBG126679 | 13404 | 718 | 81.5 | globlastp |
| 7252 | LYD359 soybean\|11v1\|GLYMA07G38260 | 13405 | 718 | 81.4 | globlastp |
| 7253 | LYD359 phalaenopsis\|11v1\|CK859150XX1_T1 | 13406 | 718 | 81.3 | glotblastn |
| 7254 | LYD359 wheat\|10v2\|BF292886_T1 | 13407 | 718 | 80.8 | glotblastn |
| 7255 | LYD359 triphysaria\|10v1\|EX984112 | 13408 | 718 | 80.7 | globlastp |
| 7256 | LYD359 foxtail_millet\|11v3\|PHY7SI021346M_P1 | 13409 | 718 | 80.6 | globlastp |
| 7257 | LYD359 arabidopsis_lyrata\|09v1\|JGIAL010748_P1 | 13410 | 718 | 80.5 | globlastp |
| 7258 | LYD359 rice\|gb170\|OS05G33840_P1 | 13411 | 718 | 80.4 | globlastp |
| 7259 | LYD359 sorghum\|11v1\|SB09G020140_P1 | 13412 | 718 | 80.4 | globlastp |
| 7260 | LYD359 maize\|10v1\|AW267504_P1 | 13413 | 718 | 80.3 | globlastp |
| 7261 | LYD359 bean\|gb167\|CA896562_P1 | 13414 | 718 | 80.1 | globlastp |
| 7262 | LYD359 brachypodium\|09v1\|DV475713_T1 | 13415 | 718 | 80.1 | glotblastn |
| 7263 | LYD359 flaveria\|11v1\|SRR149229.146166_P1 | 13416 | 718 | 80.0 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
| --- | --- | --- | --- | --- | --- |
| 7264 | LYD360 b_rapa\|gb162\|L33530_P1 | 13417 | 719 | 99.6 | globlastp |
| 7265 | LYD360 canola\|10v1\|CD825888 | 13418 | 719 | 99.6 | globlastp |
| 7266 | LYD360 radish\|gb164\|EV536913 | 13419 | 719 | 99.6 | globlastp |
| 7267 | LYD360 canola\|11v1\|EE428881_P1 | 13420 | 719 | 99.5 | globlastp |
| 7268 | LYD360 thellungiella_parvulum\|11v1\|DN773350_P1 | 13421 | 719 | 99.1 | globlastp |
| 7269 | LYD360 canola\|11v1\|DY003627_P1 | 13422 | 719 | 99.0 | globlastp |
| 7270 | LYD360 canola\|11v1\|EE457660_P1 | 13423 | 719 | 99.0 | globlastp |
| 7271 | LYD360 thellungiella_halophilum\|11v1\|DN773350_P1 | 13424 | 719 | 98.9 | globlastp |
| 7272 | LYD360 arabidopsis\|10v1\|AT3G09840_P1 | 13425 | 719 | 98.5 | globlastp |
| 7273 | LYD360 arabidopsis_lyrata\|09v1\|JGIAL009391_P1 | 13426 | 719 | 98.4 | globlastp |
| 7274 | LYD360 arabidopsis\|10v1\|AT5G03340_P1 | 13427 | 719 | 96.4 | globlastp |
| 7275 | LYD360 arabidopsis_lyrata\|09v1\|JGIAL019961_P1 | 13428 | 719 | 96.1 | globlastp |
| 7276 | LYD360 thellungiella_halophilum\|11v1\|DN776690_P1 | 13429 | 719 | 95.7 | globlastp |
| 7277 | LYD360 thellungiella_parvulum\|11v1\|DN776690_P1 | 13430 | 719 | 95.7 | globlastp |
| 7278 | LYD360 canola\|11v1\|DY020898_T1 | 13431 | 719 | 94.6 | glotblastn |
| 7279 | LYD360 vinca\|11v1\|SRR098690X113080_P1 | 13432 | 719 | 93.7 | globlastp |
| 7280 | LYD360 tabernaemontana\|11v1\|SRR098689X100752_P1 | 13433 | 719 | 93.6 | globlastp |
| 7281 | LYD360 euphorbia\|11v1\|SRR098678X102577_P1 | 13434 | 719 | 93.5 | globlastp |
| 7282 | LYD360 vinca\|11v1\|SRR098690X111803_P1 | 13435 | 719 | 93.5 | globlastp |
| 7283 | LYD360 aquilegia\|10v2\|DR930212_P1 | 13436 | 719 | 93.3 | globlastp |
| 7284 | LYD360 catharanthus\|11v1\|SRR098691X101984_P1 | 13437 | 719 | 93.2 | globlastp |
| 7285 | LYD360 silene\|11v1\|SRR096785X101301_P1 | 13438 | 719 | 93.2 | globlastp |
| 7286 | LYD360 vinca\|11v1\|SRR098690X105429_P1 | 13439 | 719 | 93.2 | globlastp |
| 7287 | LYD360 chestnut\|gb170\|SRR006295S0000641_P1 | 13440 | 719 | 93.1 | globlastp |
| 7288 | LYD360 castorbean\|09v1\|EE259385 | 13441 | 719 | 93.1 | globlastp |
| 7289 | LYD360 castorbean\|11v1\|XM_002519454_P1 | 13441 | 719 | 93.1 | globlastp |
| 7290 | LYD360 castorbean\|11v1\|EE259385_P1 | 13442 | 719 | 93.0 | globlastp |
| 7291 | LYD360 tomato\|11v1\|BG131226_P1 | 13443 | 719 | 92.9 | globlastp |
| 7292 | LYD360 solanum_phureja\|09v1\|SPHAA078722 | 13444 | 719 | 92.9 | globlastp |
| 7293 | LYD360 tomato\|09v1\|AA078722 | 13443 | 719 | 92.9 | globlastp |
| 7294 | LYD360 cassava\|09v1\|JGICASSAVA23542VALIDM1_P1 | 13445 | 719 | 92.8 | globlastp |
| 7295 | LYD360 watermelon\|11v1\|AM718298_P1 | 13446 | 719 | 92.7 | globlastp |
| 7296 | LYD360 watermelon\|11v1\|VMEL00664135361361_P1 | 13447 | 719 | 92.7 | globlastp |
| 7297 | LYD360 tobacco\|gb162\|CN824904 | 13448 | 719 | 92.7 | globlastp |
| 7298 | LYD360 oak\|10v1\|CU640839_P1 | 13449 | 719 | 92.7 | globlastp |
| 7299 | LYD360 poplar\|10v1\|AI162980_P1 | 13450 | 719 | 92.7 | globlastp |
| 7300 | LYD360 triphysaria\|10v1\|EX988582 | 13451 | 719 | 92.6 | globlastp |
| 7301 | LYD360 melon\|10v1\|DV633427_P1 | 13452 | 719 | 92.6 | globlastp |
| 7302 | LYD360 solanum_phureja\|09v1\|SPHBQ113326 | 13453 | 719 | 92.6 | globlastp |
| 7303 | LYD360 euphorbia\|11v1\|SRR098678X117908_P1 | 13454 | 719 | 92.5 | globlastp |
| 7304 | LYD360 cassava\|09v1\|DV450051_P1 | 13455 | 719 | 92.5 | globlastp |
| 7305 | LYD360 amsonia\|11v1\|SRR098688X103469_P1 | 13456 | 719 | 92.4 | globlastp |
| 7306 | LYD360 clementine\|11v1\|BE208902_P1 | 13457 | 719 | 92.4 | globlastp |
| 7307 | LYD360 grape\|11v1\|GSVIVT01025723001_P1 | 13458 | 719 | 92.4 | globlastp |
| 7308 | LYD360 orange\|11v1\|BE208902_P1 | 13457 | 719 | 92.4 | globlastp |
| 7309 | LYD360 tomato\|11v1\|BG123641_P1 | 13459 | 719 | 92.4 | globlastp |
| 7310 | LYD360 citrus\|gb166\|BE208902_P1 | 13457 | 719 | 92.4 | globlastp |
| 7311 | LYD360 solanum_phureja\|09v1\|SPHBG123641 | 13460 | 719 | 92.4 | globlastp |
| 7312 | LYD360 tomato\|09v1\|BG123641 | 13459 | 719 | 92.4 | globlastp |
| 7313 | LYD360 cotton\|10v2\|DW230981_P1 | 13461 | 719 | 92.4 | globlastp |
| 7314 | LYD360 cotton\|10v2\|SRR032367S0023066_P1 | 13462 | 719 | 92.4 | globlastp |
| 7315 | LYD360 cassava\|09v1\|FG805752_T1 | 13463 | 719 | 92.4 | glotblastn |
| 7316 | LYD360 valeriana\|11v1\|SRR099039X104541_P1 | 13464 | 719 | 92.3 | globlastp |
| 7317 | LYD360 poplar\|10v1\|AI162939_P1 | 13465 | 719 | 92.3 | globlastp |
| 7318 | LYD360 flaveria\|11v1\|SRR149229.84510_T1 | 13466 | 719 | 92.2 | glotblastn |
| 7319 | LYD360 ambrosia\|11v1\|SRR346935.108478_P1 | 13467 | 719 | 92.2 | globlastp |
| 7320 | LYD360 ambrosia\|11v1\|SRR346935.11302_P1 | 13467 | 719 | 92.2 | globlastp |
| 7321 | LYD360 cacao\|10v1\|CU470840_P1 | 13468 | 719 | 92.2 | globlastp |
| 7322 | LYD360 chelidonium\|11v1\|SRR084752X100071_P1 | 13469 | 719 | 92.2 | globlastp |
| 7323 | LYD360 trigonella\|11v1\|SRR066194X117413_P1 | 13470 | 719 | 92.2 | globlastp |
| 7324 | LYD360 cotton\|10v2\|SRR032367S0080382_P1 | 13471 | 719 | 92.2 | globlastp |
| 7325 | LYD360 cucumber\|09v1\|DN910981_P1 | 13472 | 719 | 92.2 | globlastp |
| 7326 | LYD360 pepper\|gb171\|BM064719_P1 | 13473 | 719 | 92.2 | globlastp |
| 7327 | LYD360 peanut\|10v1\|ES712536_T1 | 13474 | 719 | 92.1 | glotblastn |
| 7328 | LYD360 cotton\|10v2\|BF271145_P1 | 13475 | 719 | 92.1 | globlastp |
| 7329 | LYD360 plantago\|11v1\|SRR066373X103909_P1 | 13476 | 719 | 92.1 | globlastp |
| 7330 | LYD360 silene\|11v1\|SRR096785X100313_P1 | 13477 | 719 | 92.1 | globlastp |
| 7331 | LYD360 silene\|11v1\|SRR096785X101163_P1 | 13478 | 719 | 92.1 | globlastp |
| 7332 | LYD360 chestnut\|gb170\|SRR006295S0001538_P1 | 13479 | 719 | 92.1 | globlastp |
| 7333 | LYD360 strawberry\|11v1\|CO378670 | 13480 | 719 | 92.1 | globlastp |
| 7334 | LYD360 eucalyptus\|11v2\|CD669678_P1 | 13481 | 719 | 92.1 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name  cluster name | Polyp. SEQ ID NO: | Hom to SEQ ID NO: | % glob. iden. | Algor. |
|---|---|---|---|---|---|
| 7335 | LYD360 arabidopsis_lyrata|09v1|JGIAL018561_P1 | 13482 | 719 | 92.0 | globlastp |
| 7336 | LYD360 arnica|11v1|SRR099034X101033_T1 | 13483 | 719 | 92.0 | glotblastn |
| 7337 | LYD360 eucalyptus|11v2|CB967561_P1 | 13484 | 719 | 92.0 | globlastp |
| 7338 | LYD360 plantago|11v1|SRR066373X104113_P1 | 13485 | 719 | 92.0 | globlastp |
| 7339 | LYD360 thellungiella_parvulum|11v1|EPCRP017828_P1 | 13486 | 719 | 92.0 | globlastp |
| 7340 | LYD360 trigonella|11v1|SRR066194X103771_P1 | 13487 | 719 | 92.0 | globlastp |
| 7341 | LYD360 tripterygium|11v1|SRR098677X11232_P1 | 13488 | 719 | 92.0 | globlastp |
| 7342 | LYD360 vinca|11v1|SRR0198690X105684_P1 | 13489 | 719 | 92.0 | globlastp |
| 7343 | LYD360 cassava|09v1|JGICASSAVA24998VALIDM1_T1 | 13490 | 719 | 92.0 | glotblastn |
| 7344 | LYD360 cannabis|12v1|SOLX00041614_P1 | 13491 | 719 | 91.9 | globlastp |
| 7345 | LYD360 euonymus|11v1|SRR070038X11672_P1 | 13492 | 719 | 91.9 | globlastp |
| 7346 | LYD360 orange|11v1|CV886939_P1 | 13493 | 719 | 91.9 | globlastp |
| 7347 | LYD360 solanum_phureja|09v1|SPHBG129410 | 13494 | 719 | 91.9 | globlastp |
| 7348 | LYD360 tomato|09v1|BG129410 | 13495 | 719 | 91.9 | globlastp |
| 7349 | LYD360 phalaenopsis|11v1|SRR125771.1002738_P1 | 13496 | 719 | 91.8 | globlastp |
| 7350 | LYD360 cotton|10v2|SRR032367S0025804_T1 | 13497 | 719 | 91.7 | glotblastn |
| 7351 | LYD360 arabidopsis|10v1|AT3G53230_P1 | 13498 | 719 | 91.7 | globlastp |
| 7352 | LYD360 cacao|10v1|CU473703_P1 | 13499 | 719 | 91.7 | globlastp |
| 7353 | LYD360 soybean|11v1|GLYMA12G30060_P1 | 13500 | 719 | 91.7 | globlastp |
| 7354 | LYD360 soybean|11v1|GLYMA19G36740_P1 | 13501 | 719 | 91.7 | globlastp |
| 7355 | LYD360 apple|11v1|CN993046_P1 | 13502 | 719 | 91.6 | globlastp |
| 7356 | LYD360 clementine|11v1|CV886939_P1 | 13503 | 719 | 91.6 | globlastp |
| 7357 | LYD360 euonymus|11v1|SRR070038X129661_P1 | 13504 | 719 | 91.6 | globlastp |
| 7358 | LYD360 soybean|11v1|GLYMA03G33990_P1 | 13505 | 719 | 91.6 | globlastp |
| 7359 | LYD360 valeriana|11v1|SRR099039X101732_P1 | 13506 | 719 | 91.6 | globlastp |
| 7360 | LYD360 monkeyflower|10v1|DV208629_P1 | 13507 | 719 | 91.5 | globlastp |
| 7361 | LYD360 prunus|10v1|BU042029_P1 | 13508 | 719 | 91.5 | globlastp |
| 7362 | LYD360 kiwi|gb166|FG408431_P1 | 13509 | 719 | 91.5 | globlastp |
| 7363 | LYD360 orobanche|10v1|SRR023189S0000911_P1 | 13510 | 719 | 91.5 | globlastp |
| 7364 | LYD360 soybean|11v1|GLYMA13G20680_P1 | 13511 | 719 | 91.4 | globlastp |
| 7365 | LYD360 soybean|11v1|GLYMA13G39830_P1 | 13512 | 719 | 91.4 | globlastp |
| 7366 | LYD360 tripterygium|11v1|SRR098677X108622_P1 | 13513 | 719 | 91.4 | globlastp |
| 7367 | LYD360 sugarcane|10v1|BQ537479 | 13514 | 719 | 91.4 | globlastp |
| 7368 | LYD360 euonymus|11v1|SRR070038X108789_P1 | 13515 | 719 | 91.3 | globlastp |
| 7369 | LYD360 tomato|11v1|CA514631_P1 | 13516 | 719 | 91.3 | globlastp |
| 7370 | LYD360 rice|gb170|OS10G30580 | 13517 | 719 | 91.3 | globlastp |
| 7371 | LYD360 cucumber|09v1|DV633427_P1 | 13518 | 719 | 91.3 | globlastp |
| 7372 | LYD360 tomato|09v1|BQ113326 | 13516 | 719 | 91.3 | globlastp |
| 7373 | LYD360 ambrosia|11v1|SRR346935.122056_T1 | 13519 | 719 | 91.3 | glotblastn |
| 7374 | LYD360 prunus|10v1|BU039323 | 13520 | 719 | 91.3 | glotblastn |
| 7375 | LYD360 amorphophallus|11v2|SRR089351X10334_P1 | 13521 | 719 | 91.2 | globlastp |
| 7376 | LYD360 apple|11v1|CN490428_P1 | 13522 | 719 | 91.2 | globlastp |
| 7377 | LYD360 cannabis|12v1|JK497540_P1 | 13523 | 719 | 91.2 | globlastp |
| 7378 | LYD360 flaveria|11v1|SRR149229.176527_P1 | 13524 | 719 | 91.2 | globlastp |
| 7379 | LYD360 soybean|11v1|GLYMA10G06480_P1 | 13525 | 719 | 91.2 | globlastp |
| 7380 | LYD360 vinca|11v1|SRR098690X106865_P1 | 13526 | 719 | 91.2 | globlastp |
| 7381 | LYD360 sorghum|09v1|SB01G020910 | 13527 | 719 | 91.2 | globlastp |
| 7382 | LYD360 sorghum|11v1|SB01G020910_P1 | 13527 | 719 | 91.2 | globlastp |
| 7383 | LYD360 maize|10v1|AI372195_P1 | 13528 | 719 | 91.2 | globlastp |
| 7384 | LYD360 amsonia|11v1|SRR098688X103057_P1 | 13529 | 719 | 91.1 | globlastp |
| 7385 | LYD360 arnica|11v1|SRR099034X100738_P1 | 13530 | 719 | 91.1 | globlastp |
| 7386 | LYD360 distylium|11v1|SRR065077X1034_P1 | 13531 | 719 | 91.1 | globlastp |
| 7387 | LYD360 euonymus|11v1|SRR070038X104405_P1 | 13532 | 719 | 91.1 | globlastp |
| 7388 | LYD360 flaveria|11v1|SRR149229.101822_P1 | 13533 | 719 | 91.1 | globlastp |
| 7389 | LYD360 aquilegia|10v2|DR921618_P1 | 13534 | 719 | 91.1 | globlastp |
| 7390 | LYD360 lettuce|10v1|DW047002_T1 | 13535 | 719 | 91.0 | glotblastn |
| 7391 | LYD360 cephalotaxus|11v1|SRR064395X100320_P1 | 13536 | 719 | 91.0 | globlastp |
| 7392 | LYD360 monkeyflower|10v1|DV206722_P1 | 13537 | 719 | 91.0 | globlastp |
| 7393 | LYD360 sciadopitys|10v1|SRR065035S0005345_P1 | 13538 | 719 | 91.0 | globlastp |
| 7394 | LYD360 soybean|11v1|GLYMA11G20060_P1 | 13539 | 719 | 91.0 | globlastp |
| 7395 | LYD360 rice|gb170|OS03G05730 | 13540 | 719 | 91.0 | globlastp |
| 7396 | LYD360 sorghum|09v1|SB01G046840 | 13541 | 719 | 91.0 | globlastp |
| 7397 | LYD360 sorghum|11v1|SB01G046840_P1 | 13541 | 719 | 91.0 | globlastp |
| 7398 | LYD360 artemisia|10v1|EY038805_P1 | 13542 | 719 | 91.0 | globlastp |
| 7399 | LYD360 maize|10v1|AI901757_P1 | 13543 | 719 | 91.0 | globlastp |
| 7400 | LYD360 maize|10v1|AW054146_P1 | 13544 | 719 | 91.0 | globlastp |
| 7401 | LYD360 ambrosia|11v1|SRR346935.155102_T1 | 13545 | 719 | 90.9 | glotblastn |
| 7402 | LYD360 arnica|11v1|SRR099034X100029_P1 | 13546 | 719 | 90.9 | globlastp |
| 7403 | LYD360 catharanthus|11v1|EG555134_P1 | 13547 | 719 | 90.9 | globlastp |
| 7404 | LYD360 cephalotaxus|11v1|SRR064395X100924_P1 | 13548 | 719 | 90.9 | globlastp |
| 7405 | LYD360 amorphophallus|11v2|SRR089351X106403_P1 | 13549 | 719 | 90.8 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 7406 | LYD360 amorphophallus\|11v2\|SRR089351X108348_T1 | 13550 | 719 | 90.8 | glotblastn |
| 7407 | LYD360 taxus\|10v1\|SRR065067S0018624_P1 | 13551 | 719 | 90.8 | globlastp |
| 7408 | LYD360 sunflower\|10v1\|AJ318233 | 13552 | 719 | 90.8 | globlastp |
| 7409 | LYD360 flaveria\|11v1\|SRR149229.149173_P1 | 13553 | 719 | 90.6 | globlastp |
| 7410 | LYD360 silene\|11v1\|SRR096785X106119_P1 | 13554 | 719 | 90.6 | globlastp |
| 7411 | LYD360 poplar\|10v1\|CA925723_P1 | 13555 | 719 | 90.6 | globlastp |
| 7412 | LYD360 maize\|10v1\|AW076473_P1 | 13556 | 719 | 90.5 | globlastp |
| 7413 | LYD360 phalaenopsis\|11v1\|CB032210_P1 | 13557 | 719 | 90.5 | globlastp |
| 7414 | LYD360 sugarcane\|10v1\|BQ537481 | 13558 | 719 | 90.5 | globlastp |
| 7415 | LYD360 artemisia\|10v1\|EY040075_P1 | 13559 | 719 | 90.5 | globlastp |
| 7416 | LYD360 aristolochia\|10v1\|SRR039082S0002675_P1 | 13560 | 719 | 90.4 | globlastp |
| 7417 | LYD360 arnica\|11v1\|SRR099034X100340_P1 | 13561 | 719 | 90.4 | globlastp |
| 7418 | LYD360 orobanche\|10v1\|SRR023189S0005791_P1 | 13562 | 719 | 90.4 | globlastp |
| 7419 | LYD360 thellungiella_halophilum\|11v1\|EHJGI11028772_P1 | 13563 | 719 | 90.4 | globlastp |
| 7420 | LYD360 foxtail_millet\|10v2\|SICRP023839 | 13564 | 719 | 90.4 | globlastp |
| 7421 | LYD360 foxtail_millet\|11v3\|PHY7SI034302M_P1 | 13564 | 719 | 90.4 | globlastp |
| 7422 | LYD360 aristolochia\|10v1\|FD760594_P1 | 13565 | 719 | 90.3 | globlastp |
| 7423 | LYD360 artemisia\|10v1\|EY034334_P1 | 13566 | 719 | 90.3 | globlastp |
| 7424 | LYD360 cedrus\|11v1\|SRR065007X10249_T1 | 13567 | 719 | 90.3 | glotblastn |
| 7425 | LYD360 switchgrass\|gb167\|FE605820 | 13568 | 719 | 90.2 | globlastp |
| 7426 | LYD360 zostera\|10v1\|AM767583 | 13569 | 719 | 90.2 | globlastp |
| 7427 | LYD360 flaveria\|11v1\|SRR149229.108715_P1 | 13570 | 719 | 90.1 | globlastp |
| 7428 | LYD360 pine\|10v2\|AW056827_P1 | 13571 | 719 | 90.1 | globlastp |
| 7429 | LYD360 pseudotsuga\|10v1\|SRR065119S0031644_P1 | 13572 | 719 | 90.1 | globlastp |
| 7430 | LYD360 barley\|10v2\|AF045927_P1 | 13573 | 719 | 90.1 | globlastp |
| 7431 | LYD360 millet\|10v1\|CD726479_P1 | 13574 | 719 | 90.1 | globlastp |
| 7432 | LYD360 ambrosia\|11v1\|SRR346935.103146_P1 | 13575 | 719 | 90.0 | globlastp |
| 7433 | LYD360 abies\|11v2\|SRR098676X100740_P1 | 13576 | 719 | 89.9 | globlastp |
| 7434 | LYD360 ambrosia\|11v1\|SRR346935.106549_P1 | 13577 | 719 | 89.9 | globlastp |
| 7435 | LYD360 pseudotsuga\|10v1\|SRR065119S0005050_P1 | 13578 | 719 | 89.9 | globlastp |
| 7436 | LYD360 switchgrass\|gb167\|DN147365 | 13579 | 719 | 89.9 | globlastp |
| 7437 | LYD360 oat\|10v2\|GO587736 | 13580 | 719 | 89.9 | globlastp |
| 7438 | LYD360 oat\|11v1\|GO587736_P1 | 13580 | 719 | 89.9 | globlastp |
| 7439 | LYD360 maritime_pine\|10v1\|AL751324_T1 | 13581 | 719 | 89.9 | glotblastn |
| 7440 | LYD360 flaveria\|11v1\|SRR149232.324883_T1 | 13582 | 719 | 89.9 | glotblastn |
| 7441 | LYD360 maritime_pine\|10v1\|BX251155_T1 | 13583 | 719 | 89.8 | glotblastn |
| 7442 | LYD360 maritime_pine\|10v1\|FN692751_T1 | 13584 | 719 | 89.8 | glotblastn |
| 7443 | LYD360 arnica\|11v1\|SRR099034X100884_P1 | 13585 | 719 | 89.8 | globlastp |
| 7444 | LYD360 foxtail_millet\|11v3\|EC613957_P1 | 13586 | 719 | 89.8 | globlastp |
| 7445 | LYD360 lettuce\|10v1\|DW059851_P1 | 13587 | 719 | 89.8 | globlastp |
| 7446 | LYD360 spruce\|gb162\|CO216209_P1 | 13588 | 719 | 89.8 | globlastp |
| 7447 | LYD360 taxus\|10v1\|SRR032523S0007345_P1 | 13589 | 719 | 89.8 | globlastp |
| 7448 | LYD360 poplar\|10v1\|AJ534500_P1 | 13590 | 719 | 89.7 | globlastp |
| 7449 | LYD360 ambrosia\|11v1\|SRR346935.137736_T1 | 13591 | 719 | 89.6 | glotblastn |
| 7450 | LYD360 distylium\|11v1\|SRR065077X102956_T1 | 13592 | 719 | 89.6 | glotblastn |
| 7451 | LYD360 flaveria\|11v1\|SRR149229.152448_P1 | 13593 | 719 | 89.6 | globlastp |
| 7452 | LYD360 arnica\|11v1\|SRR099034X100341_P1 | 13594 | 719 | 89.5 | globlastp |
| 7453 | LYD360 podocarpus\|10v1\|SRR065014S0007339_P1 | 13595 | 719 | 89.5 | globlastp |
| 7454 | LYD360 artemisia\|10v1\|EY045486_P1 | 13596 | 719 | 89.5 | globlastp |
| 7455 | LYD360 strawberry\|11v1\|DY674092_P1 | 13597 | 719 | 89.4 | globlastp |
| 7456 | LYD360 grape\|11v1\|GSVIVT01007689001_P1 | 13598 | 719 | 89.3 | globlastp |
| 7457 | LYD360 fescue\|gb161\|DT675431_P1 | 13599 | 719 | 89.3 | globlastp |
| 7458 | LYD360 sequoia\|10v1\|SRR065044S0004830_P1 | 13600 | 719 | 89.2 | globlastp |
| 7459 | LYD360 cucumber\|09v1\|BI740224_P1 | 13601 | 719 | 89.1 | globlastp |
| 7460 | LYD360 barley\|10v2\|BF625506_P1 | 13602 | 719 | 89.1 | globlastp |
| 7461 | LYD360 podocarpus\|10v1\|SRR065014S0001924_T1 | 13603 | 719 | 89.1 | glotblastn |
| 7462 | LYD360 pine\|10v2\|BX254966_T1 | 13604 | 719 | 89.1 | glotblastn |
| 7463 | LYD360 clementine\|11v1\|CK665096_P1 | 13605 | 719 | 88.9 | globlastp |
| 7464 | LYD360 ambrosia\|11v1\|SRR346935.136006_P1 | 13606 | 719 | 88.8 | globlastp |
| 7465 | LYD360 orange\|11v1\|CK665096_P1 | 13607 | 719 | 88.8 | globlastp |
| 7466 | LYD360 watermelon\|11v1\|BI740224_P1 | 13608 | 719 | 88.8 | globlastp |
| 7467 | LYD360 brachypodium\|09v1\|DV470229_T1 | 13609 | 719 | 88.7 | glotblastn |
| 7468 | LYD360 spikemoss\|gb165\|DN838831_P1 | 13610 | 719 | 88.6 | globlastp |
| 7469 | LYD360 physcomitrella\|10v1\|AW699229_P1 | 13611 | 719 | 88.5 | globlastp |
| 7470 | LYD360 flaveria\|11v1\|SRR149232.282359_T1 | 13612 | 719 | 88.4 | glotblastn |
| 7471 | LYD360 momordica\|10v1\|SRR071315S0000541_P1 | 13613 | 719 | 88.4 | globlastp |
| 7472 | LYD360 cassava\|09v1\|JGICASSAVA17649VALIDM1_P1 | 13614 | 719 | 88.2 | globlastp |
| 7473 | LYD360 eucalyptus\|11v2\|SRR001659X33273_P1 | 13615 | 719 | 88.2 | globlastp |
| 7474 | LYD360 physcomitrella\|10v1\|BJ157374_P1 | 13616 | 719 | 88.2 | globlastp |
| 7475 | LYD360 ambrosia\|11v1\|SRR346935.110808_P1 | 13617 | 719 | 88.1 | globlastp |
| 7476 | LYD360 canola\|11v1\|CN828485_P1 | 13618 | 719 | 88.1 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 7477 | LYD360 flaveria\|11v1\|RR149229.189174_T1 | 13619 | 719 | 88.0 | glotblastn |
| 7478 | LYD360 nasturtium\|10v1\|SRR032558S0003567 | 13620 | 719 | 88.0 | glotblastn |
| 7479 | LYD360 castorbean\|11v1\|EG663179_P1 | 13621 | 719 | 88.0 | globlastp |
| 7480 | LYD360 ceratodon\|10v1\|SRR074890S0010086_P1 | 13622 | 719 | 88.0 | globlastp |
| 7481 | LYD360 tomato\|11v1\|CD002091_P1 | 13623 | 719 | 87.9 | globlastp |
| 7482 | LYD360 physcomitrella\|10v1\|BQ827459_P1 | 13624 | 719 | 87.8 | globlastp |
| 7483 | LYD360 lotus\|09v1\|BP063563_P1 | 13625 | 719 | 87.7 | globlastp |
| 7484 | LYD360 monkeyflower\|10v1\|SRR037227S0061683_P1 | 13626 | 719 | 87.6 | globlastp |
| 7485 | LYD360 physcomitrella\|10v1\|BQ826629_P1 | 13627 | 719 | 87.6 | globlastp |
| 7486 | LYD360 ceratodon\|10v1\|SRR074890S0009448_P1 | 13628 | 719 | 87.4 | globlastp |
| 7487 | LYD360 cirsium\|11v1\|SRR346952.14656_P1 | 13629 | 719 | 87.2 | globlastp |
| 7488 | LYD360 prunus\|10v1\|CN870307_P1 | 13630 | 719 | 87.2 | globlastp |
| 7489 | LYD360 soybean\|11v1\|GLYMA06G19000_P1 | 13631 | 719 | 87.2 | globlastp |
| 7490 | LYD360 triphysaria\|10v1\|DR175399_P1 | 13632 | 719 | 87.2 | globlastp |
| 7491 | LYD360 soybean\|11v1\|GLYMA04G35950_P1 | 13633 | 719 | 87.1 | globlastp |
| 7492 | LYD360 vinca\|11v1\|SRR098690X102460_T1 | 13634 | 719 | 87.0 | glotblastn |
| 7493 | LYD360 physcomitrella\|10v1\|BQ826803_P1 | 13635 | 719 | 86.6 | globlastp |
| 7494 | LYD360 ceratodon\|10v1\|SRR074890S0026641_T1 | 13636 | 719 | 86.6 | glotblastn |
| 7495 | LYD360 clementine\|11v1\|JGICC007340_P1 | 13637 | 719 | 86.5 | globlastp |
| 7496 | LYD360 physcomitrella\|10v1\|BJ964701_P1 | 13638 | 719 | 86.5 | globlastp |
| 7497 | LYD360 canola\|11v1\|SRR019557.18816_P1 | 13639 | 719 | 86.4 | globlastp |
| 7498 | LYD360 gnetum\|10v1\|SRR064399S0009592_P1 | 13640 | 719 | 86.4 | globlastp |
| 7499 | LYD360 amsonia\|11v1\|SRR098688X104047_P1 | 13641 | 719 | 86.0 | globlastp |
| 7500 | LYD360 orange\|11v1\|JGICC007340_P1 | 13642 | 719 | 86.0 | globlastp |
| 7501 | LYD360 strawberry\|11v1\|SRR074309S0170443_T1 | 13643 | 719 | 86.0 | glotblastn |
| 7502 | LYD360 spruce\|gb162\|CO221514_P1 | 13644 | 719 | 85.6 | globlastp |
| 7503 | LYD360 apple\|11v1\|MDP0000143678_P1 | 13645 | 719 | 85.4 | globlastp |
| 7504 | LYD360 sunflower\|10v1\|CD852052_P1 | 13646 | 719 | 85.3 | globlastp |
| 7505 | LYD360 sunflower\|10v1\|DY904230 | 13647 | 719 | 85.1 | glotblastn |
| 7506 | LYD360 tripterygium\|11v1\|SRR098677X111317_P1 | 13648 | 719 | 85.0 | globlastp |
| 7507 | LYD360 medicago\|09v1\|CRPMT037348_P1 | 13649 | 719 | 84.8 | globlastp |
| 7508 | LYD360 pteridium\|11v1\|SRR043594X103733_P1 | 13650 | 719 | 84.6 | globlastp |
| 7509 | LYD360 nasturtium\|10v1\|SRR032558S0003251 | 13651 | 719 | 84.4 | glotblastn |
| 7510 | LYD360 chlamydomonas\|gb162\|AI662862_P1 | 13652 | 719 | 84.1 | globlastp |
| 7511 | LYD360 solanum_phureja\|09v1\|SPHCD002091_P1 | 13653 | 719 | 83.8 | globlastp |
| 7512 | LYD360 aquilegia\|10v2\|JGIAC006528_P1 | 13654 | 719 | 83.7 | globlastp |
| 7513 | LYD360 aquilegia\|10v2\|JGIAC006575_P1 | 13655 | 719 | 83.7 | globlastp |
| 7514 | LYD360 ostreococcus\|gb162\|XM001415529_P1 | 13656 | 719 | 83.1 | globlastp |
| 7515 | LYD360 chestnut\|gb170\|SRR006295S0123561_T1 | 13657 | 719 | 82.8 | glotblastn |
| 7516 | LYD360 zostera\|10v1\|SRR057351S0009061 | 13658 | 719 | 82.7 | glotblastn |
| 7517 | LYD360 triphysaria\|10v1\|EY146602_T1 | 13659 | 719 | 82.2 | glotblastn |
| 7518 | LYD360 cenchrus\|gb166\|EB652529_P1 | 13660 | 719 | 81.9 | globlastp |
| 7519 | LYD360 switchgrass\|gb167\|FE628016_P1 | 13661 | 719 | 81.8 | globlastp |
| 7520 | LYD360 volvox\|gb162\|AV629785_P1 | 13662 | 719 | 81.6 | globlastp |
| 7521 | LYD360 brachypodium\|09v1\|BRADI1G75570_P1 | 13663 | 719 | 81.5 | globlastp |
| 7522 | LYD360 medicago\|09v1\|CRPMT038389_T1 | 13664 | 719 | 81.4 | glotblastn |
| 7523 | LYD360 soybean\|11v1\|GLYMA12G08410_T1 | 13665 | 719 | 81.0 | glotblastn |
| 7524 | LYD360 canola\|11v1\|EE435089_P1 | 13666 | 719 | 80.7 | globlastp |
| 7525 | LYD360 grape\|11v1\|GSVIVT01031517001_T1 | 13667 | 719 | 80.5 | glotblastn |
| 7526 | LYD360 maritime_pine\|10v1\|BX254966XX1_P1 | 13668 | 719 | 80.4 | globlastp |
| 7527 | LYD360 sorghum\|11v1\|CF482122_T1 | 13669 | 719 | 80.2 | glotblastn |
| 7528 | LYD360 foxtail_millet\|11v3\|PHY7SI039056M_T1 | 13670 | 719 | 80.1 | glotblastn |
| 7529 | LYD360 canola\|11v1\|SRR019559.31538_P1 | 13671 | 719 | 80.0 | globlastp |
| 7530 | LYD361 vinca\|11v1\|SRR098690X12356_P1 | 13672 | 720 | 85.3 | globlastp |
| 7531 | LYD361 sunflower\|10v1\|CD857682 | 13673 | 720 | 84.5 | globlastp |
| 7532 | LYD361 flaveria\|11v1\|SRR149229.158084_P1 | 13674 | 720 | 84.3 | globlastp |
| 7533 | LYD361 tragopogon\|10v1\|SRR020205S0037557 | 13675 | 720 | 84.3 | globlastp |
| 7534 | LYD361 flaveria\|11v1\|SRR149229.14461_P1 | 13676 | 720 | 84.1 | globlastp |
| 7535 | LYD361 flaveria\|11v1\|SRR149229.293038_P1 | 13677 | 720 | 84.0 | globlastp |
| 7536 | LYD361 cirsium\|11v1\|SRR346952.100082_T1 | 13678 | 720 | 83.8 | glotblastn |
| 7537 | LYD361 ambrosia\|11v1\|SRR346935.124045_P1 | 13679 | 720 | 83.6 | globlastp |
| 7538 | LYD361 monkeyflower\|10v1\|G0950169_P1 | 13680 | 720 | 83.3 | globlastp |
| 7539 | LYD361 lettuce\|10v1\|DW055094_P1 | 13681 | 720 | 82.9 | globlastp |
| 7540 | LYD361 momordica\|10v1\|SRR071315S0002004_T1 | 13682 | 720 | 82.7 | glotblastn |
| 7541 | LYD361 arnica\|11v1\|SRR099034X141701_P1 | 13683 | 720 | 82.4 | globlastp |
| 7542 | LYD361 grape\|11v1\|GSVIVT01034558001_P1 | 13684 | 720 | 82.4 | globlastp |
| 7543 | LYD361 valeriana\|11v1\|SRR099039X104343_T1 | 13685 | 720 | 82.4 | glotblastn |
| 7544 | LYD361 watermelon\|11v1\|AI563235_P1 | 13686 | 720 | 82.2 | globlastp |
| 7545 | LYD361 cucurbita\|11v1\|EU793994_P1 | 13687 | 720 | 82.0 | globlastp |
| 7546 | LYD361 artemisia\|10v1\|EY110625_T1 | 13688 | 720 | 81.8 | glotblastn |
| 7547 | LYD361 orobanche\|10v1\|SRR023189S0003707_T1 | 13689 | 720 | 81.5 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 7548 | LYD361 kiwi\|gb166\|FG403353_P1 | 13690 | 720 | 81.3 | globlastp |
| 7549 | LYD361 melon\|10v1\|VMEL01263807281546_P1 | 13691 | 720 | 81.1 | globlastp |
| 7550 | LYD361 cucumber\|09v1\|AI563235_P1 | 13692 | 720 | 80.4 | globlastp |
| 7551 | LYD364 canola\|11v1\|EE556689_P1 | 13693 | 721 | 98.2 | globlastp |
| 7552 | LYD364 radish\|gb164\|EX763390 | 13694 | 721 | 97.2 | globlastp |
| 7553 | LYD364 canola\|10v1\|ES269732 | 13695 | 721 | 97.0 | globlastp |
| 7554 | LYD364 canola\|11v1\|EE414992_P1 | 13695 | 721 | 97.0 | globlastp |
| 7555 | LYD364 radish\|gb164\|EX763193 | 13696 | 721 | 95.4 | globlastp |
| 7556 | LYD364 thellungiella_halophilum\|11v1\|BY801459_P1 | 13697 | 721 | 95.2 | globlastp |
| 7557 | LYD364 cleome_gynandra\|10v1\|SRR015532S0009091_P1 | 13698 | 721 | 85.8 | globlastp |
| 7558 | LYD364 clementine\|11v1\|BQ623000_P1 | 13699 | 721 | 85.0 | globlastp |
| 7559 | LYD364 orange\|11v1\|BQ623000_P1 | 13699 | 721 | 85.0 | globlastp |
| 7560 | LYD364 citrus\|gb166\|BQ623000_P1 | 13699 | 721 | 85.0 | globlastp |
| 7561 | LYD364 tripterygium\|11v1\|SRR098677X163501_P1 | 13700 | 721 | 84.5 | globlastp |
| 7562 | LYD364 apple\|11v1\|CN937262_P1 | 13701 | 721 | 84.0 | globlastp |
| 7563 | LYD364 euonymus\|11v1\|SRR070038X111904_P1 | 13702 | 721 | 83.8 | globlastp |
| 7564 | LYD364 cotton\|10v2\|DT466855_P1 | 13703 | 721 | 83.3 | globlastp |
| 7565 | LYD364 apple\|11v1\|CN879479_P1 | 13704 | 721 | 83.2 | globlastp |
| 7566 | LYD364 strawberry\|11v1\|DY670319 | 13705 | 721 | 83.2 | globlastp |
| 7567 | LYD364 cacao\|10v1\|CU496643_P1 | 13706 | 721 | 83.0 | globlastp |
| 7568 | LYD364 amsonia\|11v1\|SRR098688X101177_P1 | 13707 | 721 | 82.7 | globlastp |
| 7569 | LYD364 catharanthus\|11v1\|EG556426XX1_P1 | 13708 | 721 | 81.8 | globlastp |
| 7570 | LYD364 oak\|10v1\|SRR006313S0059641_P1 | 13709 | 721 | 81.8 | globlastp |
| 7571 | LYD364 cotton\|10v2\|SRR032367S0041565_P1 | 13710 | 721 | 81.8 | globlastp |
| 7572 | LYD364 tabernaemontana\|11v1\|SRR098689X104538_P1 | 13711 | 721 | 81.4 | globlastp |
| 7573 | LYD364 aquilegia\|10v2\|DR925081_P1 | 13712 | 721 | 81.0 | globlastp |
| 7574 | LYD364 melon\|10v1\|AM718233_P1 | 13713 | 721 | 80.3 | globlastp |
| 7575 | LYD364 vinca\|11v1\|SRR098690X116717_P1 | 13714 | 721 | 80.2 | globlastp |
| 7576 | LYD364 watermelon\|11v1\|AM718233_P1 | 13715 | 721 | 80.1 | globlastp |
| 7577 | LYD364 cucumber\|09v1\|AM718233_P1 | 13716 | 721 | 80.1 | globlastp |
| 7578 | LYD365 canola\|10v1\|ES984275 | 13717 | 722 | 97.1 | globlastp |
| 7579 | LYD365 radish\|gb164\|EV569337 | 13718 | 722 | 95.1 | globlastp |
| 7580 | LYD365 thellungiella_parvulum\|11v1\|DN776741_P1 | 13719 | 722 | 93.8 | globlastp |
| 7581 | LYD365 arabidopsis_lyrata\|09v1\|JGIAL024190_P1 | 13720 | 722 | 93.3 | globlastp |
| 7582 | LYD365 thellungiella_halophilum\|11v1\|DN776741_P1 | 13721 | 722 | 93.0 | globlastp |
| 7583 | LYD365 arabidopsis\|10v1\|AT4G37680_P1 | 13722 | 722 | 92.5 | globlastp |
| 7584 | LYD365 b_oleracea\|gb161\|AM386437_T1 | 13723 | 722 | 90.1 | glotblastn |
| 7585 | LYD366 canola\|11v1\|EE392367_P1 | 13724 | 723 | 97.8 | globlastp |
| 7586 | LYD366 thellungiella_halophilum\|11v1\|DN777760_P1 | 13725 | 723 | 91.0 | globlastp |
| 7587 | LYD366 thellungiella_parvulum\|11v1\|DN777760_P1 | 13726 | 723 | 90.1 | globlastp |
| 7588 | LYD366 arabidopsis_lyrata\|09v1\|JGIAL002262_P1 | 13727 | 723 | 90.1 | globlastp |
| 7589 | LYD366 arabidopsis\|10v1\|AT1G21410_P1 | 13728 | 723 | 89.3 | globlastp |
| 7590 | LYD366 b_rapa\|gb162\|EX040164_P1 | 13729 | 723 | 89.2 | globlastp |
| 7591 | LYD366 canola\|11v1\|EE460387_P1 | 13730 | 723 | 83.0 | globlastp |
| 7592 | LYD366 thellungiella_parvulum\|11v1\|DN776452_P1 | 13731 | 723 | 82.3 | globlastp |
| 7593 | LYD366 canola\|10v1\|EE463529 | 13732 | 723 | 81.9 | globlastp |
| 7594 | LYD366 canola\|11v1\|CN726230_P1 | 13733 | 723 | 81.6 | globlastp |
| 7595 | LYD366 arabidopsis\|10v1\|AT1G77000_P1 | 13734 | 723 | 81.4 | globlastp |
| 7596 | LYD366 arabidopsis_lyrata\|09v1\|JGIAL007975_P1 | 13735 | 723 | 81.3 | globlastp |
| 7597 | LYD366 thellungiella_halophilum\|11v1\|DN776452_P1 | 13736 | 723 | 81.2 | globlastp |
| 7598 | LYD367 b_rapa\|gb162\|AT000496_P1 | 13737 | 724 | 98.9 | globlastp |
| 7599 | LYD367 canola\|11v1\|DY024476XX2_P1 | 13738 | 724 | 98.5 | globlastp |
| 7600 | LYD367 canola\|10v1\|DY024476 | 13738 | 724 | 98.5 | globlastp |
| 7601 | LYD367 canola\|11v1\|ES901940_P1 | 13739 | 724 | 97.7 | globlastp |
| 7602 | LYD367 thellungiella_halophilum\|11v1\|BY814944_P1 | 13740 | 724 | 97.5 | globlastp |
| 7603 | LYD367 arabidopsis_lyrata\|09v1\|JGIAL018667_P1 | 13741 | 724 | 97.2 | globlastp |
| 7604 | LYD367 thellungiella_parvulum\|11v1\|BY814944_P1 | 13742 | 724 | 97.0 | globlastp |
| 7605 | LYD367 canola\|10v1\|CX193818 | 13743 | 724 | 97.0 | globlastp |
| 7606 | LYD367 canola\|11v1\|EV084177_P1 | 13744 | 724 | 96.8 | globlastp |
| 7607 | LYD367 radish\|gb164\|EV545357 | 13745 | 724 | 96.8 | globlastp |
| 7608 | LYD367 arabidopsis\|10v1\|AT3G54190_P1 | 13746 | 724 | 96.4 | globlastp |
| 7609 | LYD367 radish\|gb164\|EV527102 | 13747 | 724 | 95.8 | globlastp |
| 7610 | LYD367 arabidopsis_lyrata\|09v1\|JGIAL015103_P1 | 13748 | 724 | 90.0 | globlastp |
| 7611 | LYD367 arabidopsis\|10v1\|AT2G38630_P1 | 13749 | 724 | 90.0 | globlastp |
| 7612 | LYD367 thellungiella_halophilum\|11v1\|BY816181_P1 | 13750 | 724 | 89.8 | globlastp |
| 7613 | LYD367 watermelon\|11v1\|AM714178_P1 | 13751 | 724 | 88.7 | globlastp |
| 7614 | LYD367 cassava\|09v1\|CK644908_P1 | 13752 | 724 | 88.7 | globlastp |
| 7615 | LYD367 canola\|11v1\|ES978545_P1 | 13753 | 724 | 88.5 | globlastp |
| 7616 | LYD367 cucumber\|09v1\|AM714178_P1 | 13754 | 724 | 88.4 | globlastp |
| 7617 | LYD367 thellungiella_parvulum\|11v1\|BY816181_P1 | 13755 | 724 | 87.6 | globlastp |
| 7618 | LYD367 orange\|11v1\|CF506466_P1 | 13756 | 724 | 86.8 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 7619 | LYD367 clementine\|11v1\|CF506466_P1 | 13757 | 724 | 86.6 | globlastp |
| 7620 | LYD367 citrus\|gb166\|CF506466_P1 | 13757 | 724 | 86.6 | globlastp |
| 7621 | LYD367 prunus\|10v1\|BU040716 | 13758 | 724 | 85.9 | globlastp |
| 7622 | LYD367 oak\|10v1\|FP064948_P1 | 13759 | 724 | 85.7 | globlastp |
| 7623 | LYD367 cleome_gynandra\|10v1\|SRR015532S0020267_P1 | 13760 | 724 | 85.4 | globlastp |
| 7624 | LYD367 grape\|11v1\|GSVIVT01029846001_P1 | 13761 | 724 | 85.4 | globlastp |
| 7625 | LYD367 poplar\|10v1\|BI119637_P1 | 13762 | 724 | 85.3 | globlastp |
| 7626 | LYD367 euonymus\|11v1\|SRR070038X213196_P1 | 13763 | 724 | 85.1 | globlastp |
| 7627 | LYD367 eucalyptus\|11v2\|SRR001659X123173_P1 | 13764 | 724 | 84.9 | globlastp |
| 7628 | LYD367 coffea\|10v1\|DV672335_P1 | 13765 | 724 | 84.7 | globlastp |
| 7629 | LYD367 apple\|gb171\|CN492832 | 13766 | 724 | 84.4 | globlastp |
| 7630 | LYD367 amsonia\|11v1\|SRR098688X101299_P1 | 13767 | 724 | 84.0 | globlastp |
| 7631 | LYD367 tripterygium\|11v1\|SRR098677X117322_P1 | 13768 | 724 | 84.0 | globlastp |
| 7632 | LYD367 cassava\|09v1\|JGICASSAVA25211VALIDM1_P1 | 13769 | 724 | 83.9 | globlastp |
| 7633 | LYD367 poplar\|10v1\|BU811585_P1 | 13770 | 724 | 83.9 | globlastp |
| 7634 | LYD367 cacao\|10v1\|CU522092_P1 | 13771 | 724 | 83.8 | globlastp |
| 7635 | LYD367 tomato\|09v1\|AI482944 | 13772 | 724 | 83.5 | globlastp |
| 7636 | LYD367 tabernaemontana\|11v1\|SRR098689X102892_P1 | 13773 | 724 | 83.4 | globlastp |
| 7637 | LYD367 cotton\|10v2\|DT572129_P1 | 13774 | 724 | 83.4 | globlastp |
| 7638 | LYD367 eucalyptus\|11v2\|SRR001659X149861_P1 | 13775 | 724 | 83.2 | globlastp |
| 7639 | LYD367 cannabis\|12v1\|SOLX00033218_P1 | 13776 | 724 | 82.8 | globlastp |
| 7640 | LYD367 potato\|10v1\|BI406174_P1 | 13777 | 724 | 82.8 | globlastp |
| 7641 | LYD367 cotton\|10v2\|CO132735_P1 | 13778 | 724 | 82.8 | globlastp |
| 7642 | LYD367 medicago\|09v1\|AA660848_P1 | 13779 | 724 | 82.6 | globlastp |
| 7643 | LYD367 cacao\|10v1\|CU482126_P1 | 13780 | 724 | 82.6 | globlastp |
| 7644 | LYD367 solanum_phureja\|09v1\|SPHAI895877 | 13781 | 724 | 82.5 | globlastp |
| 7645 | LYD367 catharanthus\|11v1\|EG560390XX1_P1 | 13782 | 724 | 82.4 | globlastp |
| 7646 | LYD367 euonymus\|11v1\|SRR070038X241970_P1 | 13783 | 724 | 82.4 | globlastp |
| 7647 | LYD367 poplar\|10v1\|BI122314_P1 | 13784 | 724 | 82.4 | globlastp |
| 7648 | LYD367 soybean\|11v1\|GLYMA06G14500 | 13785 | 724 | 82.4 | globlastp |
| 7649 | LYD367 tomato\|09v1\|AI895877 | 13786 | 724 | 82.1 | globlastp |
| 7650 | LYD367 lotus\|09v1\|LLAW720147_P1 | 13787 | 724 | 81.9 | globlastp |
| 7651 | LYD367 amorphophallus\|11v2\|SRR089351X596563_P1 | 13788 | 724 | 81.7 | globlastp |
| 7652 | LYD367 silene\|11v1\|DV768241_P1 | 13789 | 724 | 81.7 | globlastp |
| 7653 | LYD367 monkeyflower\|10v1\|GO946808_P1 | 13790 | 724 | 81.6 | globlastp |
| 7654 | LYD367 fagopyrum\|11v1\|SRR063703X101691_P1 | 13791 | 724 | 81.4 | globlastp |
| 7655 | LYD367 poplar\|10v1\|DT479747_P1 | 13792 | 724 | 81.1 | globlastp |
| 7656 | LYD367 cephalotaxus\|11v1\|SRR064395X13793_P1 | 13793 | 724 | 80.7 | globlastp |
| 7657 | LYD367 sciadopitys\|10v1\|SRR065035S0002208 | 13794 | 724 | 80.5 | globlastp |
| 7658 | LYD367 lettuce\|10v1\|DW046871_P1 | 13795 | 724 | 80.1 | globlastp |
| 7659 | LYD367 monkeyflower\|10v1\|DV206397_P1 | 13796 | 724 | 80.1 | globlastp |
| 7660 | LYD367 pine\|10v2\|CD019457_P1 | 13797 | 724 | 80.0 | globlastp |
| 7661 | LYD377 canola\|11v1\|CN826341_P1 | 13798 | 727 | 98.9 | globlastp |
| 7662 | LYD378 canola\|11v1\|ES905670_P1 | 13799 | 728 | 99.0 | globlastp |
| 7663 | LYD378 canola\|10v1\|CD839519 | 13800 | 728 | 99.0 | globlastp |
| 7664 | LYD378 canola\|11v1\|EE437968XX2_P1 | 13801 | 728 | 98.8 | globlastp |
| 7665 | LYD378 canola\|10v1\|CD836192 | 13802 | 728 | 98.8 | globlastp |
| 7666 | LYD378 b_rapa\|gb162\|CV545263_P1 | 13803 | 728 | 98.8 | globlastp |
| 7667 | LYD378 canola\|11v1\|DQ067236_P1 | 13804 | 728 | 98.4 | globlastp |
| 7668 | LYD378 canola\|11v1\|EE503532_P1 | 13804 | 728 | 98.4 | globlastp |
| 7669 | LYD378 canola\|11v1\|SRR019558.25865_P1 | 13805 | 728 | 98.4 | globlastp |
| 7670 | LYD378 b_rapa\|gb162\|L33540_P1 | 13804 | 728 | 98.4 | globlastp |
| 7671 | LYD378 canola\|11v1\|EE437297_P1 | 13804 | 728 | 98.4 | globlastp |
| 7672 | LYD378 b_rapa\|gb162\|DN965312_T1 | 13806 | 728 | 98.1 | glotblastn |
| 7673 | LYD378 thellungiella_halophilum\|11v1\|BY803395_P1 | 13807 | 728 | 98.1 | globlastp |
| 7674 | LYD378 radish\|gb164\|EV535158 | 13808 | 728 | 98.1 | globlastp |
| 7675 | LYD378 arabidopsis\|10v1\|AT3G23810_P1 | 13809 | 728 | 97.7 | globlastp |
| 7676 | LYD378 canola\|11v1\|DY030606_P1 | 13810 | 728 | 97.3 | globlastp |
| 7677 | LYD378 b_rapa\|gb162\|BQ791463_P1 | 13810 | 728 | 97.3 | globlastp |
| 7678 | LYD378 canola\|10v1\|BQ704163 | 13810 | 728 | 97.3 | globlastp |
| 7679 | LYD378 radish\|gb164\|EV552177 | 13811 | 728 | 97.3 | globlastp |
| 7680 | LYD378 thellungiella_parvulum\|11v1\|BY810328_P1 | 13812 | 728 | 97.1 | globlastp |
| 7681 | LYD378 canola\|11v1\|EE456663_P1 | 13813 | 728 | 97.1 | globlastp |
| 7682 | LYD378 canola\|10v1\|CD825391 | 13813 | 728 | 97.1 | globlastp |
| 7683 | LYD378 canola\|11v1\|ES903016_P1 | 13813 | 728 | 97.1 | globlastp |
| 7684 | LYD378 b_oleracea\|gb161\|AM387065_P1 | 13814 | 728 | 97.1 | globlastp |
| 7685 | LYD378 thellungiella_parvulum\|11v1\|BM985729_P1 | 13815 | 728 | 96.9 | globlastp |
| 7686 | LYD378 arabidopsis_lyrata\|09v1\|JGIAL011053_P1 | 13816 | 728 | 96.9 | globlastp |
| 7687 | LYD378 b_oleracea\|gb161\|DY027191_P1 | 13817 | 728 | 96.9 | globlastp |
| 7688 | LYD378 b_rapa\|gb162\|BQ791290_P1 | 13818 | 728 | 96.9 | globlastp |
| 7689 | LYD378 canola\|11v1\|DW997127_P1 | 13819 | 728 | 96.7 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name  cluster name | Polyp. SEQ ID NO: | Hom to SEQ ID NO: | % glob. iden. | Algor. |
|---|---|---|---|---|---|
| 7690 | LYD378 canola\|10v1\|CD814491 | 13819 | 728 | 96.7 | globlastp |
| 7691 | LYD378 arabidopsis_lyrata\|09v1\|JGIAL026959_P1 | 13820 | 728 | 96.7 | globlastp |
| 7692 | LYD378 thellungiella_halophilum\|11v1\|BM985729_P1 | 13821 | 728 | 96.5 | globlastp |
| 7693 | LYD378 canola\|11v1\|ES951238_P1 | 13822 | 728 | 96.3 | globlastp |
| 7694 | LYD378 arabidopsis\|10v1\|AT4G13940_P1 | 13823 | 728 | 96.3 | globlastp |
| 7695 | LYD378 thellungiella_halophilum\|11v1\|BM986128_T1 | 13824 | 728 | 95.7 | glotblastn |
| 7696 | LYD378 cleome_gynandra\|10v1\|SRR015532S0000472_P1 | 13825 | 728 | 93.8 | globlastp |
| 7697 | LYD378 cleome_spinosa\|10v1\|GR934744_P1 | 13826 | 728 | 93.6 | globlastp |
| 7698 | LYD378 euonymus\|11v1\|SRR070038X102705_P1 | 13827 | 728 | 93.0 | globlastp |
| 7699 | LYD378 poplar\|10v1\|AI162897_P1 | 13828 | 728 | 93.0 | globlastp |
| 7700 | LYD378 cleome_spinosa\|10v1\|SRR015531S0008307_P1 | 13829 | 728 | 92.8 | globlastp |
| 7701 | LYD378 ambrosia\|11v1\|SRR346935.115152_P1 | 13830 | 728 | 92.6 | globlastp |
| 7702 | LYD378 tripterygium\|11v1\|SRR098677X101295_P1 | 13831 | 728 | 92.6 | globlastp |
| 7703 | LYD378 tripterygium\|11v1\|SRR098677X111590_P1 | 13832 | 728 | 92.6 | globlastp |
| 7704 | LYD378 castorbean\|09v1\|CF981141 | 13833 | 728 | 92.6 | globlastp |
| 7705 | LYD378 castorbean\|11v1\|CF981141_P1 | 13833 | 728 | 92.6 | globlastp |
| 7706 | LYD378 oak\|10v1\|CU640715_P1 | 13834 | 728 | 92.6 | globlastp |
| 7707 | LYD378 oak\|10v1\|DB998563_P1 | 13835 | 728 | 92.6 | globlastp |
| 7708 | LYD378 oak\|10v1\|FP026841_P1 | 13835 | 728 | 92.6 | globlastp |
| 7709 | LYD378 oak\|10v1\|FP061118_P1 | 13835 | 728 | 92.6 | globlastp |
| 7710 | LYD378 poplar\|10v1\|AI161753_P1 | 13836 | 728 | 92.6 | globlastp |
| 7711 | LYD378 cassava\|09v1\|CK641934_P1 | 13837 | 728 | 92.6 | globlastp |
| 7712 | LYD378 ambrosia\|11v1\|RR346935.137485_P1 | 13838 | 728 | 92.4 | globlastp |
| 7713 | LYD378 amsonia\|11v1\|SRR098688X101618_P1 | 13839 | 728 | 92.4 | globlastp |
| 7714 | LYD378 catharanthus\|11v1\|Z26881_P1 | 13840 | 728 | 92.4 | globlastp |
| 7715 | LYD378 cirsium\|11v1\|SRR346952.116117_P1 | 13841 | 728 | 92.4 | globlastp |
| 7716 | LYD378 platanus\|11v1\|SRR096786X100539_P1 | 13842 | 728 | 92.4 | globlastp |
| 7717 | LYD378 monkeyflower\|10v1\|GO944626_P1 | 13843 | 728 | 92.4 | globlastp |
| 7718 | LYD378 pepper\|gb171\|AF108882_P1 | 13844 | 728 | 92.4 | globlastp |
| 7719 | LYD378 catharanthus\|gb166\|Z26881 | 13840 | 728 | 92.4 | globlastp |
| 7720 | LYD378 chestnut\|gb170\|FK868468_P1 | 13845 | 728 | 92.4 | globlastp |
| 7721 | LYD378 cannabis\|12v1\|GR221625_P1 | 13846 | 728 | 92.2 | globlastp |
| 7722 | LYD378 flaveria\|11v1\|SRR149239.26119_P1 | 13847 | 728 | 92.2 | globlastp |
| 7723 | LYD378 tripterygium\|11v1\|SRR098677X102463_P1 | 13848 | 728 | 92.2 | globlastp |
| 7724 | LYD378 watermelon\|11v1\|AF206620_P1 | 13849 | 728 | 92.2 | globlastp |
| 7725 | LYD378 grape\|11v1\|GSVIVT01021041001_P1 | 13850 | 728 | 92.2 | globlastp |
| 7726 | LYD378 grape\|gb160\|BQ797519 | 13850 | 728 | 92.2 | globlastp |
| 7727 | LYD378 pepper\|gb171\|BM062377_P1 | 13851 | 728 | 92.2 | globlastp |
| 7728 | LYD378 ginseng\|10v1\|CN845685_P1 | 13852 | 728 | 92.2 | globlastp |
| 7729 | LYD378 oak\|10v1\|DB996218_P1 | 13853 | 728 | 92.2 | globlastp |
| 7730 | LYD378 monkeyflower\|10v1\|DV208189_P1 | 13854 | 728 | 92.2 | globlastp |
| 7731 | LYD378 castorbean\|11v1\|EE260052_T1 | 13855 | 728 | 92.2 | glotblastn |
| 7732 | LYD378 ambrosia\|11v1\|SRR346935.101332_P1 | 13856 | 728 | 92.0 | globlastp |
| 7733 | LYD378 ambrosia\|11v1\|SRR346935.111807_P1 | 13857 | 728 | 92.0 | globlastp |
| 7734 | LYD378 arnica\|11v1\|SRR099034X100195_P1 | 13858 | 728 | 92.0 | globlastp |
| 7735 | LYD378 platanus\|11v1\|SRR096786X10200_P1 | 13859 | 728 | 92.0 | globlastp |
| 7736 | LYD378 barley\|10v2\|BE413441_P1 | 13860 | 728 | 92.0 | globlastp |
| 7737 | LYD378 barley\|10v2\|BE438652_P1 | 13860 | 728 | 92.0 | globlastp |
| 7738 | LYD378 basilicum\|10v1\|DY321720_P1 | 13861 | 728 | 92.0 | globlastp |
| 7739 | LYD378 wheat\|10v2\|WHTSHH | 13862 | 728 | 92.0 | globlastp |
| 7740 | LYD378 flax\|11v1\|CA482818_P1 | 13863 | 728 | 92.0 | globlastp |
| 7741 | LYD378 foxtail_millet\|11v3\|EC613141_P1 | 13864 | 728 | 92.0 | globlastp |
| 7742 | LYD378 switchgrass\|gb167\|DN141744 | 13865 | 728 | 92.0 | globlastp |
| 7743 | LYD378 apple\|gb171\|CN444564 | 13866 | 728 | 92.0 | globlastp |
| 7744 | LYD378 cassava\|09v1\|CK641612_P1 | 13867 | 728 | 92.0 | globlastp |
| 7745 | LYD378 kiwi\|gb166\|FG418602_P1 | 13868 | 728 | 92.0 | globlastp |
| 7746 | LYD378 soybean\|11v1\|GLYMA11G36620 | 13869 | 728 | 92.0 | globlastp |
| 7747 | LYD378 melon\|10v1\|AF206620_P1 | 13870 | 728 | 92.0 | globlastp |
| 7748 | LYD378 sunflower\|10v1\|DY926132 | 13871 | 728 | 92.0 | globlastp |
| 7749 | LYD378 apple\|11v1\|CN444564_P1 | 13866 | 728 | 92.0 | globlastp |
| 7750 | LYD378 euonymus\|11v1\|SRR070038X101385_P1 | 13872 | 728 | 91.8 | globlastp |
| 7751 | LYD378 euonymus\|11v1\|SRR070038X102446_P1 | 13873 | 728 | 91.8 | globlastp |
| 7752 | LYD378 tomato\|11v1\|AF161705_P1 | 13874 | 728 | 91.8 | globlastp |
| 7753 | LYD378 flax\|09v1\|CA483010 | 13875 | 728 | 91.8 | globlastp |
| 7754 | LYD378 potato\|10v1\|BE919741_P1 | 13876 | 728 | 91.8 | globlastp |
| 7755 | LYD378 solanum_phureja\|09v1\|SPHBG130646 | 13877 | 728 | 91.8 | globlastp |
| 7756 | LYD378 tobacco\|gb162\|EB428053 | 13878 | 728 | 91.8 | globlastp |
| 7757 | LYD378 tomato\|09v1\|AF161705 | 13874 | 728 | 91.8 | globlastp |
| 7758 | LYD378 cenchrus\|gb166\|EB658452_P1 | 13879 | 728 | 91.8 | globlastp |
| 7759 | LYD378 sorghum\|09v1\|SB05G014470 | 13880 | 728 | 91.8 | globlastp |
| 7760 | LYD378 sorghum\|11v1\|SB05G014470_P1 | 13880 | 728 | 91.8 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 7761 | LYD378 wheat\|10v2\|CA618533 | 13881 | 728 | 91.8 | globlastp |
| 7762 | LYD378 cotton\|10v2\|BF269328_P1 | 13882 | 728 | 91.8 | globlastp |
| 7763 | LYD378 kiwi\|gb166\|FG396030_P1 | 13883 | 728 | 91.8 | globlastp |
| 7764 | LYD378 oak\|10v1\|FN700901_P1 | 13884 | 728 | 91.8 | globlastp |
| 7765 | LYD378 rice\|gb170\|OS11G26850T2 | 13885 | 728 | 91.8 | globlastp |
| 7766 | LYD378 tobacco\|gb162\|CV019257 | 13886 | 728 | 91.8 | glotblastn |
| 7767 | LYD378 cannabis\|12v1\|EC855271_T1 | 13887 | 728 | 91.6 | glotblastn |
| 7768 | LYD378 flaveria\|11v1\|SRR149244.163767_T1 | 13888 | 728 | 91.6 | glotblastn |
| 7769 | LYD378 arnica\|11v1\|SRR099034X100153_P1 | 13889 | 728 | 91.5 | globlastp |
| 7770 | LYD378 cucurbita\|11v1\|FG227000_P1 | 13890 | 728 | 91.5 | globlastp |
| 7771 | LYD378 eucalyptus\|11v2\|CT982516_P1 | 13891 | 728 | 91.5 | globlastp |
| 7772 | LYD378 olea\|11v1\|SRR014463.57499_P1 | 13892 | 728 | 91.5 | globlastp |
| 7773 | LYD378 tomato\|11v1\|BG133606_P1 | 13893 | 728 | 91.5 | globlastp |
| 7774 | LYD378 tripterygium\|11v1\|SRR098677X108849_P1 | 13894 | 728 | 91.5 | globlastp |
| 7775 | LYD378 monkeyflower\|10v1\|DV208961_P1 | 13895 | 728 | 91.5 | globlastp |
| 7776 | LYD378 potato\|10v1\|BF459946_P1 | 13896 | 728 | 91.5 | globlastp |
| 7777 | LYD378 coffea\|10v1\|DV664635_P1 | 13897 | 728 | 91.5 | globlastp |
| 7778 | LYD378 foxtail_millet\|11v3\|PHY7SI013650M_P1 | 13898 | 728 | 91.5 | globlastp |
| 7779 | LYD378 solanum_phureja\|09v1\|SPHBG133606 | 13899 | 728 | 91.5 | globlastp |
| 7780 | LYD378 tomato\|09v1\|BG133606 | 13893 | 728 | 91.5 | globlastp |
| 7781 | LYD378 artemisia\|10v1\|EY036475_P1 | 13900 | 728 | 91.5 | globlastp |
| 7782 | LYD378 sunflower\|10v1\|CD851095 | 13901 | 728 | 91.5 | globlastp |
| 7783 | LYD378 cucumber\|09v1\|AF206620_P1 | 13902 | 728 | 91.5 | globlastp |
| 7784 | LYD378 flaveria\|11v1\|SRR149229.169205_P1 | 13903 | 728 | 91.3 | globlastp |
| 7785 | LYD378 flaveria\|11v1\|SRR149229.89890_P1 | 13903 | 728 | 91.3 | globlastp |
| 7786 | LYD378 flaveria\|11v1\|SRR149232.161521_P1 | 13904 | 728 | 91.3 | globlastp |
| 7787 | LYD378 lotus\|09v1\|BP041862_P1 | 13905 | 728 | 91.3 | globlastp |
| 7788 | LYD378 wheat\|10v2\|BF293272 | 13906 | 728 | 91.3 | globlastp |
| 7789 | LYD378 wheat\|10v2\|BQ241367 | 13906 | 728 | 91.3 | globlastp |
| 7790 | LYD378 maize\|10v1\|W21772_P1 | 13907 | 728 | 91.3 | globlastp |
| 7791 | LYD378 solanum_phureja\|09v1\|SPHAF161705 | 13908 | 728 | 91.3 | globlastp |
| 7792 | LYD378 basilicum\|10v1\|DY325764_P1 | 13909 | 728 | 91.3 | globlastp |
| 7793 | LYD378 cotton\|10v2\|AF129871_P1 | 13910 | 728 | 91.3 | globlastp |
| 7794 | LYD378 eucalyptus\|11v2\|CB967558_P1 | 13911 | 728 | 91.3 | globlastp |
| 7795 | LYD378 sunflower\|10v1\|DY906149 | 13912 | 728 | 91.3 | globlastp |
| 7796 | LYD378 prunus\|10v1\|BF717170 | 13913 | 728 | 91.3 | globlastp |
| 7797 | LYD378 soybean\|11v1\|GLYMA08G11480 | 13914 | 728 | 91.3 | globlastp |
| 7798 | LYD378 ipomoea_nil\|10v1\|BJ553240_P1 | 13915 | 728 | 91.3 | globlastp |
| 7799 | LYD378 sunflower\|10v1\|DY937742 | 13916 | 728 | 91.3 | globlastp |
| 7800 | LYD378 valeriana\|11v1\|SRR099039X105789_P1 | 13917 | 728 | 91.2 | globlastp |
| 7801 | LYD378 apple\|11v1\|CN885050_T1 | 13918 | 728 | 91.2 | glotblastn |
| 7802 | LYD378 dandelion\|10v1\|DR400827_T1 | 13919 | 728 | 91.1 | glotblastn |
| 7803 | LYD378 arnica\|11v1\|SRR099034X101374_P1 | 13920 | 728 | 91.1 | globlastp |
| 7804 | LYD378 chelidonium\|11v1\|SRR084752X101481_P1 | 13921 | 728 | 91.1 | globlastp |
| 7805 | LYD378 flaveria\|11v1\|SRR149240.114769_P1 | 13922 | 728 | 91.1 | globlastp |
| 7806 | LYD378 silene\|11v1\|SRR096785X100447_P1 | 13923 | 728 | 91.1 | globlastp |
| 7807 | LYD378 vinca\|11v1\|SRR098690X100552_P1 | 13924 | 728 | 91.1 | globlastp |
| 7808 | LYD378 vinca\|11v1\|SRR098690X101241_P1 | 13925 | 728 | 91.1 | globlastp |
| 7809 | LYD378 leymus\|gb166\|EG385162 | 13926 | 728 | 91.1 | globlastp |
| 7810 | LYD378 medicago\|09v1\|ALFMSA2S_P1 | 13927 | 728 | 91.1 | globlastp |
| 7811 | LYD378 switchgrass\|gb167\|DN142533 | 13928 | 728 | 91.1 | globlastp |
| 7812 | LYD378 cacao\|10v1\|CU469921_P1 | 13929 | 728 | 91.1 | globlastp |
| 7813 | LYD378 triphysaria\|10v1\|BM357049 | 13930 | 728 | 91.1 | globlastp |
| 7814 | LYD378 lettuce\|10v1\|DW085186_P1 | 13931 | 728 | 91.1 | globlastp |
| 7815 | LYD378 euphorbia\|11v1\|DV114593_T1 | 13932 | 728 | 90.9 | glotblastn |
| 7816 | LYD378 basilicum\|10v1\|DY321889_T1 | 13933 | 728 | 90.9 | glotblastn |
| 7817 | LYD378 cichorium\|gb171\|DT213556_T1 | 13934 | 728 | 90.9 | glotblastn |
| 7818 | LYD378 cichorium\|gb171\|EH673038_T1 | 13935 | 728 | 90.9 | glotblastn |
| 7819 | LYD378 arnica\|11v1\|SRR099034X112089_P1 | 13936 | 728 | 90.9 | globlastp |
| 7820 | LYD378 cedrus\|11v1\|SRR065007X100635_P1 | 13937 | 728 | 90.9 | globlastp |
| 7821 | LYD378 plantago\|11v1\|SRR066373X100567_P1 | 13938 | 728 | 90.9 | globlastp |
| 7822 | LYD378 silene\|11v1\|SRR096785X10053_P1 | 13939 | 728 | 90.9 | globlastp |
| 7823 | LYD378 tabernaemontana\|11v1\|SRR098689X100844_P1 | 13940 | 728 | 90.9 | globlastp |
| 7824 | LYD378 strawberry\|11v1\|DV438640 | 13941 | 728 | 90.9 | globlastp |
| 7825 | LYD378 potato\|10v1\|BG097905_P1 | 13942 | 728 | 90.9 | globlastp |
| 7826 | LYD378 peanut\|10v1\|CD038771_P1 | 13943 | 728 | 90.9 | globlastp |
| 7827 | LYD378 lettuce\|10v1\|DW058898_P1 | 13944 | 728 | 90.9 | globlastp |
| 7828 | LYD378 soybean\|11v1\|GLYMA05G28480 | 13945 | 728 | 90.9 | globlastp |
| 7829 | LYD378 dandelion\|10v1\|DY802361_P1 | 13946 | 728 | 90.9 | globlastp |
| 7830 | LYD378 flaveria\|11v1\|SRR149241.143610_T1 | 13947 | 728 | 90.7 | glotblastn |
| 7831 | LYD378 basilicum\|10v1\|DY321957_T1 | 13948 | 728 | 90.7 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 7832 | LYD378 amsonia\|11v1\|SRR098688X101360_P1 | 13949 | 728 | 90.7 | globlastp |
| 7833 | LYD378 arnica\|11v1\|SRR099034X101065_P1 | 13950 | 728 | 90.7 | globlastp |
| 7834 | LYD378 chelidonium\|11v1\|SRR084752X101659_P1 | 13951 | 728 | 90.7 | globlastp |
| 7835 | LYD378 humulus\|11v1\|EX519040_P1 | 13952 | 728 | 90.7 | globlastp |
| 7836 | LYD378 maritime_pine\|10v1\|AL750155_P1 | 13953 | 728 | 90.7 | globlastp |
| 7837 | LYD378 phyla\|11v2\|SRR099035X116122_P1 | 13954 | 728 | 90.7 | globlastp |
| 7838 | LYD378 valeriana\|11v1\|SRR099039X101920_P1 | 13955 | 728 | 90.7 | globlastp |
| 7839 | LYD378 aquilegia\|10v2\|JGIAC022728_P1 | 13956 | 728 | 90.7 | globlastp |
| 7840 | LYD378 triphysaria\|10v1\|DR172234 | 13957 | 728 | 90.7 | globlastp |
| 7841 | LYD378 citrus\|gb166\|CB290974_P1 | 13958 | 728 | 90.7 | globlastp |
| 7842 | LYD378 lotus\|09v1\|LLAI967775_P1 | 13959 | 728 | 90.7 | globlastp |
| 7843 | LYD378 triphysaria\|10v1\|BM357191 | 13960 | 728 | 90.7 | globlastp |
| 7844 | LYD378 aquilegia\|10v2\|DR922048_P1 | 13961 | 728 | 90.6 | globlastp |
| 7845 | LYD378 eucalyptus\|11v2\|SRR001658X13888_T1 | 13962 | 728 | 90.6 | glotblastn |
| 7846 | LYD378 oat\|10v2\|GO586651 | 13963 | 728 | 90.5 | glotblastn |
| 7847 | LYD378 oat\|10v2\|GR344174 | 13964 | 728 | 90.5 | glotblastn |
| 7848 | LYD378 iceplant\|gb164\|MCU79766_T1 | 13965 | 728 | 90.5 | glotblastn |
| 7849 | LYD378 oat\|11v1\|GR313462_P1 | 13966 | 728 | 90.5 | globlastp |
| 7850 | LYD378 oat11v1\|GR325352_P1 | 13966 | 728 | 90.5 | globlastp |
| 7851 | LYD378 phalaenopsis\|11v1\|SRR125771.1001108_P1 | 13967 | 728 | 90.5 | globlastp |
| 7852 | LYD378 trigonella\|11v1\|SRR066194X130639_P1 | 13968 | 728 | 90.5 | globlastp |
| 7853 | LYD378 watermelon\|11v1\|VMEL03160725183103_P1 | 13969 | 728 | 90.5 | globlastp |
| 7854 | LYD378 fescue\|gb161\|DT689536_P1 | 13970 | 728 | 90.5 | globlastp |
| 7855 | LYD378 oat\|11v1\|GO586651_P1 | 13966 | 728 | 90.5 | globlastp |
| 7856 | LYD378 oat\|10v2\|GO582752 | 13966 | 728 | 90.5 | globlastp |
| 7857 | LYD378 wheat\|10v2\|CA500890 | 13971 | 728 | 90.5 | globlastp |
| 7858 | LYD378 barley\|10v2\|BF622755_P1 | 13972 | 728 | 90.5 | globlastp |
| 7859 | LYD378 cowpea\|gb166\|FC457714_P1 | 13973 | 728 | 90.5 | globlastp |
| 7860 | LYD378 spruce\|gb162\|CO215633 | 13974 | 728 | 90.5 | globlastp |
| 7861 | LYD378 oat\|11v1\|GR344174_P1 | 13966 | 728 | 90.5 | globlastp |
| 7862 | LYD378 oat\|11v1\|GR313665_P1 | 13966 | 728 | 90.5 | globlastp |
| 7863 | LYD378 maritime_pine\|10v1\|AL750739_P1 | 13975 | 728 | 90.3 | globlastp |
| 7864 | LYD378 oat\|11v1\|GO582752_P1 | 13976 | 728 | 90.3 | globlastp |
| 7865 | LYD378 orange\|11v1\|CB290974_P1 | 13977 | 728 | 90.3 | globlastp |
| 7866 | LYD378 phalaenopsis\|11v1\|X79905_P1 | 13978 | 728 | 90.3 | globlastp |
| 7867 | LYD378 tabernaemontana\|11v1\|SRR098689X100341_P1 | 13979 | 728 | 90.3 | globlastp |
| 7868 | LYD378 vinca\|11v1\|SRR098690X101025_P1 | 13980 | 728 | 90.3 | globlastp |
| 7869 | LYD378 oat\|10v2\|GO592301 | 13976 | 728 | 90.3 | globlastp |
| 7870 | LYD378 oat\|10v2\|GR313665 | 13976 | 728 | 90.3 | globlastp |
| 7871 | LYD378 antirrhinum\|gb166\|AJ558951_P1 | 13981 | 728 | 90.3 | globlastp |
| 7872 | LYD378 amborella\|gb166\|CD482763_P1 | 13982 | 728 | 90.3 | globlastp |
| 7873 | LYD378 clementine\|11v1\|CB290974_P1 | 13983 | 728 | 90.1 | globlastp |
| 7874 | LYD378 phalaenopsis\|11v1\|SRR125771.1000920_P1 | 13984 | 728 | 90.1 | globlastp |
| 7875 | LYD378 plantago\|11v1\|SRR066373X100249_P1 | 13985 | 728 | 90.1 | globlastp |
| 7876 | LYD378 banana\|10v1\|DV270762_P1 | 13986 | 728 | 90.1 | globlastp |
| 7877 | LYD378 oil_palm\|gb166\|CN599616_P1 | 13987 | 728 | 90.1 | globlastp |
| 7878 | LYD378 spruce\|gb162\|CO216143 | 13988 | 728 | 90.1 | globlastp |
| 7879 | LYD378 eschscholzia\|10v1\|CD479487 | 13989 | 728 | 90.1 | globlastp |
| 7880 | LYD378 lettuce\|10v1\|DW079447_P1 | 13990 | 728 | 90.1 | globlastp |
| 7881 | LYD378 cedrus\|11v1\|SRR065007X100240_P1 | 13991 | 728 | 89.9 | globlastp |
| 7882 | LYD378 vinca\|11v1\|SRR098690X101569_P1 | 13992 | 728 | 89.9 | globlastp |
| 7883 | LYD378 foxtail_millet\|10v2\|SICRP000601 | 13993 | 728 | 89.9 | globlastp |
| 7884 | LYD378 poppy\|gb166\|EB740753_P1 | 13994 | 728 | 89.9 | globlastp |
| 7885 | LYD378 wheat\|10v2\|BF293436 | 13995 | 728 | 89.9 | globlastp |
| 7886 | LYD378 pseudotsuga\|10v1\|SRR065119S0000474 | 13996 | 728 | 89.9 | globlastp |
| 7887 | LYD378 podocarpus\|10v1\|SRR065014S0001919_P1 | 13997 | 728 | 89.9 | globlastp |
| 7888 | LYD378 lettuce\|10v1\|DW045122_P1 | 13998 | 728 | 89.9 | globlastp |
| 7889 | LYD378 cotton\|10v2\|AI725445_P1 | 13999 | 728 | 89.7 | globlastp |
| 7890 | LYD378 pseudotsuga\|10v1\|SRR065119S0007645 | 14000 | 728 | 89.7 | globlastp |
| 7891 | LYD378 orobanche\|10v1\|SRR023189S0005157_P1 | 14001 | 728 | 89.7 | globlastp |
| 7892 | LYD378 spikemoss\|gb165\|FE427744 | 14002 | 728 | 89.7 | globlastp |
| 7893 | LYD378 spikemoss\|gb165\|FE428682 | 14002 | 728 | 89.7 | globlastp |
| 7894 | LYD378 wheat\|10v2\|BG274640 | 14003 | 728 | 89.7 | glotblastn |
| 7895 | LYD378 amorphophallus\|11v2\|SRR089351X145173_P1 | 14004 | 728 | 89.5 | globlastp |
| 7896 | LYD378 canola\|11v1\|ES264127_P1 | 14005 | 728 | 89.5 | globlastp |
| 7897 | LYD378 pteridium\|11v1\|SRR043594X134214_P1 | 14006 | 728 | 89.5 | globlastp |
| 7898 | LYD378 chickpea\|09v2\|AJ884609_P1 | 14007 | 728 | 89.5 | globlastp |
| 7899 | LYD378 clover\|gb162\|AB236781_P1 | 14008 | 728 | 89.5 | globlastp |
| 7900 | LYD378 sciadopitys\|10v1\|SRR065035S0002413 | 14009 | 728 | 89.5 | globlastp |
| 7901 | LYD378 pine\|10v2\|AJ300723_T1 | 14010 | 728 | 89.5 | glotblastn |
| 7902 | LYD378 sequoia\|10v1\|SRR065044S0008296 | 14011 | 728 | 89.3 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 7903 | LYD378 grape\|11v1\|GSVIVT01007578001_P1 | 14012 | 728 | 89.3 | globlastp |
| 7904 | LYD378 grape\|gb160\|BG273708 | 14012 | 728 | 89.3 | globlastp |
| 7905 | LYD378 sequoia\|10v1\|SRR065044S0001399 | 14013 | 728 | 89.3 | globlastp |
| 7906 | LYD378 abies\|11v2\|SRR098676X100678_P1 | 14014 | 728 | 89.1 | globlastp |
| 7907 | LYD378 abies\|11v2\|SRR098676X135135XX1_P1 | 14015 | 728 | 89.1 | globlastp |
| 7908 | LYD378 cucumber\|09v1\|BGI454H0019958_P1 | 14016 | 728 | 89.1 | globlastp |
| 7909 | LYD378 medicago\|09v1\|AW257137_P1 | 14017 | 728 | 89.1 | globlastp |
| 7910 | LYD378 aristolochia\|10v1\|FD758204_P1 | 14018 | 728 | 89.1 | globlastp |
| 7911 | LYD378 distylium\|11v1\|SRR065077X100334_P1 | 14019 | 728 | 88.9 | globlastp |
| 7912 | LYD378 grape\|11v1\|EC973452_P1 | 14020 | 728 | 88.9 | globlastp |
| 7913 | LYD378 platanus\|11v1\|SRR096786X112499_P1 | 14021 | 728 | 88.9 | globlastp |
| 7914 | LYD378 trigonella\|11v1\|SRR066194X101523_P1 | 14022 | 728 | 88.9 | globlastp |
| 7915 | LYD378 cephalotaxus\|11v1\|SRR064395X100750_P1 | 14023 | 728 | 88.7 | globlastp |
| 7916 | LYD378 cotton\|10v2\|DN761470_P1 | 14024 | 728 | 88.7 | globlastp |
| 7917 | LYD378 cycas\|gb166\|CB089508_P1 | 14025 | 728 | 88.7 | globlastp |
| 7918 | LYD378 amorphophallus\|11v2\|SRR089351X223228_T1 | 14026 | 728 | 88.7 | glotblastn |
| 7919 | LYD378 cephalotaxus\|11v1\|SRR064395X103851_P1 | 14027 | 728 | 88.5 | globlastp |
| 7920 | LYD378 ginger\|gb164\|DY351813_P1 | 14028 | 728 | 88.5 | globlastp |
| 7921 | LYD378 coffea\|10v1\|DV664613_P1 | 14029 | 728 | 88.5 | globlastp |
| 7922 | LYD378 phalaenopsis\|11v1\|SRR125771.1004214_T1 | 14030 | 728 | 88.5 | glotblastn |
| 7923 | LYD378 flaveria\|11v1\|SRR149232.140380_P1 | 14031 | 728 | 88.0 | globlastp |
| 7924 | LYD378 pine\|10v2\|AL751326_T1 | 14032 | 728 | 87.8 | glotblastn |
| 7925 | LYD378 marchantia\|gb166\|BJ841640_P1 | 14033 | 728 | 87.8 | globlastp |
| 7926 | LYD378 phalaenopsis\|11v1\|CK857700_P1 | 14034 | 728 | 87.6 | globlastp |
| 7927 | LYD378 taxus\|10v1\|SRR032523S0022935 | 14035 | 728 | 87.6 | globlastp |
| 7928 | LYD378 podocarpus\|10v1\|SRR065014S0000841_P1 | 14036 | 728 | 87.4 | globlastp |
| 7929 | LYD378 flaveria\|11v1\|SRR149232.114721_P1 | 14037 | 728 | 87.2 | globlastp |
| 7930 | LYD378 gnetum\|10v1\|SRR064399S0034636_P1 | 14038 | 728 | 87.2 | globlastp |
| 7931 | LYD378 physcomitrella\|10v1\|AW599908_P1 | 14039 | 728 | 87.2 | globlastp |
| 7932 | LYD378 physcomitrella\|10v1\|AW561393_P1 | 14040 | 728 | 87.2 | globlastp |
| 7933 | LYD378 petunia\|gb171\|CV292638_P1 | 14041 | 728 | 87.0 | globlastp |
| 7934 | LYD378 physcomitrella\|10v1\|AW739367_P1 | 14042 | 728 | 86.8 | globlastp |
| 7935 | LYD378 ceratodon\|10v1\|SRR074890S0069256_P1 | 14043 | 728 | 86.8 | globlastp |
| 7936 | LYD378 scabiosa\|11v1\|SRR063723X100816_P1 | 14044 | 728 | 86.4 | globlastp |
| 7937 | LYD378 zostera\|10v1\|SRR057351S0002262 | 14045 | 728 | 86.0 | globlastp |
| 7938 | LYD378 tragopogon\|10v1\|SRR020205S0010360 | 14046 | 728 | 85.6 | globlastp |
| 7939 | LYD378 cacao\|10v1\|CU481992_P1 | 14047 | 728 | 85.6 | globlastp |
| 7940 | LYD378 cleome_gynandra\|10v1\|SRR015532S0007187_P1 | 14048 | 728 | 85.4 | globlastp |
| 7941 | LYD378 cotton\|10v2\|DT545969_P1 | 14049 | 728 | 84.9 | globlastp |
| 7942 | LYD378 pteridium\|11v1\|GW574811_P1 | 14050 | 728 | 84.7 | globlastp |
| 7943 | LYD378 b_rapa\|gb162\|BG544576_P1 | 14051 | 728 | 84.3 | globlastp |
| 7944 | LYD378 primula\|11v1\|SRR098680X207816_P1 | 14052 | 728 | 84.1 | globlastp |
| 7945 | LYD378 beet\|gb162\|BE590262_P1 | 14053 | 728 | 83.9 | globlastp |
| 7946 | LYD378 pteridium\|11v1\|GW575179_P1 | 14054 | 728 | 82.3 | globlastp |
| 7947 | LYD378 sequoia\|10v1\|SRR065044S0092560 | 14055 | 728 | 81.9 | globlastp |
| 7948 | LYD378 canola\|11v1\|CD836192_P1 | 14056 | 728 | 81.3 | globlastp |
| 7949 | LYD378 curcuma\|10v1\|DY388142_P1 | 14057 | 728 | 81.0 | globlastp |
| 7950 | LYD378 artemisia\|10v1\|EY033112_P1 | 14058 | 728 | 80.2 | globlastp |
| 7951 | LYD382 peanut\|10v1\|CX127907_P1 | 14059 | 730 | 85.9 | globlastp |
| 7952 | LYD382 trigonella\|11v1\|SRR066194X105498_P1 | 14060 | 730 | 85.5 | globlastp |
| 7953 | LYD382 aristolochia\|10v1\|FD754814_P1 | 14061 | 730 | 85.5 | globlastp |
| 7954 | LYD382 eucalyptus\|11v2\|CU396775_P1 | 14062 | 730 | 85.1 | globlastp |
| 7955 | LYD382 chestnut\|gb170\|SRR006295S0000754_P1 | 14063 | 730 | 85.1 | globlastp |
| 7956 | LYD382 oak\|10v1\|AJ873910_P1 | 14064 | 730 | 85.1 | globlastp |
| 7957 | LYD382 lotus\|09v1\|LLBI418341_P1 | 14065 | 730 | 85.0 | globlastp |
| 7958 | LYD382 clover\|gb162\|BB903607_P1 | 14066 | 730 | 84.8 | globlastp |
| 7959 | LYD382 soybean\|11v1\|GLYMA19G01200 | 14067 | 730 | 84.6 | globlastp |
| 7960 | LYD382 aquilegia\|10v2\|DR944702_P1 | 14068 | 730 | 84.3 | globlastp |
| 7961 | LYD382 medicago\|09v1\|LLAW684105_P1 | 14069 | 730 | 84.2 | globlastp |
| 7962 | LYD382 soybean\|11v1\|GLYMA13G23790 | 14070 | 730 | 84.1 | globlastp |
| 7963 | LYD382 utricularia\|11v1\|SRR094438.102147_P1 | 14071 | 730 | 83.2 | globlastp |
| 7964 | LYD382 safflower\|gb162\|EL374718 | 14072 | 730 | 83.0 | globlastp |
| 7965 | LYD382 amborella\|gb166\|CD483403_P1 | 14073 | 730 | 82.5 | globlastp |
| 7966 | LYD382 spurge\|gb161\|BG317312 | 14074 | 730 | 82.3 | glotblastn |
| 7967 | LYD382 phalaenopsis\|11v1\|SRR125771.1039093_T1 | 14075 | 730 | 82.0 | glotblastn |
| 7968 | LYD382 antirrhinum\|gb166\|AJ568796_T1 | 14076 | 730 | 81.9 | glotblastn |
| 7969 | LYD382 sarracenia\|11v1\|SRR192669.101165_T1 | 14077 | 730 | 81.8 | glotblastn |
| 7970 | LYD382 cowpea\|gb166\|FF385586_P1 | 14078 | 730 | 80.4 | globlastp |
| 7971 | LYD382 fescue\|gb161\|DT679486_P1 | 14079 | 730 | 80.4 | globlastp |
| 7972 | LYD382 flaveria\|11v1\|SRR149229.113579_T1 | 14080 | 730 | 80.4 | glotblastn |
| 7973 | LYD385 cotton\|10v2\|BQ403999_P1 | 14081 | 732 | 82.5 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 7974 | LYD387 cotton\|10v2\|DW506465_T1 | 14082 | 734 | 82.0 | glotblastn |
| 7975 | LYD387 cassava\|09v1\|BM259711_P1 | 14083 | 734 | 81.3 | globlastp |
| 7976 | LYD388 cacao\|10v1\|CF972938_P1 | 14084 | 735 | 94.9 | globlastp |
| 7977 | LYD388 castorbean\|09v1\|XM002509535 | 14085 | 735 | 89.9 | globlastp |
| 7978 | LYD388 castorbean\|11v1\|XM_002509535_P1 | 14085 | 735 | 89.9 | globlastp |
| 7979 | LYD388 tripterygium\|11v1\|SRR098677X10453_P1 | 14086 | 735 | 89.0 | globlastp |
| 7980 | LYD388 cassava\|09v1\|DV443057_P1 | 14087 | 735 | 89.0 | globlastp |
| 7981 | LYD388 soybean\|11v1\|GLYMA05G04210 | 14088 | 735 | 88.9 | globlastp |
| 7982 | LYD388 cleome_spinosa\|10v1\|GR932635_P1 | 14089 | 735 | 88.3 | globlastp |
| 7983 | LYD388 cassava\|09v1\|DV453987_P1 | 14090 | 735 | 88.3 | globlastp |
| 7984 | LYD388 prunus\|10v1\|CN926018 | 14091 | 735 | 87.9 | globlastp |
| 7985 | LYD388 poplar\|10v1\|BI071632_P1 | 14092 | 735 | 87.8 | globlastp |
| 7986 | LYD388 watermelon\|11v1\|DV632848_P1 | 14093 | 735 | 87.7 | globlastp |
| 7987 | LYD388 cleome_gynandra\|10v1\|SRR015532S0003320_P1 | 14094 | 735 | 87.7 | globlastp |
| 7988 | LYD388 cannabis\|12v1\|EW701274_P1 | 14095 | 735 | 87.6 | globlastp |
| 7989 | LYD388 oak\|10v1\|CU657806_P1 | 14096 | 735 | 87.6 | globlastp |
| 7990 | LYD388 clementine\|11v1\|CK701311_P1 | 14097 | 735 | 87.4 | globlastp |
| 7991 | LYD388 euphorbia\|11v1\|SRR098678X102845_P1 | 14098 | 735 | 87.4 | globlastp |
| 7992 | LYD388 apple\|11v1\|CN926018_P1 | 14099 | 735 | 87.4 | globlastp |
| 7993 | LYD388 orange\|11v1\|CK701311_P1 | 14100 | 735 | 87.3 | globlastp |
| 7994 | LYD388 eucalyptus\|11v2\|ES590034_P1 | 14101 | 735 | 87.2 | globlastp |
| 7995 | LYD388 cucumber\|09v1\|DV632848_P1 | 14102 | 735 | 87.0 | globlastp |
| 7996 | LYD388 catharanthus\|11v1\|SRR098691X102854_P1 | 14103 | 735 | 86.6 | globlastp |
| 7997 | LYD388 amsonia\|11v1\|SRR098688X100719_P1 | 14104 | 735 | 86.5 | globlastp |
| 7998 | LYD388 thellungiella_halophilum\|11v1\|DN773721_P1 | 14105 | 735 | 86.5 | globlastp |
| 7999 | LYD388 canola\|11v1\|EE452078_P1 | 14106 | 735 | 86.3 | globlastp |
| 8000 | LYD388 thellungiella_parvulum\|11v1\|DN773721_P1 | 14107 | 735 | 86.3 | globlastp |
| 8001 | LYD388 medicago\|09v1\|AW127680_P1 | 14108 | 735 | 86.1 | globlastp |
| 8002 | LYD388 strawberry\|11v1\|DY674203 | 14109 | 735 | 86.1 | globlastp |
| 8003 | LYD388 arabidopsis\|10v1\|AT1G62750_P1 | 14110 | 735 | 86.0 | globlastp |
| 8004 | LYD388 arabidopsis_lyrata\|09v1\|JGIAL005652_P1 | 14111 | 735 | 85.6 | globlastp |
| 8005 | LYD388 phyla\|11v2\|SRR099035X101386_P1 | 14112 | 735 | 85.5 | globlastp |
| 8006 | LYD388 tabernaemontana\|11v1\|SRR098689X112571_P1 | 14113 | 735 | 85.5 | globlastp |
| 8007 | LYD388 aristolochia\|10v1\|FD761141_P1 | 14114 | 735 | 85.5 | globlastp |
| 8008 | LYD388 flaveria\|11v1\|SRR149232.30580_P1 | 14115 | 735 | 85.3 | globlastp |
| 8009 | LYD388 flaveria\|11v1\|SRR149229.117602_P1 | 14116 | 735 | 84.8 | globlastp |
| 8010 | LYD388 ambrosia\|11v1\|SRR346935.209205_P1 | 14117 | 735 | 84.7 | globlastp |
| 8011 | LYD388 tomato\|11v1\|BG130489_P1 | 14118 | 735 | 84.7 | globlastp |
| 8012 | LYD388 tomato\|09v1\|AA076677 | 14118 | 735 | 84.7 | globlastp |
| 8013 | LYD388 ambrosia\|11v1\|SRR346935.394950_P1 | 14119 | 735 | 84.6 | globlastp |
| 8014 | LYD388 ambrosia\|11v1\|SRR346935.128714_P1 | 14120 | 735 | 84.3 | globlastp |
| 8015 | LYD388 arnica\|11v1\|SRR099034X104664_P1 | 14121 | 735 | 83.9 | globlastp |
| 8016 | LYD388 sunflower\|10v1\|CX943962 | 14122 | 735 | 83.7 | globlastp |
| 8017 | LYD388 triphysaria\|10v1\|EY148720 | 14123 | 735 | 83.4 | globlastp |
| 8018 | LYD388 lettuce\|10v1\|DW057556_P1 | 14124 | 735 | 83.3 | globlastp |
| 8019 | LYD388 aquilegia\|10v2\|DT740030_P1 | 14125 | 735 | 83.0 | globlastp |
| 8020 | LYD388 grape\|11v1\|GSVIVT01006035001_P1 | 14126 | 735 | 82.1 | globlastp |
| 8021 | LYD388 sorghum\|11v1\|SB06G023840_P1 | 14127 | 735 | 81.9 | globlastp |
| 8022 | LYD388 phalaenopsis\|11v1\|SRR125771.1005741_P1 | 14128 | 735 | 81.6 | globlastp |
| 8023 | LYD388 switchgrass\|gb167\|FE637605 | 14129 | 735 | 81.2 | globlastp |
| 8024 | LYD388 zostera\|10v1\|SRR057351S0020994 | 14130 | 735 | 80.9 | globlastp |
| 8025 | LYD388 maize\|10v1\|AI649702_P1 | 14131 | 735 | 80.8 | globlastp |
| 8026 | LYD388 foxtail_millet\|11v3\|PHY7SI009422M_P1 | 14132 | 735 | 80.8 | globlastp |
| 8027 | LYD388 distylium\|11v1\|SRR065077X104454_P1 | 14133 | 735 | 80.6 | globlastp |
| 8028 | LYD388 maize\|10v1\|CD969589_P1 | 14134 | 735 | 80.6 | globlastp |
| 8029 | LYD388 cedrus\|11v1\|SRR065007X100464_P1 | 14135 | 735 | 80.3 | globlastp |
| 8030 | LYD388 cephalotaxus\|11v1\|SRR064395X105408_P1 | 14136 | 735 | 80.2 | globlastp |
| 8031 | LYD388 platanus\|11v1\|SRR096786X103276_P1 | 14137 | 735 | 80.2 | globlastp |
| 8032 | LYD388 wheat\|10v2\|BE412213XX1 | 14138 | 735 | 80.2 | globlastp |
| 8033 | LYD391 sorghum\|09v1\|SB03G032950 | 14139 | 737 | 93.0 | globlastp |
| 8034 | LYD391 sorghum\|11v1\|SB03G032950_P1 | 14139 | 737 | 93.0 | globlastp |
| 8035 | LYD391 switchgrass\|gb167\|DN141759 | 14140 | 737 | 88.1 | globlastp |
| 8036 | LYD392 foxtail_millet\|10v2\|EC613417 | 14141 | 738 | 86.2 | globlastp |
| 8037 | LYD392 foxtail_millet\|11v3\|EC613417_P1 | 14141 | 738 | 86.2 | globlastp |
| 8038 | LYD392 switchgrass\|gb167\|FE646413 | 14142 | 738 | 85.3 | glotblastn |
| 8039 | LYD392 millet\|10v1\|EVO454PM013913_P1 | 14143 | 738 | 84.3 | globlastp |
| 8040 | LYD396 trigonella\|11v1\|SRR066194X231762_P1 | 14144 | 740 | 95.2 | globlastp |
| 8041 | LYD396 soybean\|11v1\|GLYMA13G32830 | 14145 | 740 | 84.6 | globlastp |
| 8042 | LYD396 pigeonpea\|10v1\|SRR054580S0009276_P1 | 14146 | 740 | 83.9 | globlastp |
| 8043 | LYD396 pigeonpea\|10v1\|SRR054580S0023424_P1 | 14147 | 740 | 82.5 | globlastp |
| 8044 | LYD397 chestnut\|gb170\|SRR006295S0021804_P1 | 14148 | 741 | 80.8 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 8045 | LYD397 oak\|10v1\|FP036011_P1 | 14149 | 741 | 80.8 | globlastp |
| 8046 | LYD398 trigonella\|11v1\|SRR066194X111474_P1 | 14150 | 742 | 88.7 | globlastp |
| 8047 | LYD403 soybean\|11v1\|GLYMA09G07590 | 14151 | 743 | 84.4 | globlastp |
| 8048 | LYD403 soybean\|11v1\|GLYMA15G18810 | 14152 | 743 | 84.4 | globlastp |
| 8049 | LYD403 cowpea\|gb166\|FF546951_P1 | 14153 | 743 | 83.0 | globlastp |
| 8050 | LYD403 pigeonpea\|10v1\|SRR054580S0008236_P1 | 14154 | 743 | 83.0 | globlastp |
| 8051 | LYD408 trigonella\|11v1\|SRR066194X115949_P1 | 14155 | 746 | 81.5 | globlastp |
| 8052 | LYD413 soybean\|11v1\|GLYMA12G09390 | 14156 | 749 | 87.5 | globlastp |
| 8053 | LYD413 pigeonpea\|10v1\|SRR054580S0048726_T1 | 14157 | 749 | 83.2 | glotblastn |
| 8054 | LYD415 soybean\|11v1\|GLYMA04G42010 | 14158 | 750 | 83.4 | globlastp |
| 8055 | LYD415 pigeonpea\|10v1\|SRR054580S0082138_P1 | 14159 | 750 | 82.9 | globlastp |
| 8056 | LYD415 soybean\|11v1\|GLYMA06G12760 | 14160 | 750 | 82.8 | globlastp |
| 8057 | LYD415 bean\|gb167\|CB539322_P1 | 14161 | 750 | 80.4 | globlastp |
| 8058 | LYD416 lotus\|09v1\|GO018503_T1 | 14162 | 751 | 86.6 | glotblastn |
| 8059 | LYD416 poplar\|10v1\|AI167032_T1 | 14163 | 751 | 80.9 | glotblastn |
| 8060 | LYD419 bean\|gb167\|CA906538_P1 | 14164 | 754 | 80.5 | globlastp |
| 8061 | LYD422 tripterygium\|11v1\|SRR098677X105702_P1 | 14165 | 756 | 81.1 | globlastp |
| 8062 | LYD428 maize\|10v1\|AW231584_P1 | 14166 | 757 | 88.0 | globlastp |
| 8063 | LYD436 maize\|10v1\|AI942031_P1 | 14167 | 758 | 96.1 | globlastp |
| 8064 | LYD436 foxtail_millet\|11v3\|PHY7SI021562M_P1 | 14168 | 758 | 95.8 | globlastp |
| 8065 | LYD436 foxtail_millet\|10v2\|SICRP027763 | 14169 | 758 | 94.8 | glotblastn |
| 8066 | LYD436 brachypodium\|09v1\|DV470118_P1 | 14170 | 758 | 88.8 | globlastp |
| 8067 | LYD436 rice\|gb170\|OS05G05800 | 14171 | 758 | 87.9 | globlastp |
| 8068 | LYD446 soybean\|11v1\|GLYMA05G03300_P1 | 654 | 759 | 80.2 | globlastp |
| 8069 | LYD456 soybean\|11v1\|GLYMA12G01800 | 14172 | 763 | 85.1 | globlastp |
| 8070 | LYD456 soybean\|11v1\|GLYMA12G01780 | 14173 | 763 | 80.1 | globlastp |
| 8071 | LYD480 solanum_phureja\|09v1\|SPHAI771275 | 14174 | 766 | 95.4 | globlastp |
| 8072 | LYD487 potato\|10v1\|BE921852_P1 | 14175 | 768 | 95.9 | globlastp |
| 8073 | LYD487 solanum_phureja\|09v1\|SPHBG127385 | 14176 | 768 | 95.7 | globlastp |
| 8074 | LYD497 thellungiella_halophilum\|11v1\|DN775488_P1 | 14177 | 769 | 97.6 | globlastp |
| 8075 | LYD497 arabidopsis_lyrata\|09v1\|BQ834502_P1 | 14178 | 769 | 96.4 | globlastp |
| 8076 | LYD497 arabidopsis\|10v1\|AT3G44110_P1 | 14179 | 769 | 96.0 | globlastp |
| 8077 | LYD497 radish\|gb164\|EW713755 | 14180 | 769 | 95.0 | glotblastn |
| 8078 | LYD497 thellungiella_halophilum\|11v1\|DN776143_P1 | 14181 | 769 | 91.3 | globlastp |
| 8079 | LYD497 thellungiella\|gb167\|DN775488 | 14181 | 769 | 91.3 | globlastp |
| 8080 | LYD497 thellungiella_parvulum\|11v1\|DN776143_P1 | 14182 | 769 | 90.8 | globlastp |
| 8081 | LYD497 arabidopsis_lyrata\|09v1\|JGIAL021881_P1 | 14183 | 769 | 90.8 | globlastp |
| 8082 | LYD497 b_rapa\|gb162\|BG543519_P1 | 14184 | 769 | 90.4 | globlastp |
| 8083 | LYD497 b_rapa gb162\|BQ790681_P1 | 14185 | 769 | 90.1 | globlastp |
| 8084 | LYD497 canola\|10v1\|DY020103 | 14186 | 769 | 90.1 | globlastp |
| 8085 | LYD497 canola\|11v1\|DY020103_P1 | 14186 | 769 | 90.1 | globlastp |
| 8086 | LYD497 canola\|10v1\|EE417645 | 14187 | 769 | 90.1 | globlastp |
| 8087 | LYD497 canola\|11v1\|EE417645_P1 | 14187 | 769 | 90.1 | globlastp |
| 8088 | LYD497 b_oleracea\|gb161\|DY029727_P1 | 14188 | 769 | 89.9 | globlastp |
| 8089 | LYD497 b_rapa\|gb162\|L37658_P1 | 14189 | 769 | 89.9 | globlastp |
| 8090 | LYD497 canola\|10v1\|DW997640 | 14190 | 769 | 89.9 | globlastp |
| 8091 | LYD497 canola\|11v1\|DW997640XX1_P1 | 14190 | 769 | 89.9 | globlastp |
| 8092 | LYD497 canola\|10v1\|H74465 | 14188 | 769 | 89.9 | globlastp |
| 8093 | LYD497 canola\|11v1\|CN728966_P1 | 14188 | 769 | 89.9 | globlastp |
| 8094 | LYD497 b_oleracea\|gb161\|DY027908_P1 | 14191 | 769 | 89.6 | globlastp |
| 8095 | LYD497 canola\|10v1\|CX190136 | 14192 | 769 | 89.6 | globlastp |
| 8096 | LYD497 canola\|11v1\|DY006307_P1 | 14192 | 769 | 89.6 | globlastp |
| 8097 | LYD497 arabidopsis\|10v1\|AT5G22060_P1 | 14193 | 769 | 89.4 | globlastp |
| 8098 | LYD497 radish\|gb164\|EV525842 | 14194 | 769 | 89.4 | globlastp |
| 8099 | LYD497 radish\|gb164\|EW716467 | 14195 | 769 | 89.4 | globlastp |
| 8100 | LYD497 apple\|11v1\|CN491118_P1 | 14196 | 769 | 88.0 | globlastp |
| 8101 | LYD497 apple\|gb171\|CN491118 | 14196 | 769 | 88.0 | globlastp |
| 8102 | LYD497 oak\|10v1\|DB997907_P1 | 14197 | 769 | 87.0 | globlastp |
| 8103 | LYD497 apple\|11v1\|CN866270_P1 | 14198 | 769 | 87.0 | globlastp |
| 8104 | LYD497 apple\|gb171\|CN866270 | 14198 | 769 | 87.0 | globlastp |
| 8105 | LYD497 chestnut\|gb170\|SRR006295S0002664_P1 | 14199 | 769 | 86.7 | globlastp |
| 8106 | LYD497 trigonella\|11v1\|SRR066194X102083_P1 | 14200 | 769 | 86.6 | globlastp |
| 8107 | LYD497 medicago\|09v1\|AI974233_P1 | 14201 | 769 | 86.6 | globlastp |
| 8108 | LYD497 soybean\|11v1\|GLYMA12G10150 | 14202 | 769 | 86.6 | globlastp |
| 8109 | LYD497 catharanthus\|11v1\|EG556090_P1 | 14203 | 769 | 86.5 | globlastp |
| 8110 | LYD497 peanut\|10v1\|ES721812_P1 | 14204 | 769 | 86.5 | globlastp |
| 8111 | LYD497 ambrosia\|11v1\|SRR346935.160842_P1 | 14205 | 769 | 86.3 | globlastp |
| 8112 | LYD497 soybean\|11v1\|GLYMA11G17930 | 14206 | 769 | 86.3 | globlastp |
| 8113 | LYD497 amsonia\|11v1\|SRR098688X107269_P1 | 14207 | 769 | 86.1 | globlastp |
| 8114 | LYD497 pigeonpea\|10v1\|GW352659_P1 | 14208 | 769 | 85.9 | globlastp |
| 8115 | LYD497 ambrosia\|11v1\|SRR346935.136048_P1 | 14209 | 769 | 85.8 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 8116 | LYD497_ambrosia\|11v1\|GR935619_P1 | 14210 | 769 | 85.6 | globlastp |
| 8117 | LYD497_tripterygium\|11v1\|SRR098677X104761_P1 | 14211 | 769 | 85.6 | globlastp |
| 8118 | LYD497_eucalyptus\|11v2\|CB967915_P1 | 14212 | 769 | 85.3 | globlastp |
| 8119 | LYD497_euphorbia\|11v1\|BI975259_P1 | 14213 | 769 | 85.3 | globlastp |
| 8120 | LYD497_orange\|11v1\|CF506830_P1 | 14214 | 769 | 85.3 | globlastp |
| 8121 | LYD497_trigonella\|11v1\|SRR066194X100701_P1 | 14215 | 769 | 85.3 | globlastp |
| 8122 | LYD497_iceplant\|gb164\|BE033497_P1 | 14216 | 769 | 85.3 | globlastp |
| 8123 | LYD497_petunia\|gb171\|CV292987_P1 | 14217 | 769 | 85.3 | globlastp |
| 8124 | LYD497_prunus\|10v1\|CN491118 | 14218 | 769 | 85.3 | globlastp |
| 8125 | LYD497_melon\|10v1\|VMEL00562912803351_P1 | 14219 | 769 | 85.3 | globlastp |
| 8126 | LYD497_peanut\|10v1\|EG029783_P1 | 14220 | 769 | 85.3 | globlastp |
| 8127 | LYD497_sunflower\|10v1\|CD850942 | 14221 | 769 | 85.2 | globlastp |
| 8128 | LYD497_fraxinus\|11v1\|SRR058827.104257_T1 | 14222 | 769 | 85.1 | glotblastn |
| 8129 | LYD497_clementine\|11v1\|CF506830_P1 | 14223 | 769 | 85.1 | globlastp |
| 8130 | LYD497_tabernaemontana\|11v1\|SRR098689X104137_P1 | 14224 | 769 | 85.1 | globlastp |
| 8131 | LYD497_vinca\|11v1\|SRR098690X102857_P1 | 14225 | 769 | 85.1 | globlastp |
| 8132 | LYD497_citrus\|gb166\|CF506830_P1 | 14223 | 769 | 85.1 | globlastp |
| 8133 | LYD497_cucumber\|09v1\|DN910007_P1 | 14226 | 769 | 85.1 | globlastp |
| 8134 | LYD497_pepper\|gb171\|BI480578_P1 | 14227 | 769 | 85.1 | globlastp |
| 8135 | LYD497_solanum_phureja\|09v1\|SPHBG123223 | 14228 | 769 | 85.1 | globlastp |
| 8136 | LYD497_soybean\|11v1\|GLYMA13G38790 | 14229 | 769 | 85.1 | globlastp |
| 8137 | LYD497_lettuce\|10v1\|DW081072_P1 | 14230 | 769 | 85.0 | globlastp |
| 8138 | LYD497_euonymus\|11v1\|SRR070038X100033_P1 | 14231 | 769 | 84.9 | globlastp |
| 8139 | LYD497_flaveria\|11v1\|SRR149238.194383_P1 | 14232 | 769 | 84.9 | globlastp |
| 8140 | LYD497_prunus\|10v1\|BI203058_P1 | 14233 | 769 | 84.9 | globlastp |
| 8141 | LYD497_vinca\|11v1\|SRR098690X103365_P1 | 14234 | 769 | 84.9 | globlastp |
| 8142 | LYD497_cotton\|10v2\|DT569498_P1 | 14235 | 769 | 84.9 | globlastp |
| 8143 | LYD497_cowpea\|gb166\|FC457865_P1 | 14236 | 769 | 84.9 | globlastp |
| 8144 | LYD497_grape\|11v1\|GSVIVT01036049001_P1 | 14237 | 769 | 84.9 | globlastp |
| 8145 | LYD497_grape\|gb160\|CA815428 | 14237 | 769 | 84.9 | globlastp |
| 8146 | LYD497_euonymus\|11v1\|SRR070038X113733_P1 | 14238 | 769 | 84.8 | globlastp |
| 8147 | LYD497_phyla\|11v2\|SRR099035X104836_P1 | 14239 | 769 | 84.8 | globlastp |
| 8148 | LYD497_soybean\|11v1\|GLYMA12G31620 | 14240 | 769 | 84.8 | globlastp |
| 8149 | LYD497_flaveria\|11v1\|SRR149229.129866_P1 | 14241 | 769 | 84.7 | globlastp |
| 8150 | LYD497_flaveria\|11v1\|SRR149229.171545_P1 | 14242 | 769 | 84.7 | globlastp |
| 8151 | LYD497_flaveria\|11v1\|SRR149238.56747_P1 | 14243 | 769 | 84.7 | globlastp |
| 8152 | LYD497_flax\|11v1\|CA482256_P1 | 14244 | 769 | 84.7 | globlastp |
| 8153 | LYD497_ambrosia\|11v1\|SRR346935.161298_T1 | 14245 | 769 | 84.7 | glotblastn |
| 8154 | LYD497_watermelon\|11v1\|DQ641089_T1 | 14246 | 769 | 84.6 | glotblastn |
| 8155 | LYD497_canola\|11v1\|EE415454_P1 | 14247 | 769 | 84.6 | globlastp |
| 8156 | LYD497_tomato\|11v1\|NTU64914_P1 | 14248 | 769 | 84.6 | globlastp |
| 8157 | LYD497_tripterygium\|11v1\|SRR098677X113291_T1 | 14249 | 769 | 84.6 | glotblastn |
| 8158 | LYD497_papaya\|gb165\|AM903496_P1 | 14250 | 769 | 84.6 | globlastp |
| 8159 | LYD497_tomato\|09v1\|BG123223 | 14248 | 769 | 84.6 | globlastp |
| 8160 | LYD497_medicago\|09v1\|AI974478_P1 | 14251 | 769 | 84.6 | globlastp |
| 8161 | LYD497_lettuce\|10v1\|DW071427_P1 | 14252 | 769 | 84.5 | globlastp |
| 8162 | LYD497_aristolochia\|10v1\|FD760954_P1 | 14253 | 769 | 84.4 | globlastp |
| 8163 | LYD497_grape\|11v1\|GSVIVT01034612001_P1 | 14254 | 769 | 84.4 | globlastp |
| 8164 | LYD497_grape\|gb160\|BE846432 | 14254 | 769 | 84.4 | globlastp |
| 8165 | LYD497_bean\|gb167\|BU791100_P1 | 14255 | 769 | 84.4 | globlastp |
| 8166 | LYD497_antirrhinum\|gb166\|AJ790003_P1 | 14256 | 769 | 84.4 | globlastp |
| 8167 | LYD497_oak\|10v1\|FP059464_P1 | 14257 | 769 | 84.4 | globlastp |
| 8168 | LYD497_fagopyrum\|11v1\|SRR063689X103645_P1 | 14258 | 769 | 84.2 | globlastp |
| 8169 | LYD497_flaveria\|11v1\|SRR149229.104349_P1 | 14259 | 769 | 84.2 | globlastp |
| 8170 | LYD497_flaveria\|11v1\|SRR149229.253827_P1 | 14260 | 769 | 84.2 | globlastp |
| 8171 | LYD497_flaveria\|11v1\|SRR149241.10961_P1 | 14261 | 769 | 84.2 | globlastp |
| 8172 | LYD497_humulus\|11v1\|GD243562_P1 | 14262 | 769 | 84.2 | globlastp |
| 8173 | LYD497_humulus\|11v1\|GD248904_P1 | 14262 | 769 | 84.2 | globlastp |
| 8174 | LYD497_sunflower\|10v1\|CD850447 | 14263 | 769 | 84.2 | globlastp |
| 8175 | LYD497_cowpea\|gb166\|FC457354_P1 | 14264 | 769 | 84.2 | globlastp |
| 8176 | LYD497_cacao\|10v1\|CA794361_P1 | 14265 | 769 | 84.2 | globlastp |
| 8177 | LYD497_ginger\|gb164\|DY344964_P1 | 14266 | 769 | 84.2 | globlastp |
| 8178 | LYD497_euphorbia\|11v1\|BP961936_P1 | 14267 | 769 | 84.1 | globlastp |
| 8179 | LYD497_orobanche\|10v1\|SRR023189S0000546_P1 | 14268 | 769 | 84.1 | globlastp |
| 8180 | LYD497_lettuce\|10v1\|DW046397_P1 | 14269 | 769 | 84.1 | globlastp |
| 8181 | LYD497_ambrosia\|11v1\|SRR346935.120095_P1 | 14270 | 769 | 84.0 | globlastp |
| 8182 | LYD497_ambrosia\|11v1\|SRR346935.318001_P1 | 14271 | 769 | 84.0 | globlastp |
| 8183 | LYD497_chelidonium\|11v1\|SRR084752X100891_P1 | 14272 | 769 | 84.0 | globlastp |
| 8184 | LYD497_flaveria\|11v1\|SRR149232.105608_P1 | 14273 | 769 | 84.0 | globlastp |
| 8185 | LYD497_poppy\|gb166\|FE964493_P1 | 14274 | 769 | 84.0 | globlastp |
| 8186 | LYD497_sunflower\|10v1\|DY915953_P1 | 14275 | 769 | 84.0 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 8187 | LYD497 dandelion\|10v1\|DQ160025_P1 | 14276 | 769 | 84.0 | globlastp |
| 8188 | LYD497 triphysaria\|10v1\|DR171863_T1 | 14277 | 769 | 83.9 | glotblastn |
| 8189 | LYD497 bean\|gb167\|CA906109_P1 | 14278 | 769 | 83.9 | globlastp |
| 8190 | LYD497 castorbean\|11v1\|T15127_P1 | 14279 | 769 | 83.9 | globlastp |
| 8191 | LYD497 chestnut\|gb170\|SRR006296S0001007_P1 | 14280 | 769 | 83.9 | globlastp |
| 8192 | LYD497 cirsium\|11v1\|SRR346952.1075053_P1 | 14281 | 769 | 83.9 | globlastp |
| 8193 | LYD497 orange\|11v1\|BQ623197_P1 | 14282 | 769 | 83.9 | globlastp |
| 8194 | LYD497 phalaenopsis\|11v1\|CB032807_P1 | 14283 | 769 | 83.9 | globlastp |
| 8195 | LYD497 phalaenopsis\|11v1\|CB033750_P1 | 14283 | 769 | 83.9 | globlastp |
| 8196 | LYD497 citrus\|gb166\|BQ623197_P1 | 14282 | 769 | 83.9 | globlastp |
| 8197 | LYD497 sugarcane\|10v1\|BU102705 | 14284 | 769 | 83.8 | globlastp |
| 8198 | LYD497 ambrosia\|11v1\|SRR346949.115705_T1 | 14285 | 769 | 83.7 | glotblastn |
| 8199 | LYD497 arnica\|11v1\|SRR099034X100618_P1 | 14286 | 769 | 83.7 | globlastp |
| 8200 | LYD497 cirsium\|11v1\|SRR346952.107147_P1 | 14287 | 769 | 83.7 | globlastp |
| 8201 | LYD497 flax\|11v1\|CV478777_P1 | 14288 | 769 | 83.7 | globlastp |
| 8202 | LYD497 monkeyflower\|10v1\|DV206666_P1 | 14289 | 769 | 83.7 | globlastp |
| 8203 | LYD497 cotton\|10v2\|BG445245_P1 | 14290 | 769 | 83.7 | globlastp |
| 8204 | LYD497 clementine\|11v1\|BQ623197_P1 | 14291 | 769 | 83.6 | globlastp |
| 8205 | LYD497 tabernaemontana\|11v1\|SRR098689X101647_P1 | 14292 | 769 | 83.6 | globlastp |
| 8206 | LYD497 watermelon\|11v1\|AA660002_P1 | 14293 | 769 | 83.6 | globlastp |
| 8207 | LYD497 spurge\|gb161\|AF239932 | 14294 | 769 | 83.6 | globlastp |
| 8208 | LYD497 melon\|10v1\|DV632533_P1 | 14295 | 769 | 83.6 | globlastp |
| 8209 | LYD497 arnica\|11v1\|SRR099034X104887_P1 | 14296 | 769 | 83.5 | globlastp |
| 8210 | LYD497 foxtail_millet\|11v3\|EC612074_P1 | 14297 | 769 | 83.5 | globlastp |
| 8211 | LYD497 ginger\|gb164\|DY345527_P1 | 14298 | 769 | 83.5 | globlastp |
| 8212 | LYD497 solanum_phureja\|09v1\|SPHAF124139_P1 | 14299 | 769 | 83.5 | globlastp |
| 8213 | LYD497 artemisia\|10v1\|EY033510_P1 | 14300 | 769 | 83.5 | globlastp |
| 8214 | LYD497 brachypodium\|09v1\|DV468896_P1 | 14301 | 769 | 83.5 | globlastp |
| 8215 | LYD497 sorghum\|09v1\|SB01G013390 | 14302 | 769 | 83.5 | globlastp |
| 8216 | LYD497 sorghum\|11v1\|SB01G013390_P1 | 14302 | 769 | 83.5 | globlastp |
| 8217 | LYD497 banana\|10v1\|AY787796 | 14303 | 769 | 83.4 | glotblastn |
| 8218 | LYD497 aquilegia\|10v2\|DR916833_P1 | 14304 | 769 | 83.4 | globlastp |
| 8219 | LYD497 euphorbia\|11v1\|AF239932XX1_P1 | 14305 | 769 | 83.4 | globlastp |
| 8220 | LYD497 canola\|10v1\|CX193725 | 14306 | 769 | 83.4 | globlastp |
| 8221 | LYD497 canola\|11v1\|DV643263_P1 | 14307 | 769 | 83.4 | globlastp |
| 8222 | LYD497 coffea\|10v1\|DQ124000_P1 | 14308 | 769 | 83.4 | globlastp |
| 8223 | LYD497 coffea\|10v1\|DV663920_P1 | 14309 | 769 | 83.4 | globlastp |
| 8224 | LYD497 cannabis\|12v1\|GR221026_P1 | 14310 | 769 | 83.3 | globlastp |
| 8225 | LYD497 chickpea\|09v2\|EH058882_P1 | 14311 | 769 | 83.3 | globlastp |
| 8226 | LYD497 barley\|10v2\|BE420930_P1 | 14312 | 769 | 83.3 | globlastp |
| 8227 | LYD497 rice\|gb170\|OS03G44620T2 | 14313 | 769 | 83.3 | globlastp |
| 8228 | LYD497 maize\|10v1\|AI396449_P1 | 14314 | 769 | 83.3 | globlastp |
| 8229 | LYD497 ambrosia\|11v1\|SRR346943.197979_T1 | 14315 | 769 | 83.3 | glotblastn |
| 8230 | LYD497 phalaenopsis\|11v1\|CB032781_T1 | 14316 | 769 | 83.2 | glotblastn |
| 8231 | LYD497 triphysaria\|10v1\|DR172946_P1 | 14317 | 769 | 83.2 | globlastp |
| 8232 | LYD497 cotton\|10v2\|DT544369_P1 | 14318 | 769 | 83.2 | globlastp |
| 8233 | LYD497 poplar\|10v1\|BI071897_P1 | 14319 | 769 | 83.2 | globlastp |
| 8234 | LYD497 cotton\|10v2\|BF268155_P1 | 14320 | 769 | 83.2 | globlastp |
| 8235 | LYD497 cotton\|10v2\|SRR032368S0616524_P1 | 14321 | 769 | 83.2 | globlastp |
| 8236 | LYD497 platanus\|11v1\|SRR096786X113897_T1 | 14322 | 769 | 83.2 | glotblastn |
| 8237 | LYD497 walnuts\|gb166\|CB303856 | 14323 | 769 | 83.2 | glotblastn |
| 8238 | LYD497 maize\|10v1\|W21742_P1 | 14324 | 769 | 83.1 | globlastp |
| 8239 | LYD497 millet\|10v1\|CD724871_P1 | 14325 | 769 | 83.1 | globlastp |
| 8240 | LYD497 apple\|11v1\|CN492813_P1 | 14326 | 769 | 83.0 | globlastp |
| 8241 | LYD497 catharanthus\|11v1\|EG557170_P1 | 14327 | 769 | 83.0 | globlastp |
| 8242 | LYD497 cirsium\|11v1\|SRR346952.1000189_P1 | 14328 | 769 | 83.0 | globlastp |
| 8243 | LYD497 cirsium\|11v1\|SRR346952.108403_P1 | 14329 | 769 | 83.0 | globlastp |
| 8244 | LYD497 curcuma\|10v1\|DY385577_P1 | 14330 | 769 | 83.0 | globlastp |
| 8245 | LYD497 eucalyptus\|11v2\|CB967867_P1 | 14331 | 769 | 83.0 | globlastp |
| 8246 | LYD497 sugarcane\|10v1\|AA842770_P1 | 14332 | 769 | 83.0 | globlastp |
| 8247 | LYD497 tomato\|11v1\|NTU64913_P1 | 14333 | 769 | 83.0 | globlastp |
| 8248 | LYD497 poplar\|10v1\|AI166364_P1 | 14334 | 769 | 83.0 | globlastp |
| 8249 | LYD497 pepper\|gb171\|AF109656_P1 | 14335 | 769 | 83.0 | globlastp |
| 8250 | LYD497 cucurbita\|11v1\|SRR091276X100595XX1_T1 | 14336 | 769 | 82.9 | glotblastn |
| 8251 | LYD497 apple\|11v1\|CN497067_P1 | 14337 | 769 | 82.9 | globlastp |
| 8252 | LYD497 tobacco\|gb162\|AF154638_P1 | 14338 | 769 | 82.9 | globlastp |
| 8253 | LYD497 wheat\|10v2\|BF199715 | 14339 | 769 | 82.9 | globlastp |
| 8254 | LYD497 wheat\|10v2\|CA649147 | 14340 | 769 | 82.8 | glotblastn |
| 8255 | LYD497 kiwi\|gb166\|FG399461_P1 | 14341 | 769 | 82.8 | globlastp |
| 8256 | LYD497 poplar\|10v1\|AI164534_P1 | 14342 | 769 | 82.8 | globlastp |
| 8257 | LYD497 cynara\|gb167\|GE582183_T1 | 14343 | 769 | 82.7 | glotblastn |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 8258 | LYD497 sorghum\|11v1\|SB01G005860_P1 | 14344 | 769 | 82.7 | globlastp |
| 8259 | LYD497 tobacco\|gb162\|NTU64913_P1 | 14345 | 769 | 82.7 | globlastp |
| 8260 | LYD497 cacao\|10v1\|CU539774_P1 | 14346 | 769 | 82.7 | globlastp |
| 8261 | LYD497 castorbean\|09v1\|XM002515819 | 14347 | 769 | 82.7 | globlastp |
| 8262 | LYD497 castorbean\|11v1\|XM_002515819_P1 | 14347 | 769 | 82.7 | globlastp |
| 8263 | LYD497 switchgrass\|gb167\|DN143211_P1 | 14348 | 769 | 82.6 | globlastp |
| 8264 | LYD497 valeriana\|11v1\|SRR099039X101240_P1 | 14349 | 769 | 82.6 | globlastp |
| 8265 | LYD497 safflower\|gb162\|EL378154_T1 | 14350 | 769 | 82.5 | glotblastn |
| 8266 | LYD497 cassava\|09v1\|JGICASSAVA35716VALIDM1_P1 | 14351 | 769 | 82.5 | globlastp |
| 8267 | LYD497 curcuma\|10v1\|DY382981_P1 | 14352 | 769 | 82.5 | globlastp |
| 8268 | LYD497 foxtail_millet\|11v3\|PHY7SI035864M_P1 | 14353 | 769 | 82.5 | globlastp |
| 8269 | LYD497 maize\|10v1\|AW330975_P1 | 14354 | 769 | 82.5 | globlastp |
| 8270 | LYD497 maize\|10v1\|T12693_P1 | 14355 | 769 | 82.5 | globlastp |
| 8271 | LYD497 momordica\|10v1\|SRR071315S0005921_P1 | 14356 | 769 | 82.5 | globlastp |
| 8272 | LYD497 tomato\|11v1\|BG123571_P1 | 14357 | 769 | 82.5 | globlastp |
| 8273 | LYD497 hevea\|10v1\|AF085275_T1 | 14358 | 769 | 82.5 | glotblastn |
| 8274 | LYD497 oat\|11v1\|GO583965_P1 | 14359 | 769 | 82.4 | globlastp |
| 8275 | LYD497 switchgrass\|gb167\|DN141212_P1 | 14360 | 769 | 82.4 | globlastp |
| 8276 | LYD497 valeriana\|11v1\|SRR099039X105175_P1 | 14361 | 769 | 82.4 | globlastp |
| 8277 | LYD497 cichorium\|gb171\|EH678387_P1 | 14362 | 769 | 82.4 | globlastp |
| 8278 | LYD497 euonymus\|11v1\|SRR070038X100823_P1 | 14363 | 769 | 82.3 | globlastp |
| 8279 | LYD497 euonymus\|11v1\|SRR070038X101498_P1 | 14364 | 769 | 82.3 | globlastp |
| 8280 | LYD497 euonymus\|11v1\|SRR070038X10587_P1 | 14365 | 769 | 82.3 | globlastp |
| 8281 | LYD497 kiwi\|gb166\|FG397142_P1 | 14366 | 769 | 82.3 | globlastp |
| 8282 | LYD497 switchgrass\|gb167\|DN140950_P1 | 14367 | 769 | 82.3 | globlastp |
| 8283 | LYD497 switchgrass\|gb167\|DN144182_P1 | 14368 | 769 | 82.3 | globlastp |
| 8284 | LYD497 vinca\|11v1\|SRR098690X100192_P1 | 14369 | 769 | 82.3 | globlastp |
| 8285 | LYD497 vinca\|11v1\|SRR098690X101903_P1 | 14370 | 769 | 82.3 | globlastp |
| 8286 | LYD497 strawberry\|11v1\|CX661998 | 14371 | 769 | 82.3 | globlastp |
| 8287 | LYD497 amsonia\|11v1\|SRR098688X102635_P1 | 14372 | 769 | 82.2 | globlastp |
| 8288 | LYD497 euphorbia\|11v1\|BG317325_P1 | 14373 | 769 | 82.2 | globlastp |
| 8289 | LYD497 tobacco\|gb162\|NTU64914_P1 | 14374 | 769 | 82.1 | globlastp |
| 8290 | LYD497 ginger\|gb164\|DY346824_P1 | 14375 | 769 | 82.0 | globlastp |
| 8291 | LYD497 rice\|gb170\|OS03G57340_P1 | 14376 | 769 | 82.0 | globlastp |
| 8292 | LYD497 plantago\|11v1\|SRR066373X112159_P1 | 14377 | 769 | 81.9 | globlastp |
| 8293 | LYD497 amorphophallus\|11v2\|SRR089351X120182_P1 | 14378 | 769 | 81.8 | globlastp |
| 8294 | LYD497 centaurea\|gb166\|EH729094_P1 | 14379 | 769 | 81.8 | globlastp |
| 8295 | LYD497 ipomoea_batatas\|10v1\|BM878746_P1 | 14380 | 769 | 81.8 | globlastp |
| 8296 | LYD497 kiwi\|gb166\|FG404353_P1 | 14381 | 769 | 81.8 | globlastp |
| 8297 | LYD497 kiwi\|gb166\|FG405243_P1 | 14382 | 769 | 81.8 | globlastp |
| 8298 | LYD497 kiwi\|gb166\|FG425469_P1 | 14383 | 769 | 81.8 | globlastp |
| 8299 | LYD497 solanum_phureja\|09v1\|SPHBG123571_P1 | 14384 | 769 | 81.8 | globlastp |
| 8300 | LYD497 oat\|11v1\|GR313436_P1 | 14385 | 769 | 81.7 | globlastp |
| 8301 | LYD497 oat\|11v1\|GR319459_P1 | 14385 | 769 | 81.7 | globlastp |
| 8302 | LYD497 cassava\|09v1\|DV443541_P1 | 14386 | 769 | 81.6 | globlastp |
| 8303 | LYD497 phalaenopsis\|11v1\|CK857679XX1_P1 | 14387 | 769 | 81.6 | globlastp |
| 8304 | LYD497 phalaenopsis\|11v1\|SRR125771.1028274_P1 | 14387 | 769 | 81.6 | globlastp |
| 8305 | LYD497 phyla\|11v2\|SRR099035X100969_P1 | 14388 | 769 | 81.6 | globlastp |
| 8306 | LYD497 tripterygium\|11v1\|SRR098677X120361_P1 | 14389 | 769 | 81.6 | globlastp |
| 8307 | LYD497 radish\|gb164\|EX766230 | 14390 | 769 | 81.6 | globlastp |
| 8308 | LYD497 tripterygium\|11v1\|SRR098677X100943_T1 | 14391 | 769 | 81.6 | glotblastn |
| 8309 | LYD497 oat\|11v1\|CN180781_P1 | 14392 | 769 | 81.5 | globlastp |
| 8310 | LYD497 brachypodium\|09v1\|DV474532_P1 | 14393 | 769 | 81.4 | globlastp |
| 8311 | LYD497 pepper\|gb171\|BM063592_P1 | 14394 | 769 | 81.3 | globlastp |
| 8312 | LYD497 phalaenopsis\|11v1\|SRR125771.1004730_P1 | 14395 | 769 | 81.3 | globlastp |
| 8313 | LYD497 oil_palm\|gb166\|CN600037_T1 | 14396 | 769 | 81.3 | glotblastn |
| 8314 | LYD497 beet\|gb162\|BI543703_T1 | 14397 | 769 | 81.1 | glotblastn |
| 8315 | LYD497 platanus\|11v1\|SRR096786X117453_T1 | 14398 | 769 | 81.1 | glotblastn |
| 8316 | LYD497 cenchrus\|gb166\|EB654693_P1 | 14399 | 769 | 81.1 | globlastp |
| 8317 | LYD497 silene\|11v1\|SRR096785X135277_P1 | 14400 | 769 | 81.1 | globlastp |
| 8318 | LYD497 strawberry\|11v1\|SRR034859S0002902_P1 | 14401 | 769 | 81.1 | globlastp |
| 8319 | LYD497 vinca\|11v1\|SRR098690X126485_P1 | 14402 | 769 | 81.1 | globlastp |
| 8320 | LYD497 aquilegia\|10v2\|JGIAC004636_P1 | 14403 | 769 | 81.0 | globlastp |
| 8321 | LYD497 flaveria\|11v1\|SRR149229.55441_T1 | 14404 | 769 | 81.0 | glotblastn |
| 8322 | LYD497 flaveria\|11v1\|SRR149229.112420_P1 | 14405 | 769 | 80.9 | globlastp |
| 8323 | LYD497 amorphophallus\|11v2\|SRR089351X110673_T1 | 14406 | 769 | 80.8 | glotblastn |
| 8324 | LYD497 oil_palm\|gb166\|CN601428_T1 | 14407 | 769 | 80.8 | glotblastn |
| 8325 | LYD497 pseudoroegneria\|gb167\|FF347829_P1 | 14408 | 769 | 80.8 | globlastp |
| 8326 | LYD497 leymus\|gb166\|EG374967_P1 | 14409 | 769 | 80.7 | globlastp |
| 8327 | LYD497 strawberry\|11v1\|CO379354_P1 | 14410 | 769 | 80.7 | globlastp |
| 8328 | LYD497 triphysaria\|10v1\|DR174399_P1 | 14411 | 769 | 80.7 | globlastp |

TABLE 54-continued

Homologous polynucleotides and polypeptides which can increase plant yield, seed yield, oil yield, oil content, growth rate, fiber yield, fiber quality, biomass, vigor, ABST and/or NUE of a plant

| Polyn. SEQ ID NO: | Hom to Gene Name cluster name | Polyp. SEQ ID NO: | Hom to SEQ ID NO: | % glob. iden. | Algor. |
|---|---|---|---|---|---|
| 8329 | LYD497 flaveria\|11v1\|SRR149239.91886_P1 | 14412 | 769 | 80.6 | globlastp |
| 8330 | LYD497 cleome_gynandra\|10v1\|SRR015532S0000008_P1 | 14413 | 769 | 80.6 | globlastp |
| 8331 | LYD497 plantago\|11v1\|SRR066373X105105_P1 | 14414 | 769 | 80.5 | globlastp |
| 8332 | LYD497 wheat\|10v2\|BE412082XX1_P1 | 14415 | 769 | 80.5 | globlastp |
| 8333 | LYD497 wheat\|10v2\|BT008914_P1 | 14415 | 769 | 80.5 | globlastp |
| 8334 | LYD497 pseudotsuga\|10v1\|SRR065119S0005084_P1 | 14416 | 769 | 80.4 | globlastp |
| 8335 | LYD497 barley\|10v2\|BE413088_P1 | 14417 | 769 | 80.3 | globlastp |
| 8336 | LYD497 ambrosia\|11v1\|SRR346935.150833_T1 | 14418 | 769 | 80.2 | glotblastn |
| 8337 | LYD497 cirsium\|11v1\|SRR346952.1046865_P1 | 14419 | 769 | 80.2 | globlastp |
| 8338 | LYD497 onion\|gb162\|CF439090_T1 | 14420 | 769 | 80.1 | glotblastn |
| 8339 | LYD497 triphysaria\|10v1\|BM356522_P1 | 14421 | 769 | 80.1 | globlastp |
| 8340 | LYD497 momordica\|10v1\|EC612074_P1 | 14422 | 769 | 80.0 | globlastp |
| 8341 | LYD501 arabidopsis_lyrata\|09v1\|JGIAL000625_P1 | 14423 | 770 | 85.8 | globlastp |
| 8342 | LYD501 arabidopsis\|10v1\|AT1G06700_P1 | 14424 | 770 | 85.8 | globlastp |
| 8343 | LYD501 thellungiella_halophilum\|11v1\|EHJGI11008939_P1 | 14425 | 770 | 84.3 | globlastp |
| 8344 | LYD501 thellungiella_parvulum\|11v1\|DN774235_P1 | 14426 | 770 | 84.1 | globlastp |
| 8345 | LYD501 canola\|11v1\|SRR019556.16525_P1 | 14427 | 770 | 83.2 | globlastp |
| 8346 | LYD501 b_rapa\|gb162\|DQ006921_P1 | 14428 | 770 | 82.9 | globlastp |
| 8347 | LYD501 canola\|11v1\|CN730195_P1 | 14429 | 770 | 82.4 | globlastp |
| 8348 | LYD501 canola\|11v1\|EE434918_P1 | 14430 | 770 | 82.2 | globlastp |
| 8349 | LYD501 apple\|11v1\|CN494165_P1 | 14431 | 770 | 81.9 | globlastp |
| 8350 | LYD501 canola\|11v1\|ES963949_P1 | 14432 | 770 | 81.5 | globlastp |
| 8351 | LYD501 canola\|10v1\|DY012432 | 14432 | 770 | 81.5 | globlastp |
| 8352 | LYD501 apple\|gb171\|CO756295 | 14433 | 770 | 81.4 | globlastp |
| 8353 | LYD501 medicago\|09v1\|AW698435_P1 | 14434 | 770 | 80.5 | globlastp |
| 8354 | LYD501 soybean\|11v1\|GLYMA20G38980 | 14435 | 770 | 80.4 | globlastp |
| 8355 | LYD501 cowpea\|gb166\|FF394501_P1 | 14436 | 770 | 80.3 | globlastp |
| 8356 | LYD501 soybean\|11v1\|GLYMA10G44210 | 14437 | 770 | 80.3 | globlastp |
| 8357 | LYD501 strawberry\|11v1\|CO817130 | 14438 | 770 | 80.3 | globlastp |
| 8358 | LYD501 bean\|gb167\|CA898779_P1 | 14439 | 770 | 80.0 | globlastp |
| 8359 | LYD501 lotus\|09v1\|LLAW720407_P1 | 14440 | 770 | 80.0 | globlastp |
| 8360 | LYD502 cacao\|10v1\|CU494553_P1 | 14441 | 771 | 93.4 | globlastp |
| 8361 | LYD502 cassava\|09v1\|CK645954_P1 | 14442 | 771 | 89.7 | globlastp |
| 8362 | LYD502 cassava\|09v1\|JGICASSAVA3004M1_P1 | 14443 | 771 | 89.7 | globlastp |
| 8363 | LYD502 beech\|gb170\|AM231807_P1 | 14444 | 771 | 88.8 | globlastp |
| 8364 | LYD502 cotton\|10v2\|DW227150_P1 | 14445 | 771 | 87.7 | globlastp |
| 8365 | LYD502 cotton\|10v2\|SRR032367S0000521_P1 | 14445 | 771 | 87.7 | globlastp |
| 8366 | LYD502 nasturtium\|10v1\|SRR032558S0166768 | 14446 | 771 | 87.7 | globlastp |
| 8367 | LYD502 sarracenia\|11v1\|SRR192669.107015_P1 | 14447 | 771 | 86.0 | globlastp |
| 8368 | LYD502 poplar\|10v1\|AI163956_P1 | 14448 | 771 | 86.0 | globlastp |
| 8369 | LYD502 chestnut\|gb170\|SRR006295S0000431_P1 | 14449 | 771 | 85.3 | globlastp |
| 8370 | LYD502 oak\|10v1\|FP033074_P1 | 14449 | 771 | 85.3 | globlastp |
| 8371 | LYD502 cowpea\|gb166\|FF387500_P1 | 14450 | 771 | 84.1 | globlastp |
| 8372 | LYD502 lotus\|09v1\|GO031558_P1 | 14451 | 771 | 84.1 | globlastp |
| 8373 | LYD502 nasturtium\|10v1\|SRR032558S0032412 | 14452 | 771 | 84.0 | globlastp |
| 8374 | LYD502 strawberry\|11v1\|DV438041 | 14453 | 771 | 84.0 | globlastp |
| 8375 | LYD502 grape\|11v1\|GSVIVT01020366001_T1 | 14454 | 771 | 83.0 | glotblastn |
| 8376 | LYD502 peanut\|10v1\|ES720111_P1 | 14455 | 771 | 82.6 | globlastp |
| 8377 | LYD502 bean\|gb167\|CA910369_P1 | 14456 | 771 | 82.2 | globlastp |
| 8378 | LYD502 apple\|11v1\|CN494841_P1 | 14457 | 771 | 82.1 | globlastp |
| 8379 | LYD502 apple\|gb171\|CN494841 | 14457 | 771 | 82.1 | globlastp |
| 8380 | LYD502 rose\|10v1\|BQ104024 | 14458 | 771 | 81.5 | globlastp |
| 8381 | LYD502 pigeonpea\|10v1\|SRR054580S0088396_T1 | 14459 | 771 | 81.3 | glotblastn |
| 8382 | LYD502 soybean\|11v1\|GLYMA18G49400 | 14460 | 771 | 81.3 | globlastp |
| 8383 | LYD502 kiwi\|gb166\|FG407436_T1 | 14461 | 771 | 81.1 | glotblastn |
| 8384 | LYD502 cowpea\|gb166\|FF388339_P1 | 14462 | 771 | 81.1 | globlastp |

Table 54: Provided are polynucleotides (Polyn.) and polypeptides (Polyp.) which are homologous to the identified polynucleotides or polypeptides of Table 53. Hom. = homologue; "glob." = global; "Iden." = identical; Algor. = Algorithm;

Example 14

Gene Cloning and Generation of Binary Vectors for Plant Expression

To validate their role in improving oil content, plant yield, seed yield, oil content, biomass, growth rate, fiber yield, fiber quality, ABST, NUE and/or vigor, selected genes were over-expressed in plants, as follows.

Cloning Strategy

Selected genes from those listed in Examples 12 and 13 hereinabove were cloned into binary vectors for the generation of transgenic plants. For cloning, the full-length open reading frame (ORF) was first identified. In case of ORF-EST clusters and in some cases already published mRNA sequences were analyzed to identify the entire open reading frame by comparing the results of several translation algorithms to known proteins from other plant species. To clone the full-length cDNAs, reverse transcription (RT) followed by polymerase chain reaction (PCR; RT-PCR) was performed on total RNA extracted from leaves, flowers, siliques or other plant tissues, growing under normal and different treated conditions. Total RNA was extracted as described in "GENERAL EXPERIMENTAL AND BIOINFORMATICS METHODS" above. Production of cDNA and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.) which are well known to those skilled in the art. PCR products are purified using PCR purification kit (Qiagen). In case where the entire coding sequence was not found, RACE kit from Invitrogen (RACE=Rapid A mplification of cDNA E nds) was used to access the full cDNA transcript of the gene from the RNA samples described above. RACE products were cloned into high copy vector followed by sequencing or directly sequenced.

The information from the RACE procedure was used for cloning of the full length ORF of the corresponding genes.

In case genomic DNA is cloned, the genes were amplified by direct PCR on genomic DNA extracted from leaf tissue using the DNAeasy kit (Qiagen Cat. No. 69104).

Usually, 2 sets of primers were synthesized for the amplification of each gene from a cDNA or a genomic sequence; an external set of primers and an internal set (nested PCR primers). When needed (e.g., when the first PCR reaction does not result in a satisfactory product for sequencing), an additional primer (or two) of the nested PCR primers was used.

To facilitate cloning of the cDNAs/genomic sequences, a 8-12 bp extension was added to the 5' of each primer. The primer extension includes an endonuclease restriction site. The restriction sites were selected using two parameters: (a). The site does not exist in the cDNA sequence; and (b). The restriction sites in the forward and reverse primers are designed such that the digested cDNA is inserted in the sense formation into the binary vector utilized for transformation.

Each digested PCR product was inserted into a high copy vector pUC19 (New England BioLabs Inc], or into plasmids originating from this vector. In some cases the undigested PCR product was inserted into pCR-Blunt II-TOPO (Invitrogen).

Sequencing of the amplified PCR products was performed, using ABI 377 sequencer (Amersham Biosciences Inc). In some cases, after confirming the sequences of the cloned genes, the cloned cDNA was introduced into a modified pGI binary vector containing the At6669 promoter via digestion with appropriate restriction endonucleases. In any case the insert was followed by single copy of the NOS terminator (SEQ ID NO: 14481). The digested products and the linearized plasmid vector were ligated using T4 DNA ligase enzyme (Roche, Switzerland).

High copy plasmids containing the cloned genes were digested with the restriction endonucleases (New England BioLabs Inc) according to the sites designed in the primers and cloned into binary vectors.

Several DNA sequences of the selected genes were synthesized by a commercial supplier GeneArt [Hypertext Transfer Protocol://World Wide Web (dot) geneart (dot) com/]. Synthetic DNA was designed in silico. Suitable restriction enzymes sites were added to the cloned sequences at the 5' end and at the 3' end to enable later cloning into the pQFNc binary vector downstream of the At6669 promoter (SEQ ID NO: 14467).

Binary vectors used for cloning: The plasmid pPI was constructed by inserting a synthetic poly-(A) signal sequence, originating from pGL3 basic plasmid vector (Promega, Acc No U47295; by 4658-4811) into the HindIII restriction site of the binary vector pBI101.3 (Clontech, Acc. No. U12640). pGI (pBXYN) is similar to pPI, but the original gene in the backbone, the GUS gene, is replaced by the GUS-Intron gene followed by the NOS terminator (SEQ ID NO: 14481) (Vancanneyt. G, et at MGG 220, 245-50, 1990). pGI was used in the past to clone the polynucleotide sequences, initially under the control of 35S promoter [Odell, J T, et al. Nature 313, 810-812 (28 Feb. 1985); SEQ ID NO: 14465].

Figure 2:
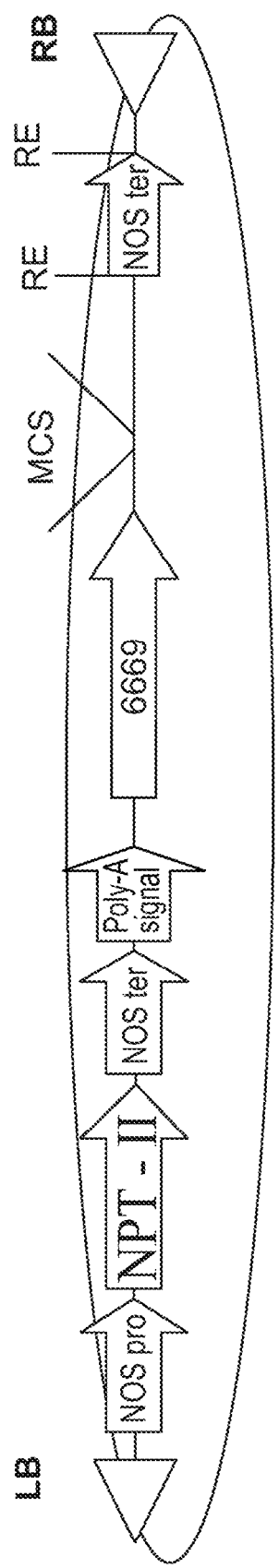
FIG. 2 is a schematic illustration of the modified pGI binary plasmid containing the new At6669 promoter (SEQ ID NO: 14467) (pQFN or pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); The isolated polynucleotide sequences of the invention were cloned into the MCS of the vector.
Figure 4:
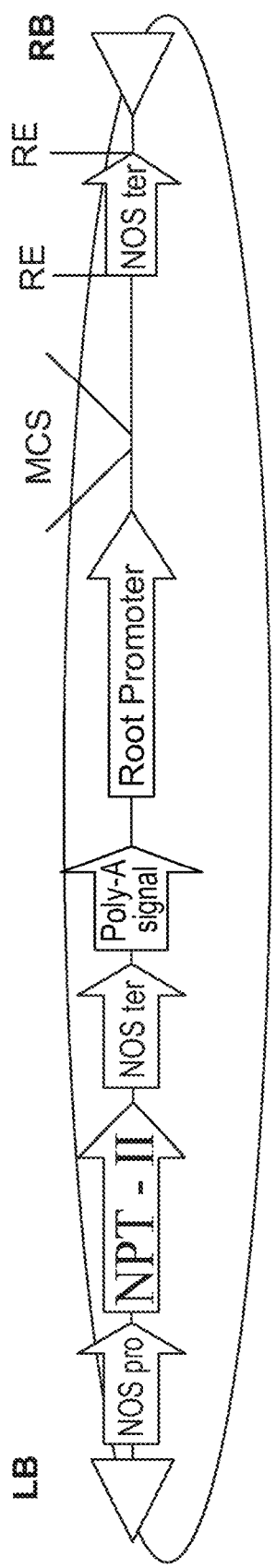
FIG. 4 is a schematic illustration of the modified pGI binary plasmid containing the Root Promoter (pQNa RP) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); The isolated polynucleotide sequences according to some embodiments of the invention were cloned into the MCS (Multiple cloning site) of the vector.
Figure 5:
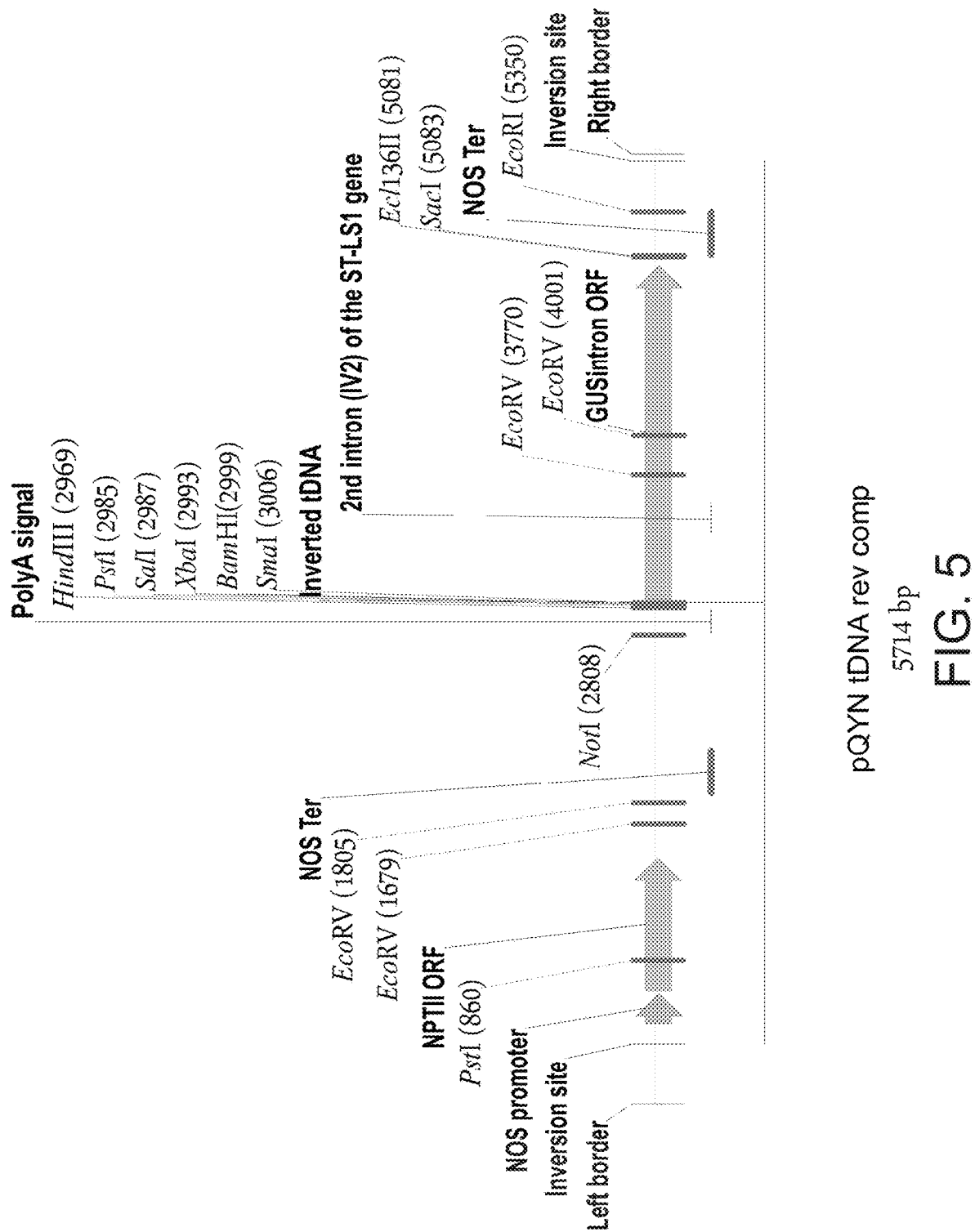
FIG. 5 is a schematic illustration of the pQYN plasmid.
Figure 6:
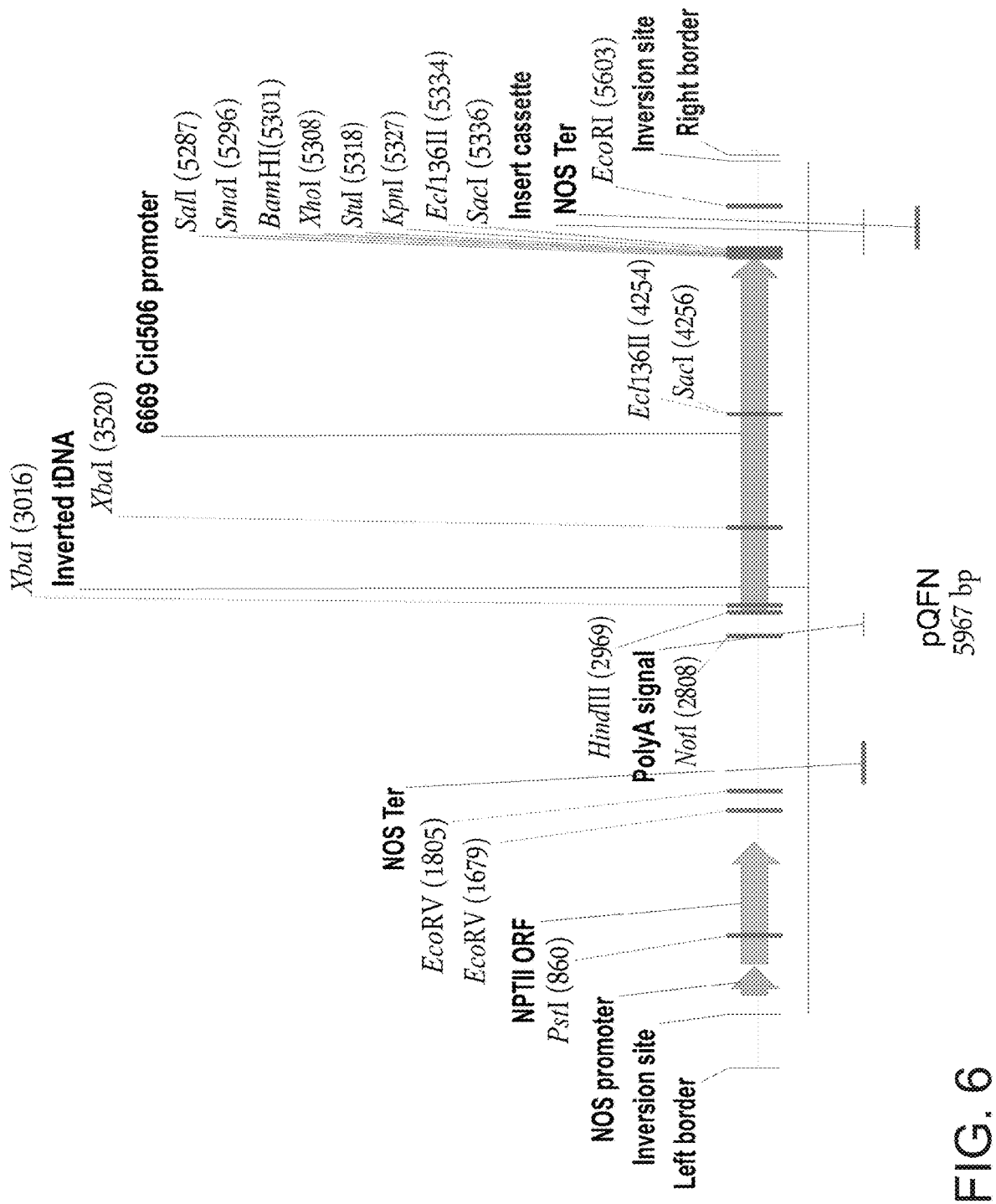
FIG. 6 is a schematic illustration of the pQFN plasmid.
Figure 7:
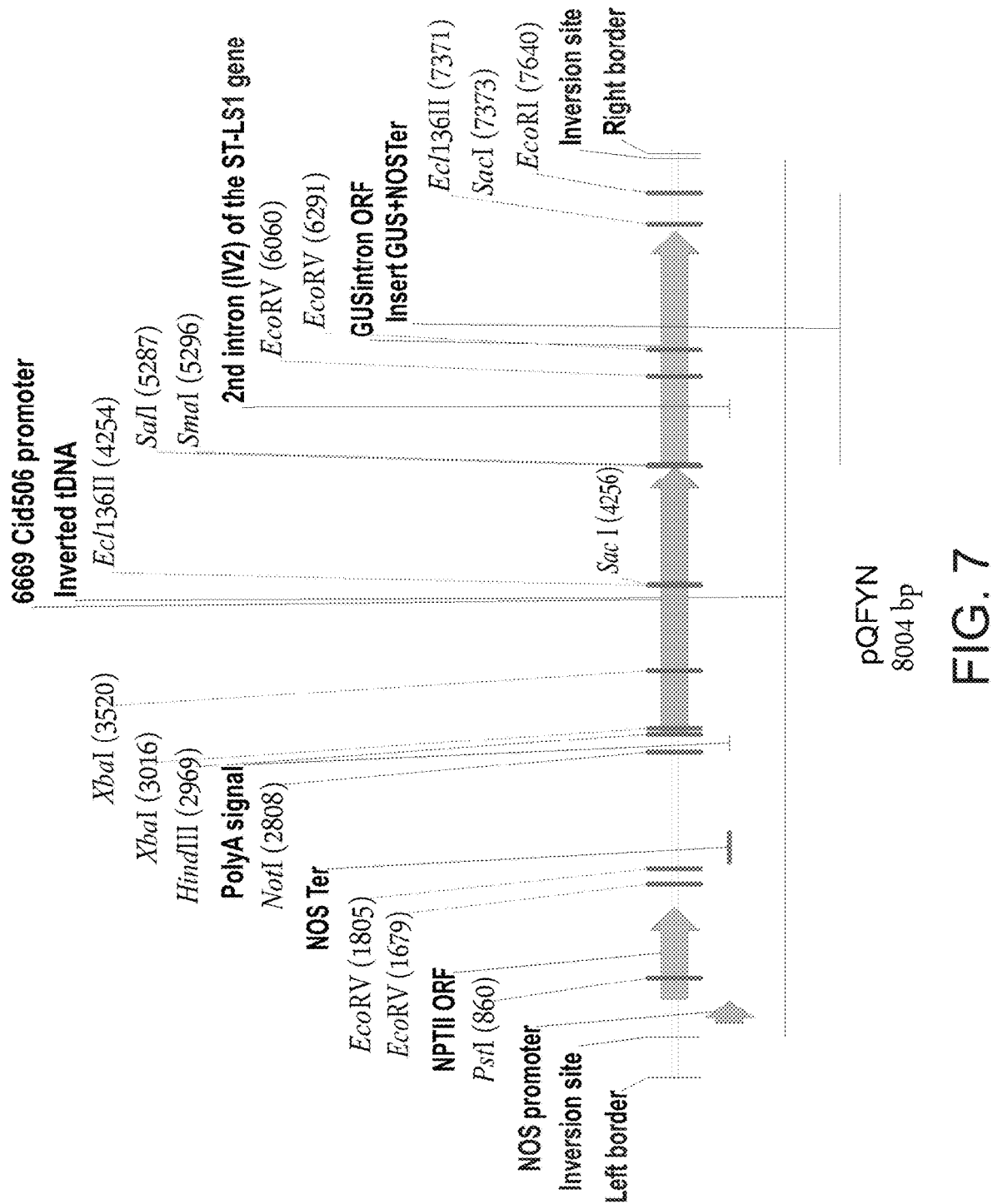
FIG. 7 is a schematic illustration of the pQFYN plasmid.
Figure 8:
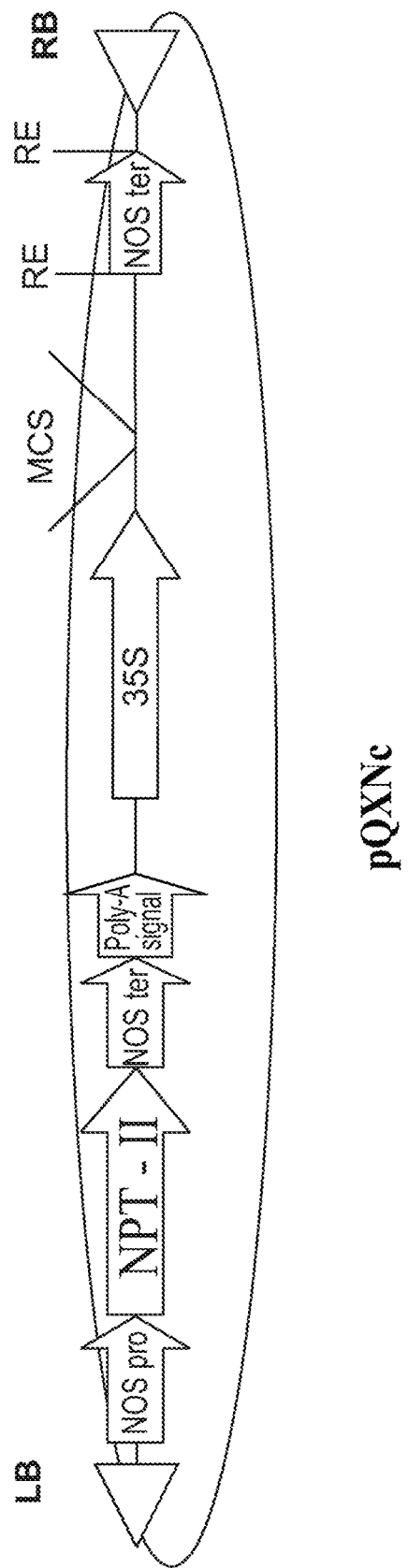
FIG. 8 is a schematic illustration of the modified pGI binary plasmid (pQXNc) used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (SEQ ID NO: 14463). The isolated polynucleotide sequences of some embodiments of the invention were cloned into the MCS (Multiple cloning site) of the vector.

The modified pGI vectors [pQXNc (FIG. 8); or pQFN (FIG. 2), pQFNc (FIG. 2) or pQYN 6669 (FIG. 1)] are modified versions of the pGI vector in which the cassette is inverted between the left and right borders so the gene and its corresponding promoter are close to the right border and the NPTII gene is close to the left border.

At6669, the *Arabidopsis thaliana* promoter sequence (SEQ ID NO:14467) was inserted in the modified pGI binary vector, upstream to the cloned genes, followed by DNA ligation and binary plasmid extraction from positive *E. coli* colonies, as described above.

Colonies were analyzed by PCR using the primers covering the insert which are designed to span the introduced promoter and gene. Positive plasmids were identified, isolated and sequenced.

Selected genes cloned by the present inventors are provided in Table 55 below.

TABLE 55

Genes cloned in High copy number plasmids

| Gene Name | High copy plasmid | Organism | Primers used SEQ ID NOs: | Polyn. SEQ ID NO: | Polyp. SEQ ID NO: |
| --- | --- | --- | --- | --- | --- |
| LYD289 | pUC19c_LYD289 | Arabidopsis thalia | 14482, 14670, 14482, 14670 | 259 | 456 |
| LYD290 | pUC19c_LYD290 | Arabidopsis thalia | 14483, 14671 | 260 | 457 |
| LYD291 | pUC19c_LYD291 | Arabidopsis thalia | 14484, 14672 | 261 | 458 |
| LYD292 | pUC19c_LYD292 | Arabidopsis thalia | 14485, 14673, 14858, 14955 | 262 | 459 |
| LYD293 | pUC19c_LYD293 | Arabidopsis thalia | 14486, 14674, 14859, 14956 | 263 | 460 |
| LYD294 | pUC19c_LYD294 | Arabidopsis thalia | 14487, 14675, 14860, 14957 | 264 | 461 |
| LYD295 | pUC19c_LYD295 | Arabidopsis thalia | 14488, 14676, 14488, 14676 | 265 | 462 |
| LYD296 | pUC19c_LYD296 | Arabidopsis thalia | 14489, 14677, 14861, 14958 | 266 | 463 |
| LYD297 | pUC19c_LYD297 | Arabidopsis thalia | 14490, 14678, 14862, 14678 | 267 | 703 |
| LYD298 | pUC19c_LYD298 | Arabidopsis thalia | 14491, 14679, 14863, 14959 | 268 | 465 |
| LYD299 | pMA_LYD299_GA | | GeneArt | 269 | 466 |
| LYD300 | pOA_LYD300_GA | | GeneArt | 270 | 467 |
| LYD301 | pUC19d_LYD301 | Arabidopsis thalia | 14492, 14680, 14864, 14960 | 271 | 468 |
| LYD302 | pUC19c_LYD302 | Arabidopsis thalia | 14493, 14681, 14493, 14961 | 272 | 469 |

TABLE 55-continued

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LYD303 | pUC19c_LYD303 | Arabidopsis thalia | 14494, 14682, 14865, 14962 | 273 | 470 |
| LYD304 | pUC19c_LYD304 | Arabidopsis thalia | 14495, 14683, 14495, 14683 | 274 | 471 |
| LYD305 | pUC19c_LYD305 | Arabidopsis thalia | 14496, 14684, 14866, 14963 | 275 | 472 |
| LYD306 | pUC19c_LYD306 | Arabidopsis thalia | 14497, 14685 | 276 | 704 |
| LYD307 | pUC19c_LYD307 | Arabidopsis thalia | 14498, 14686, 14867, 14964 | 277 | 474 |
| LYD308 | pUC19c_LYD308 | Arabidopsis thalia | 14499, 14687, 14868, 14965 | 278 | 705 |
| LYD309 | pUC19c_LYD309 | Arabidopsis thalia | 14500, 14688, 14500, 14966 | 279 | 476 |
| LYD310 | pUC19c_LYD310 | Arabidopsis thalia | 14501, 14689, 14501, 14689 | 280 | 706 |
| LYD311 | pUC19c_LYD311 | Arabidopsis thalia | 14502, 14690, 14502, 14690 | 281 | 478 |
| LYD312 | pUC19c_LYD312 | Arabidopsis thalia | 14503, 14691, 14503, 14691 | 282 | 479 |
| LYD313 | pUC19c_LYD313 | Arabidopsis thalia | 14504, 14692, 14504, 14692 | 283 | 480 |
| LYD315 | pUC19c_LYD315 | Arabidopsis thalia | 14505, 14693, 14869, 14967 | 284 | 707 |
| LYD316 | pUC19c_LYD316 | Arabidopsis thalia | 14506, 14694, 14506, 14694 | 285 | 482 |
| LYD318 | pUC19c_LYD318 | Arabidopsis thalia | 14507, 14695, 14870, 14968 | 286 | 483 |
| LYD319 | pUC19c_LYD319 | Arabidopsis thalia | 14508, 14696, 14871, 14696 | 287 | 484 |
| LYD320 | pUC19c_LYD320 | Arabidopsis thalia | 14509, 14697, 14872, 14969 | 288 | 485 |
| LYD321 | pUC19c_LYD321 | Arabidopsis thalia | 14510, 14698, 14873, 14970 | 289 | 486 |
| LYD322 | pUC19c_LYD322 | Arabidopsis thalia | 14511, 14699, 14874, 14971 | 290 | 487 |
| LYD323 | pUC19c_LYD323 | Arabidopsis thalia | 14512, 14700, 14875, 14972 | 291 | 488 |
| LYD324 | pUC19c_LYD324 | Arabidopsis thalia | 14513, 14701 | 292 | 489 |
| LYD325 | pUC19c_LYD325 | Arabidopsis thalia | 14514, 14702, 14514, 14702 | 293 | 490 |
| LYD326 | pUC19c_LYD326 | Arabidopsis thalia | 14515, 14703 | 294 | 491 |
| LYD327 | TopoB_LYD327 | Arabidopsis thalia | 14516, 14704, 14877, 14974 | 295 | 492 |
| LYD328 | pUC19c_LYD328 | Arabidopsis thalia | 14517, 14705, 14878, 14975 | 296 | 493 |
| LYD329 | pUC19c_LYD329 | Arabidopsis thalia | 14518, 14706, 14879, 14976 | 297 | 494 |
| LYD330 | pUC19c_LYD330 | Arabidopsis thalia | 14519, 14707, 14880, 14977 | 298 | 495 |
| LYD331 | pUC19c_LYD331 | Arabidopsis thalia | 14520, 14708, 14881, 14978 | 299 | 496 |
| LYD332 | pUC19c_LYD332 | Arabidopsis thalia | 14521, 14709, 14882, 14979 | 300 | 497 |
| LYD334 | pUC19c_LYD334 | Arabidopsis thalia | 14522, 14710, 14522, 14980 | 301 | 498 |
| LYD335 | pUC19c_LYD335 | Arabidopsis thalia | 14523, 14711, 14883, 14981 | 302 | 499 |
| LYD337 | pUC19c_LYD337 | Arabidopsis thalia | 14524, 14712 | 303 | 500 |
| LYD338 | pUC19c_LYD338 | Arabidopsis thalia | 14525, 14713, 14525, 14982 | 304 | 501 |
| LYD339 | pUC19c_LYD339 | Arabidopsis thalia | 14526, 14714, 14884, 14983 | 305 | 502 |
| LYD340 | pUC19c_LYD340 | Arabidopsis thalia | 14527, 14715, 14527, 14715 | 306 | 503 |
| LYD341 | pUC19c_LYD341 | Arabidopsis thalia | 14528, 14716, 14885, 14984 | 307 | 504 |
| LYD342 | pUC19c_LYD342 | Arabidopsis thalia | 14529, 14717, 14886, 14985 | 308 | 505 |
| LYD343 | pUC19c_LYD343 | Arabidopsis thalia | 14530, 14718, 14887, 14986 | 309 | 506 |
| LYD344 | pUC19c_LYD344 | Arabidopsis thalia | 14531, 14719, 14531, 14719 | 310 | 507 |
| LYD346 | pUC19c_LYD346 | Brassica juncea | 14532, 14720, 14532, 14720 | 311 | 508 |
| LYD347 | pUC19c_LYD347 | Brassica juncea | 14533, 14721, 14888, 14721 | 312 | 708 |
| LYD348 | pUC19c_LYD348 | Brassica juncea | 14534, 14722, 14889, 14987 | 313 | 709 |
| LYD349 | pUC19c_LYD349 | Brassica juncea | 14535, 14723, 14535, 14723 | 314 | 710 |
| LYD351 | pUC19c_LYD351 | Brassica juncea | 14536, 14724, 14890, 14988 | 315 | 711 |
| LYD352 | pUC19_LYD352 | Brassica juncea | 14537, 14725, 14537, 14725 | 316 | 712 |
| LYD353 | pUC19c_LYD353 | Brassica juncea | 14538, 14726, 14538, 14726 | 317 | 713 |
| LYD354 | pUC19_LYD354 | Brassica juncea | 14539, 14727, 14539, 14727 | 318 | 714 |
| LYD355 | pUC19c_LYD355 | Brassica juncea | 14540, 14728, 14540, 14728 | 319 | 516 |
| LYD356 | pUC19c_LYD356 | Brassica juncea | 14541, 14729, 14541, 14729 | 320 | 715 |
| LYD357 | pUC19c_LYD357 | Brassica juncea | 14542, 14730, 14891, 14989 | 321 | 716 |
| LYD358 | pUC19_LYD358 | Brassica juncea | 14543, 14731, 14892, 14990 | 322 | 717 |
| LYD359 | pUC19c_LYD359 | Brassica juncea | 14544, 14732, 14544, 14991 | 323 | 718 |
| LYD360 | pUC19c_LYD360 | Brassica juncea | 14545, 14733, 14545, 14733 | 324 | 719 |
| LYD361 | pUC19c_LYD361 | Brassica juncea | 14546, 14734, 14546, 14734 | 325 | 720 |
| LYD362 | pUC19c_LYD362 | Brassica juncea | 14547, 14735, 14893, 14992 | 326 | 523 |
| LYD364 | pUC19_LYD364 | Brassica juncea | 14548, 14736, 14894, 14736 | 327 | 721 |
| LYD365 | pUC19c_LYD365 | Brassica juncea | 14549, 14737 | 328 | 722 |
| LYD366 | pUC19c_LYD366 | Brassica juncea | 14550, 14738, 14895, 14993 | 329 | 723 |
| LYD367 | pUC19c_LYD367 | Brassica juncea | 14551, 14739, 14551, 14739 | 330 | 724 |
| LYD368 | pUC19c_LYD368 | Brassica juncea | 14552, 14740, 14552, 14994 | 331 | 528 |
| LYD370 | pUC19c_LYD370 | BARLEY Hordeum vulgare L. | 14553, 14741, 14553, 14741 | 332 | 725 |
| LYD372 | pUC19d_LYD372 | CANOLA Brassica napus | 14554, 14742, 14896, 14995 | 333 | 531 |
| LYD375 | pUC19c_LYD375 | CANOLA Brassica napus | 14555, 14743, 14555, 14996 | 334 | 726 |
| LYD376 | pUC19c_LYD376 | CANOLA Brassica napus | 14556, 14744, 14897, 14997 | 335 | 533 |
| LYD377 | TopoB_LYD377 | CANOLA Brassica napus | 14557, 14745, 14898, 14998 | 336 | 727 |
| LYD378 | pUC19c_LYD378 | CANOLA Brassica napus | 14558, 14746, 14558, 14746 | 337 | 728 |
| LYD379 | pUC19c_LYD379 | CANOLA Brassica napus | 14559, 14747 | 338 | 729 |
| LYD380 | pMK-RQ_LYD380_GA | | GeneArt | 339 | 537 |
| LYD382 | pUC19c_LYD382 | COTTON Gossypium barbadense | 14560, 14748, 14560, 14748 | 340 | 730 |
| LYD383 | pQFNc_LYD383 | COTTON Gossypium hirsutum | 14561, 14749, 14899, 14999 | 341 | 731 |
| LYD385 | pUC19c_LYD385 | COTTON Gossypium barbadense | 14562, 14750, 14900, 15000 | 342 | 732 |
| LYD386 | pUC19c_LYD386 | COTTON Gossypium barbadense | 14563, 14751, 14901, 15001 | 343 | 733 |
| LYD387 | pUC19c_LYD387 | COTTON Gossypium barbadense | 14564, 14752, 14902, 15002 | 344 | 734 |
| LYD388 | pUC19c_LYD388 | COTTON Gossypium barbadense | 14565, 14753, 14565, 14753 | 345 | 735 |
| LYD390 | pUC19c_LYD390 | COTTON Gossypium barbadense | 14566, 14754 | 346 | 736 |

TABLE 55-continued

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LYD391 | pUC19_LYD391 | MAIZE *Zea mays* L. | 14567, 14755, 14567, 14755 | 347 | 737 |
| LYD392 | pUC19c_LYD392 | MAIZE *Zea mays* L. | 14568, 14756, 14904, 15004 | 348 | 738 |
| LYD393 | pUC19c_LYD393 | MEDICAGO *Medicago trancatula* | 14569, 14757, 14569, 15005 | 349 | 739 |
| LYD395 | pUC19c_LYD395 | MEDICAGO *Medicago trancatula* | 14570, 14758, 14905, 15006 | 350 | 549 |
| LYD396 | pUC19c_LYD396 | MEDICAGO *Medicago trancatula* | 14571, 14759, 14906, 15007 | 351 | 740 |
| LYD397 | pUC19c_LYD397 | MEDICAGO *Medicago trancatula* | 14572, 14760, 14907, 15008 | 352 | 741 |
| LYD398 | pUC19c_LYD398 | MEDICAGO *Medicago trancatula* | 14573, 14761, 14573, 14761 | 353 | 742 |
| LYD399 | pUC19c_LYD399 | MEDICAGO *Medicago trancatula* | 14574, 14762, 14908, 15009 | 354 | 553 |
| LYD401 | pUC19c_LYD401 | MEDICAGO *Medicago trancatula* | 14575, 14763, 14909, 15010 | 355 | 554 |
| LYD402 | pUC19c_LYD402 | MEDICAGO *Medicago trancatula* | 14576, 14764, 14910, 15011 | 356 | 555 |
| LYD403 | pUC19c_LYD403 | MEDICAGO *Medicago trancatula* | 14577, 14765, 14911, 15012 | 357 | 743 |
| LYD404 | pUC19c_LYD404 | MEDICAGO *Medicago trancatula* | 14578, 14766, 14578, 15013 | 358 | 744 |
| LYD405 | pUC19c_LYD405 | MEDICAGO *Medicago trancatula* | 14579, 14767, 14579, 15014 | 359 | 745 |
| LYD407 | pMK-RQ_LYD407_GA | | GeneArt | 360 | 559 |
| LYD408 | pUC19c_LYD408 | MEDICAGO *Medicago trancatula* | 14580, 14768, 14580, 15015 | 361 | 746 |
| LYD409 | pUC19c_LYD409 | MEDICAGO *Medicago trancatula* | 14581, 14769, 14912, 15016 | 362 | 747 |
| LYD410 | pUC19c_LYD410 | MEDICAGO *Medicago trancatula* | 14582, 14770, 14913, 15017 | 363 | 748 |
| LYD413 | pUC19d_LYD413 | MEDICAGO *Medicago trancatula* | 14583, 14771, 14914, 14771 | 364 | 749 |
| LYD414 | pUC19c_LYD414 | MEDICAGO *Medicago trancatula* | 14584, 14772, 14915, 15018 | 365 | 564 |
| LYD415 | pUC19c_LYD415 | MEDICAGO *Medicago trancatula* | 14585, 14773, 14916, 15019 | 366 | 750 |
| LYD416 | pUC19c_LYD416 | MEDICAGO *Medicago trancatula* | 14586, 14774, 14586, 14774 | 367 | 751 |
| LYD417 | pUC19c_LYD417 | MEDICAGO *Medicago trancatula* | 14587, 14775, 14587, 15020 | 368 | 752 |
| LYD418 | pUC19c_LYD418 | MEDICAGO *Medicago trancatula* | 14588, 14776, 14588, 14776 | 369 | 753 |
| LYD419 | pUC19c_LYD419 | MEDICAGO *Medicago trancatula* | 14589, 14777, 14917, 15021 | 370 | 754 |
| LYD420 | pUC19c_LYD420 | MEDICAGO *Medicago trancatula* | 14590, 14778, 14590, 14778 | 371 | 755 |
| LYD422 | pUC19c_LYD422 | MEDICAGO *Medicago trancatula* | 14591, 14779, 14918, 14779 | 372 | 756 |
| LYD423 | pUC19c_LYD423 | *Sorghum bicolor* | 14592, 14780, 14592, 15022 | 373 | 573 |
| LYD424 | pUC19c_LYD424 | *Sorghum bicolor* | 14593, 14781, 14593, 14781 | 374 | 574 |
| LYD425 | pUC19c_LYD425 | *Sorghum bicolor* | 14594, 14782, 14919, 15023 | 375 | 575 |
| LYD427 | pMA-RQ_LYD427_GA | | GeneArt | 376 | 576 |
| LYD428 | pUC19c_LYD428 | *Sorghum bicolor* | 14595, 14783, 14595, 15024 | 377 | 757 |
| LYD431 | pMA_LYD431_GA | | GeneArt | 378 | 578 |
| LYD432 | pUC19c_LYD432 | *Sorghum bicolor* | 14596, 14784, 14920, 15025 | 379 | 579 |
| LYD433 | TopoB_LYD433 | *Sorghum bicolor* | 14597, 14785, 14597, 14785 | 380 | 580 |
| LYD434 | pUC19c_LYD434 | *Sorghum bicolor* | 14598, 14786, 14598, 14786 | 381 | 581 |
| LYD435 | pUC19c_LYD435 | *Sorghum bicolor* | 14599, 14787 | 382 | 582 |
| LYD436 | pUC19c_LYD436 | *Sorghum bicolor* | 14600, 14788, 14600, 14788 | 383 | 758 |
| LYD437 | pUC19c_LYD437 | SOYBEAN *Glycine max* | 14601, 14789, 14921, 15026 | 384 | 584 |
| LYD438 | pUC19c_LYD438 | SOYBEAN *Glycine max* | 14602, 14790, 14922, 15027 | 385 | 585 |
| LYD439 | pUC19c_LYD439 | SOYBEAN *Glycine max* | 14603, 14791, 14923, 15028 | 386 | 586 |
| LYD440 | pUC19c_LYD440 | SOYBEAN *Glycine max* | 14604, 14792, 14604, 15029 | 387 | 587 |
| LYD441 | pUC19c_LYD441 | SOYBEAN *Glycine max* | 14605, 14793, 14924, 15030 | 388 | 588 |
| LYD442 | pUC19c_LYD442 | SOYBEAN *Glycine max* | 14606, 14794, 14606, 14794 | 389 | 589 |
| LYD443 | pMA-RQ_LYD443_GA | | GeneArt | 390 | 590 |
| LYD445 | pUC19d_LYD445 | SOYBEAN *Glycine max* | 14607, 14795, 14607, 14795 | 391 | 591 |
| LYD446 | pUC19c_LYD446p | SOYBEAN *Glycine max* | 14608, 14796 | 392 | 759 |
| LYD448 | pUC19c_LYD448 | SOYBEAN *Glycine max* | 14609, 14797, 14609, 15031 | 393 | 594 |
| LYD449 | pUC19c_LYD449 | SOYBEAN *Glycine max* | 14610, 14798, 14610, 15032 | 394 | 760 |
| LYD450 | pUC19c_LYD450 | SOYBEAN *Glycine max* | 14611, 14799, 14925, 15033 | 395 | 596 |
| LYD451 | pUC19c_LYD451 | SOYBEAN *Glycine max* | 14612, 14800, 14612, 14800 | 396 | 597 |
| LYD452 | pUC19c_LYD452 | SOYBEAN *Glycine max* | 14613, 14801, 14613, 14801 | 397 | 761 |
| LYD453 | pUC19c_LYD453 | SOYBEAN *Glycine max* | 14614, 14802, 14926, 15034 | 398 | 599 |
| LYD454 | pUC19c_LYD454 | SOYBEAN *Glycine max* | 14615, 14803, 14615, 14803 | 399 | 600 |
| LYD455 | pUC19c_LYD455 | SOYBEAN *Glycine max* | 14616, 14804, 14616, 15035 | 400 | 762 |
| LYD456 | TopoB_LYD456 | SOYBEAN *Glycine max* | 14617, 14805, 14927, 15036 | 401 | 763 |
| LYD458 | pUC19c_LYD458 | SOYBEAN *Glycine max* | 14618, 14806, 14928, 14806 | 402 | 603 |
| LYD459 | pUC19c_LYD459 | SOYBEAN *Glycine max* | 14619, 14807, 14619, 14807 | 403 | 604 |
| LYD460 | pUC19c_LYD460 | SOYBEAN *Glycine max* | 14620, 14808, 14620, 14808 | 404 | 605 |
| LYD461 | pUC19c_LYD461 | SOYBEAN *Glycine max* | 14621, 14809, 14929, 15037 | 405 | 606 |
| LYD462 | pUC19c_LYD462 | SOYBEAN *Glycine max* | 14622, 14810, 14622, 15038 | 406 | 764 |
| LYD465 | pUC19c_LYD465 | SOYBEAN *Glycine max* | 14623, 14811, 14623, 14811 | 407 | 608 |
| LYD466 | pUC19c_LYD466 | SOYBEAN *Glycine max* | 14624, 14812, 14930, 15039 | 408 | 609 |
| LYD467 | pMA-RQ_LYD467_GA | | GeneArt | 409 | 610 |
| LYD468 | pMA_LYD468_GA | | GeneArt | 410 | 611 |
| LYD469 | pUC19c_LYD469 | SOYBEAN *Glycine max* | 14625, 14813, 14625, 14813 | 411 | 612 |
| LYD470 | pUC19c_LYD470 | SOYBEAN *Glycine max* | 14626, 14814, 14931, 15040 | 412 | 765 |
| LYD471 | pUC19c_LYD471 | SOYBEAN *Glycine max* | 14627, 14815, 14627, 15041 | 413 | 614 |
| LYD472 | pUC19c_LYD472 | SOYBEAN *Glycine max* | 14628, 14816 | 414 | 615 |
| LYD473 | pUC19c_LYD473 | SOYBEAN *Glycine max* | 14629, 14817, 14629, 15043 | 415 | 616 |
| LYD474 | pUC19c_LYD474 | SUNFLOWER *Helianthus annuus* | 14630, 14818, 14932, 15044 | 416 | 617 |
| LYD475 | pUC19c_LYD475 | TOMATO *Lycopersicum* ND | 14631, 14819, 14933, 15045 | 417 | 618 |
| LYD477 | pUC19_LYD477 | TOMATO *Lycopersicum* ND | 14632, 14820, 14934, 15046 | 418 | 619 |
| LYD478 | pUC19c_LYD478 | TOMATO *Lycopersicum* ND | 14633, 14821, 14935, 15047 | 419 | 620 |
| LYD479 | pUC19c_LYD479 | TOMATO *Lycopersicum* ND | 14634, 14822, 14936, 14822 | 420 | 621 |

TABLE 55-continued

Genes cloned in High copy number plasmids

| Gene Name | High copy plasmid | Organism | Primers used SEQ ID NOs: | Polyn. SEQ ID NO: | Polyp. SEQ ID NO: |
|---|---|---|---|---|---|
| LYD480 | pUC19_LYD480 | TOMATO *Lycopersicum* ND | 14635, 14823, 14937, 15048 | 421 | 766 |
| LYD481 | pUC19c_LYD481 | TOMATO *Lycopersicum* ND | 14636, 14824 | 422 | 623 |
| LYD482 | pUC19c_LYD482 | TOMATO *Lycopersicum* ND | 14637, 14825, 14938, 15049 | 423 | 624 |
| LYD483 | pUC19c_LYD483 | TOMATO *Lycopersicum* ND | 14638, 14826, 14638, 14826 | 424 | 767 |
| LYD484 | pUC19c_LYD484 | TOMATO *Lycopersicum* ND | 14639, 14827, 14939, 15050 | 425 | 626 |
| LYD487 | pUC19c_LYD487 | TOMATO *Lycopersicum* ND | 14640, 14828, 14940, 15051 | 426 | 768 |
| LYD489 | pUC19c_LYD489 | TOMATO *Lycopersicum* ND | 14641, 14829, 14941, 15052 | 427 | 628 |
| LYD491 | pUC19c_LYD491 | TOMATO *Lycopersicum* ND | 14642, 14830, 14942, 14830 | 428 | 629 |
| LYD492 | pUC19c_LYD492 | TOMATO *Lycopersicum* ND | 14643, 14831, 14643, 15053 | 429 | 630 |
| LYD495 | pUC19c_LYD495 | WHEAT *Triticum aestivum* L. | 14644, 14832, 14943, 15054 | 430 | 631 |
| LYD496 | pUC19c_LYD496 | *Arabidopsis thalia* | 14669, 14857, 14669, 14857 | 455 | — |
| LYD497 | pUC19c_LYD497 | *Brassica juncea* | 14645, 14833, 14944, 15055 | 431 | 769 |
| LYD498 | pUC19c_LYD498 | *Brassica juncea* | 14646, 14834, 14646, 14834 | 432 | 633 |
| LYD499 | pUC19c_LYD499 | *Brassica juncea* | 14647, 14835, 14647, 14835 | 433 | 634 |
| LYD500 | pUC19_LYD500 | *Brassica juncea* | 14648, 14836, 14648, 14836 | 434 | 635 |
| LYD501 | pUC19c_LYD501 | *Brassica juncea* | 14649, 14837, 14945, 15056 | 435 | 770 |
| LYD502 | pUC19c_LYD502 | COTTON *Gossypium barbadense* | 14650, 14838 | 436 | 771 |
| LYD503 | pUC19c_LYD503 | MAIZE *Zea mays* L. | 14651, 14839, 14946, 15057 | 437 | 638 |
| LYD504 | pUC19c_LYD504 | MEDICAGO *Medicago trancatula* | 14652, 14840, 14652, 15058 | 438 | 639 |
| LYD505 | pUC19c_LYD505 | MEDICAGO *Medicago trancatula* | 14653, 14841, 14653, 15059 | 439 | 772 |
| LYD506 | pUC19c_LYD506 | MEDICAGO *Medicago trancatula* | 14654, 14842, 14947, 15060 | 440 | 641 |
| LYD507 | pUC19c_LYD507 | *Sorghum bicolor* | 14655, 14843, 14948, 15061 | 441 | 642 |
| LYD508 | pUC19d_LYD508 | *Sorghum bicolor* | 14656, 14844, 14949, 15062 | 442 | 643 |
| LYD509 | pUC19c_LYD509 | *Sorghum bicolor* | 14657, 14845, 14657, 14845 | 443 | 644 |
| LYD510 | pUC19c_LYD510 | *Sorghum bicolor* | 14658, 14846, 14658, 15063 | 444 | 645 |
| LYD511 | pUC19c_LYD511 | SOYBEAN *Glycine max* | 14659, 14847, 14950, 15064 | 445 | 646 |
| LYD512 | pUC19c_LYD512 | SOYBEAN *Glycine max* | 14660, 14848 | 446 | 647 |
| LYD513 | pUC19c_LYD513 | SOYBEAN *Glycine max* | 14661, 14849 | 447 | 648 |
| LYD514 | TopoB_LYD514 | SOYBEAN *Glycine max* | 14662, 14850, 14951, 15065 | 448 | 649 |
| LYD515 | pUC19c_LYD515 | SOYBEAN *Glycine max* | 14663, 14851, 14952, 15066 | 449 | 650 |
| LYD516 | pUC19c_LYD516 | SOYBEAN *Glycine max* | 14664, 14852, 14953, 15067 | 450 | 651 |
| LYD517 | pUC19c_LYD517 | SOYBEAN *Glycine max* | 14665, 14853 | 451 | 652 |
| LYD518 | pUC19c_LYD518 | SOYBEAN *Glycine max* | 14666, 14854, 14666, 14854 | 452 | 773 |
| LYD519 | pUC19c_LYD519 | SOYBEAN *Glycine max* | 14667, 14855, 14954, 15068 | 453 | 654 |
| LYD520 | pUC19c_LYD520 | SOYBEAN *Glycine max* | 14668, 14856 | 454 | 774 |

Table 55.
"Polyn."—Polynucleotide;
"Polyp."—polypeptide.
For cloning of each gene at least 2 primers were used: Forward (Fwd) or Reverse (Rev). In some cases, 4 primers were used: External forward (EF), External reverse (ER), nested forward (NF) or nested reverse (NR). The sequences of the primers used for cloning the genes are provided in the sequence listing.

Example 15

Production of Transgenic *Arabidopsis* Plants Expressing the Identified Polynucleotides of Some Embodiments of the Invention Experimental Methods Production of *Agrobacterium tumefaciens* cells harboring the binary vectors according to some embodiments of the invention—Each of the binary vectors described in Example 14 above were used to transform *Agrobacterium* cells. Two additional binary constructs, having only the At6669 or the 35S promoter or no additional promoter were used as negative controls.

The binary vectors were introduced to *Agrobacterium tumefaciens* GV301, or LB4404 competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (50 mg/L; for *Agrobacterium* strains GV301) or streptomycin (300 mg/L; for *Agrobacterium* strain LB4404) and kanamycin (50 mg/L) at 28° C. for 48 hours. *Agrobacterium* colonies, which are developed on the selective media, were further analyzed by PCR using the primers designed to span the inserted sequence in the pPI plasmid. The resulting PCR products were isolated and sequenced to verify that the correct polynucleotide sequences of the invention were properly introduced to the *Agrobacterium* cells.

Preparation of *Arabidopsis* plants for transformation—*Arabidopsis thaliana* var *Columbia* ($T_0$ plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues are the primary targets of *Agrobacterium*-mediated transformation by the *Arabidopsis* floral-dip method. Plant Physiol. 123(3): 895-904] with minor modifications. Briefly, *Arabidopsis thaliana* Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Preparation of the *Agrobacterium* carrying the binary vectors to transformation into *Arabidopsis* plants—Single colonies of *Agrobacterium* carrying the binary vectors harboring the genes of some embodiments of the invention were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising Agrobacterium cells were resuspended in a transformation medium which contains half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of Arabidopsis plants with the Agrobacterium—Transformation of $T_0$ plants was performed by inverting each plant into an Agrobacterium suspension such that the above ground plant tissue is submerged for 3-5 seconds. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques are brown and dry, then seeds were harvested from plants and kept at room temperature until sowing.

Generation of T1 and T2 transgenic plants—For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ Arabidopsis plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 16

Evaluation of Transgenic Arabidopsis for Seed Yield and Plant Growth Rate Under Normal Conditions in Greenhouse Assays (GH-SM Assays)

Assay 1: Seed yield plant biomass and plant growth rate under normal greenhouse conditions—This assay follows seed yield production, the biomass formation and the rosette area growth of plants grown in the greenhouse at non-limiting nitrogen growth conditions. Transgenic Arabidopsis seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until mature seeds. Seeds were harvested, extracted and weight. The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying the At6669 promoter and the selectable marker was used as control.

The plants were analyzed for their overall size, growth rate, flowering, seed yield, 1,000-seed weight, dry matter and harvest index (HI—seed yield/dry matter). Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs are square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number [formula IX (described above)], rosette area [formula VIII (described above)], plot coverage (formula XIII, below) and harvest index [formula IV (described above)] was calculated with the indicated formulas.

Relative growth rate of plot coverage=Regression coefficient of plot coverage along time course. Formula XIII Seeds average weight—At the end of the experiment all seeds were collected. The seeds were scattered on a glass tray and a picture was taken. Using the digital analysis, the number of seeds in each sample was calculated.

Dry weight and seed yield—On about day 80 from sowing, the plants were harvested and left to dry at 30° C. in a drying chamber. The biomass and seed weight of each plot were measured and divided by the number of plants in each plot. Dry weight=total weight of the vegetative portion above ground (excluding roots) after drying at 30° C. in a drying chamber; Seed yield per plant=total seed weight per plant (gr). 1000 seed weight (the weight of 1000 seeds) (gr.).

The harvest index (HI) was calculated using Formula IV as described above.

Oil percentage in seeds—At the end of the experiment all seeds from each plot were collected. Seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra-Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical analyses—To identify outperforming genes and constructs, results from the independent transformation events tested were analyzed separately. Data was analyzed using Student's t-test and results are considered significant if the p value was less than 0.1. The JMP statistics software package was used (Version 5.2.1, SAS Institute Inc., Cary, N.C., USA).

Tables 56-60 summarize the observed phenotypes of transgenic plants exogenously expressing the gene constructs using the seed maturation (GH-SM) assays under normal conditions. The evaluation of each gene was performed by testing the performance of different number of events. Event with p-value <0.1 was considered statistically significant.

TABLE 56

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LYD513 | 67217.3 | — | — | — | 38.5 | 0.02 | −3 | 32.1 | 0.28 | −1 |
| LYD512 | 67209.1 | — | — | — | 38.6 | 0.13 | −2 | 32.0 | 0.15 | −1 |
| LYD512 | 67209.4 | — | — | — | — | — | — | 32.1 | 0.28 | −1 |
| LYD512 | 67211.1 | — | — | — | — | — | — | 32.1 | 0.28 | −1 |
| LYD512 | 67212.2 | — | — | — | — | — | — | 32.1 | 0.28 | −1 |
| LYD482 | 67334.1 | — | — | — | — | — | — | 32.1 | 0.28 | −1 |
| LYD482 | 67334.3 | — | — | — | — | — | — | 32.0 | 0.15 | −1 |
| LYD475 | 67202.3 | — | — | — | 38.8 | 0.07 | −2 | — | — | — |
| LYD475 | 67204.4 | — | — | — | 38.0 | 0.02 | −4 | 32.0 | 0.15 | −1 |
| LYD472 | 67332.1 | — | — | — | 37.6 | L | −5 | 32.0 | 0.15 | −1 |
| LYD472 | 67332.3 | — | — | — | 38.7 | 0.04 | −2 | 32.0 | 0.15 | −1 |
| LYD472 | 67332.4 | — | — | — | 38.0 | 0.02 | −4 | 32.0 | 0.15 | −1 |
| LYD466 | 67119.4 | — | — | — | — | — | — | 32.1 | 0.28 | −1 |
| LYD466 | 67121.1 | — | — | — | 37.5 | L | −5 | 32.0 | 0.15 | −1 |
| LYD466 | 67121.3 | — | — | — | — | — | — | 32.1 | 0.28 | −1 |
| LYD452 | 67106.2 | — | — | — | — | — | — | 32.0 | 0.15 | −1 |
| LYD451 | 67187.7 | — | — | — | — | — | — | 32.1 | 0.28 | −1 |
| LYD451 | 67188.1 | — | — | — | 38.9 | 0.11 | −1 | 32.1 | 0.28 | −1 |
| LYD451 | 67188.4 | — | — | — | 38.3 | 0.26 | −3 | — | — | — |
| LYD445 | 67353.1 | — | — | — | — | — | — | 32.0 | 0.15 | −1 |
| LYD445 | 67353.2 | — | — | — | 38.5 | 0.02 | −3 | 32.0 | 0.15 | −1 |
| LYD439 | 67095.6 | — | — | — | 39.0 | 0.20 | −1 | 32.1 | 0.28 | −1 |
| LYD415 | 67264.5 | — | — | — | 38.8 | 0.07 | −2 | — | — | — |
| LYD415 | 67266.1 | — | — | — | 39.0 | 0.20 | −1 | 32.1 | 0.28 | −1 |
| LYD382 | 67175.2 | — | — | — | — | — | — | 32.1 | 0.28 | −1 |
| LYD382 | 67176.3 | — | — | — | — | — | — | 32.0 | 0.15 | −1 |
| LYD339 | 67246.3 | — | — | — | — | — | — | 32.0 | 0.15 | −1 |
| LYD339 | 67247.6 | — | — | — | — | — | — | 32.0 | 0.15 | −1 |
| LYD324 | 67167.1 | — | — | — | 38.7 | 0.08 | −2 | 32.0 | 0.15 | −1 |
| LYD321 | 67280.1 | — | — | — | — | — | — | 32.1 | 0.28 | −1 |
| LYD321 | 67283.1 | — | — | — | — | — | — | 32.1 | 0.28 | −1 |
| LYD321 | 67283.4 | — | — | — | 38.0 | 0.02 | −4 | 32.0 | 0.15 | −1 |
| LYD302 | 67413.1 | — | — | — | — | — | — | 32.1 | 0.28 | −1 |
| LYD302 | 67414.2 | — | — | — | — | — | — | 32.1 | 0.28 | −1 |
| LYD302 | 67416.3 | — | — | — | 38.7 | 0.04 | −2 | 32.0 | 0.15 | −1 |
| LYD296 | 67358.6 | — | — | — | 38.8 | 0.08 | −2 | 32.1 | 0.28 | −1 |
| LYD296 | 67360.1 | — | — | — | 38.7 | 0.09 | −2 | — | — | — |
| LYD290 | 67233.1 | — | — | — | 39.0 | 0.20 | −1 | 32.1 | 0.28 | −1 |
| LYD290 | 67233.5 | — | — | — | 38.6 | 0.03 | −2 | — | — | — |
| CONT. | — | — | — | — | 39.5 | — | — | 32.3 | — | — |
| LYD517 | 67222.1 | — | — | — | 37.5 | 0.05 | −3 | 32.0 | 0.23 | −1 |
| LYD515 | 67151.1 | — | — | — | 37.1 | 0.18 | −4 | 32.0 | 0.23 | −1 |
| LYD502 | 67341.5 | — | — | — | 37.5 | 0.05 | −3 | 32.0 | 0.23 | −1 |
| LYD502 | 67342.2 | — | — | — | — | — | — | 32.0 | 0.23 | −1 |
| LYD498 | 67252.3 | — | — | — | — | — | — | 32.0 | 0.23 | −1 |
| LYD492 | 67364.1 | — | — | — | — | — | — | 32.0 | 0.23 | −1 |

TABLE 56-continued

Genes showing improved plant performance at Normal growth conditions under regulation of At6669 promoter

| Gene Name | Event # | Dry Weight [mg] Ave. | P-Val. | % Incr. | Flowering Ave. | P-Val. | % Incr. | Inflorescence Emergence Ave. | P-Val. | % Incr. |
|---|---|---|---|---|---|---|---|---|---|---|
| LYD492 | 67366.3 | — | — | — | 37.1 | 0.06 | −4 | — | — | — |
| LYD474 | 67199.1 | — | — | — | 37.7 | 0.10 | −2 | 32.0 | 0.23 | −1 |
| LYD454 | 67192.5 | — | — | — | 37.6 | 0.07 | −3 | — | — | — |
| LYD450 | 67178.4 | — | — | — | 37.6 | 0.07 | −3 | — | — | — |
| LYD450 | 67182.2 | — | — | — | 37.6 | 0.07 | −3 | 32.0 | 0.23 | −1 |
| LYD397 | 67322.1 | — | — | — | 37.6 | 0.07 | −3 | 32.0 | 0.23 | −1 |
| LYD397 | 67324.2 | — | — | — | 37.1 | 0.06 | −4 | 32.0 | 0.23 | −1 |
| LYD328 | 67238.2 | — | — | — | 37.1 | 0.06 | −4 | 32.0 | 0.23 | −1 |
| LYD323 | 67286.4 | — | — | — | — | — | — | 32.0 | 0.23 | −1 |
| LYD323 | 67287.1 | — | — | — | 37.0 | 0.12 | −4 | 32.0 | 0.23 | −1 |
| LYD323 | 67287.3 | — | — | — | 36.8 | 0.01 | −5 | 32.0 | 0.23 | −1 |
| LYD312 | 67256.4 | — | — | — | 37.5 | 0.05 | −3 | 32.0 | 0.23 | −1 |
| LYD312 | 67256.5 | — | — | — | 37.6 | 0.07 | −3 | 32.0 | 0.23 | −1 |
| LYD312 | 67257.1 | — | — | — | 37.9 | 0.29 | −2 | 32.0 | 0.23 | −1 |
| LYD312 | 67257.3 | — | — | — | 37.5 | 0.05 | −3 | 32.0 | 0.23 | −1 |
| LYD310 | 67160.2 | — | — | — | 38.0 | 0.29 | −1 | 32.0 | 0.23 | −1 |
| LYD301 | 67347.1 | — | — | — | 37.9 | 0.29 | −2 | 32.0 | 0.23 | −1 |
| LYD301 | 67347.2 | — | — | — | 37.1 | 0.06 | −4 | 32.0 | 0.23 | −1 |
| LYD298 | 66962.3 | — | — | — | 37.9 | 0.29 | −2 | 32.0 | 0.23 | −1 |
| LYD298 | 66964.4 | — | — | — | 37.5 | 0.05 | −3 | 32.0 | 0.23 | −1 |
| LYD298 | 66966.1 | — | — | — | 37.6 | 0.07 | −3 | — | — | — |
| LYD291 | 67402.2 | — | — | — | — | — | — | 32.0 | 0.23 | −1 |
| CONT. | — | — | — | — | 38.6 | — | — | 32.4 | — | — |
| LYD508 | 67823.2 | 1170.6 | 0.04 | 9 | — | — | — | — | — | — |
| LYD508 | 67824.3 | 1310.0 | 0.22 | 22 | 37.9 | 0.08 | −4 | 31.8 | 0.13 | −2 |
| LYD495 | 67731.2 | 1120.0 | 0.26 | 5 | — | — | — | — | — | — |
| LYD495 | 67732.5 | 1178.1 | 0.23 | 10 | — | — | — | — | — | — |
| LYD491 | 67874.3 | 1120.0 | 0.26 | 5 | — | — | — | — | — | — |
| LYD491 | 67874.6 | 1187.5 | 0.03 | 11 | — | — | — | — | — | — |
| LYD489 | 67784.4 | 1118.8 | 0.29 | 4 | — | — | — | — | — | — |
| LYD479 | 67727.4 | 1198.8 | 0.02 | 12 | — | — | — | — | — | — |
| LYD433 | 67702.4 | 1228.8 | L | 15 | — | — | — | — | — | — |
| LYD428 | 67472.2 | — | — | — | 38.5 | 0.22 | −3 | 32.0 | 0.20 | −1 |
| LYD428 | 67473.3 | 1204.4 | 0.17 | 12 | 37.6 | 0.14 | −5 | 31.6 | 0.22 | −3 |
| LYD305 | 67533.1 | 1353.1 | L | 26 | — | — | — | — | — | — |
| CONT. | — | 1071.0 | — | — | 39.6 | — | — | 32.5 | — | — |
| LYD484 | 67133.3 | — | — | — | — | — | — | 27.8 | 0.03 | −4 |
| LYD484 | 67135.3 | — | — | — | 34.8 | 0.08 | −2 | 27.8 | 0.02 | −4 |
| LYD470 | 67125.4 | — | — | — | 34.5 | 0.02 | −3 | 27.9 | 0.02 | −4 |
| LYD470 | 67126.7 | — | — | — | 33.8 | 0.28 | −5 | 27.0 | 0.27 | −7 |
| LYD459 | 67112.1 | — | — | — | — | — | — | 27.4 | 0.24 | −6 |
| LYD414 | 67091.1 | — | — | — | 33.8 | 0.28 | −5 | — | — | — |
| LYD414 | 67091.2 | — | — | — | 33.7 | 0.16 | −5 | 28.3 | 0.19 | −2 |
| LYD387 | 67316.1 | — | — | — | 34.7 | 0.17 | −2 | — | — | — |
| LYD387 | 67317.1 | — | — | — | — | — | — | 28.0 | 0.03 | −3 |
| LYD387 | 67317.4 | — | — | — | — | — | — | 27.9 | 0.03 | −4 |
| LYD386 | 67860.3 | — | — | — | — | — | — | 28.1 | 0.04 | −3 |
| LYD347 | 67848.2 | — | — | — | 34.5 | 0.02 | −3 | 27.2 | 0.13 | −6 |
| LYD341 | 67055.2 | — | — | — | 34.8 | 0.08 | −2 | 27.3 | 0.20 | −6 |
| LYD338 | 67442.3 | — | — | — | 33.9 | 0.26 | −4 | 28.0 | 0.03 | −3 |
| LYD338 | 67443.1 | — | — | — | 34.7 | 0.17 | −2 | — | — | — |
| LYD337 | 66994.3 | — | — | — | 34.3 | L | −3 | — | — | — |
| LYD337 | 66995.4 | — | — | — | 33.8 | 0.28 | −5 | 27.3 | 0.20 | −6 |
| LYD322 | 66884.2 | — | — | — | 33.8 | 0.28 | −5 | 27.5 | 0.13 | −5 |
| LYD322 | 66886.6 | — | — | — | 34.5 | 0.02 | −3 | — | — | — |
| LYD322 | 66887.1 | — | — | — | 33.1 | L | −7 | — | — | — |
| LYD307 | 66977.3 | — | — | — | — | — | — | 27.4 | 0.24 | −6 |
| CONT. | — | — | — | — | 35.5 | — | — | 29.0 | — | — |
| LYD496 | 67737.2 | — | — | — | — | — | — | 31.5 | 0.18 | −2 |
| LYD496 | 67739.1 | — | — | — | 37.1 | 0.11 | −3 | — | — | — |
| LYD496 | 67741.6 | — | — | — | — | — | — | 31.2 | 0.06 | −2 |
| LYD410 | 67546.3 | 1274.9 | 0.18 | 12 | — | — | — | 31.1 | 0.04 | −3 |
| LYD409 | 67468.2 | 1203.1 | 0.05 | 6 | — | — | — | — | — | — |
| LYD405 | 67696.2 | — | — | — | — | — | — | 31.6 | 0.28 | −1 |
| LYD403 | 67769.4 | 1375.0 | L | 21 | — | — | — | — | — | — |
| LYD403 | 67771.1 | — | — | — | — | — | — | 31.4 | 0.18 | −2 |
| LYD402 | 67760.2 | 1203.1 | 0.14 | 6 | 37.1 | 0.29 | −3 | — | — | — |
| LYD379 | 67677.1 | 1181.9 | 0.14 | 4 | — | — | — | — | — | — |
| LYD379 | 67678.1 | — | — | — | — | — | — | 31.5 | 0.18 | −2 |
| LYD372 | 67673.4 | 1281.2 | 0.23 | 13 | 37.1 | 0.11 | −3 | 31.2 | 0.06 | −2 |
| LYD366 | 67812.5 | 1192.5 | 0.08 | 5 | — | — | — | — | — | — |

TABLE 56-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LYD362 | 67538.2 | 1175.0 | 0.20 | 3 | — | — | — | — | — | — |
| LYD362 | 67543.5 | — | — | — | 36.7 | 0.02 | −4 | 31.3 | 0.21 | −2 |
| LYD355 | 67641.2 | 1180.0 | 0.15 | 4 | — | — | — | — | — | — |
| LYD347 | 67844.2 | 1213.8 | 0.03 | 7 | — | — | — | 31.3 | 0.21 | −2 |
| LYD335 | 67557.5 | — | — | — | — | — | — | 31.5 | 0.18 | −2 |
| CONT. | — | 1135.6 | — | — | 38.1 | — | — | 32.0 | — | — |
| LYD504 | 67136.3 | — | — | — | 33.0 | L | −8 | 26.8 | L | −8 |
| LYD504 | 67138.1 | — | — | — | 34.7 | 0.04 | −3 | 27.9 | 0.02 | −5 |
| LYD504 | 67139.1 | — | — | — | — | — | — | 27.6 | 0.16 | −6 |
| LYD504 | 67140.1 | — | — | — | 34.6 | 0.08 | −3 | — | — | — |
| LYD466 | 67119.4 | — | — | — | 34.0 | L | −5 | 28.1 | L | −4 |
| LYD442 | 67103.1 | — | — | — | — | — | — | 28.0 | L | −4 |
| LYD442 | 67104.3 | — | — | — | 34.7 | 0.06 | −3 | 28.1 | 0.01 | −4 |
| LYD440 | 66902.1 | — | — | — | — | — | — | 28.4 | 0.28 | −3 |
| LYD440 | 66903.1 | — | — | — | 34.7 | 0.06 | −3 | 27.8 | L | −5 |
| LYD425 | 67454.5 | — | — | — | 35.1 | 0.17 | −2 | 28.1 | L | −4 |
| LYD408 | 67304.1 | — | — | — | 34.4 | 0.02 | −4 | — | — | — |
| LYD408 | 67305.6 | — | — | — | 34.7 | 0.11 | −3 | 27.9 | L | −5 |
| LYD408 | 67306.2 | — | — | — | 34.1 | 0.01 | −5 | 28.0 | L | −4 |
| LYD401 | 67086.3 | — | — | — | 34.9 | 0.09 | −2 | — | — | — |
| LYD375 | 67071.4 | — | — | — | 34.9 | 0.18 | −2 | — | — | — |
| LYD375 | 67073.2 | — | — | — | 34.4 | 0.02 | −4 | 28.0 | L | −4 |
| LYD342 | 67062.1 | — | — | — | 34.9 | 0.09 | −2 | 28.4 | 0.28 | −3 |
| LYD329 | 67277.4 | — | — | — | 34.4 | 0.16 | −4 | 28.0 | L | −4 |
| LYD320 | 67040.3 | — | — | — | 34.8 | 0.09 | −3 | 28.4 | 0.28 | −3 |
| LYD318 | 66980.5 | — | — | — | 35.0 | 0.16 | −2 | — | — | — |
| LYD318 | 66982.1 | — | — | — | 34.9 | 0.19 | −2 | — | — | — |
| LYD318 | 66983.4 | — | — | — | 33.4 | 0.03 | −6 | 27.3 | 0.18 | −7 |
| LYD316 | 67436.1 | — | — | — | 34.7 | 0.06 | −3 | — | — | — |
| LYD316 | 67439.1 | — | — | — | 34.7 | 0.06 | −3 | — | — | — |
| LYD298 | 66962.3 | — | — | — | 35.1 | 0.17 | −2 | — | — | — |
| LYD292 | 66998.3 | — | — | — | 34.5 | 0.03 | −3 | 27.5 | L | −6 |
| LYD292 | 66999.4 | — | — | — | 34.4 | 0.16 | −4 | 28.4 | 0.25 | −3 |
| LYD292 | 67000.1 | — | — | — | 34.4 | 0.02 | −4 | 28.9 | 0.28 | −1 |
| CONT. | — | — | — | — | 35.8 | — | — | 29.2 | — | — |

TABLE 56.
"CONT."—Control;
"Ave."—Average;
"% Incr." = % increment;
"p-val." —p-value,
L—p < 0.01.
The transgenes were under the transcriptional regulation of the new At6669 promoter (SEQ ID NO: 14467).
"—" = results are still unavailable.

TABLE 57

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYD499 | 68152.2 | 1.1 | 0.22 | 7 | — | — | — | — | — | — |
| LYD446 | 68110.1 | 1.1 | 0.14 | 15 | — | — | — | 63.1 | 0.03 | 18 |
| LYD443 | 68163.1 | 1.1 | 0.05 | 15 | — | — | — | 62.3 | 0.14 | 17 |
| LYD443 | 68164.1 | 1.0 | 0.06 | 4 | — | — | — | — | — | — |
| LYD443 | 68164.2 | 1.2 | L | 18 | — | — | — | 64.2 | 0.12 | 20 |
| LYD443 | 68165.3 | 1.1 | L | 12 | 9.8 | 0.25 | 3 | 62.8 | L | 18 |
| LYD436 | 68073.3 | 1.1 | 0.09 | 15 | 10.1 | 0.05 | 5 | 64.4 | 0.02 | 21 |
| LYD416 | 67904.3 | 1.0 | 0.21 | 4 | — | — | — | 56.4 | 0.03 | 6 |
| LYD416 | 67907.6 | 1.0 | 0.19 | 6 | — | — | — | — | — | — |
| LYD391 | 68156.4 | 1.0 | 0.15 | 5 | — | — | — | 58.0 | L | 9 |
| LYD391 | 68160.4 | 1.2 | L | 22 | — | — | — | 68.4 | 0.09 | 28 |
| LYD388 | 68096.2 | 1.2 | L | 19 | — | — | — | 63.4 | L | 19 |
| LYD388 | 68098.2 | 1.2 | 0.04 | 25 | — | — | — | 69.1 | L | 29 |
| LYD388 | 68098.3 | 1.1 | L | 14 | — | — | — | 57.9 | 0.14 | 9 |

TABLE 57-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYD367 | 68066.5 | 1.2 | 0.01 | 25 | — | — | — | 68.7 | 0.14 | 29 |
| LYD364 | 68018.4 | 1.1 | 0.17 | 12 | — | — | — | 60.2 | 0.03 | 13 |
| LYD364 | 68020.1 | 1.1 | 0.07 | 8 | — | — | — | 55.3 | 0.29 | 3 |
| LYD364 | 68020.5 | 1.3 | 0.05 | 26 | 9.9 | 0.22 | 3 | 72.5 | L | 36 |
| LYD364 | 68022.1 | 1.1 | 0.14 | 14 | — | — | — | 62.5 | 0.15 | 17 |
| LYD361 | 68147.1 | 1.0 | 0.12 | 4 | — | — | — | 56.2 | 0.25 | 5 |
| LYD360 | 68061.1 | 1.2 | 0.11 | 19 | — | — | — | 65.1 | 0.02 | 22 |
| LYD360 | 68063.2 | 1.1 | 0.04 | 12 | — | — | — | 58.2 | 0.26 | 9 |
| LYD357 | 68228.1 | 1.1 | L | 9 | — | — | — | 57.8 | 0.20 | 8 |
| LYD354 | 68133.4 | 1.1 | 0.12 | 12 | — | — | — | 61.7 | 0.11 | 16 |
| LYD354 | 68133.6 | 1.1 | 0.14 | 8 | — | — | — | — | — | — |
| LYD349 | 68085.5 | 1.4 | 0.11 | 38 | 9.8 | 0.25 | 3 | 76.9 | 0.08 | 44 |
| LYD308 | 66881.2 | 1.1 | 0.25 | 14 | 9.9 | 0.22 | 3 | 63.2 | 0.02 | 18 |
| LYD295 | 67972.2 | — | — | — | 10.0 | 0.07 | 5 | 63.3 | 0.17 | 18 |
| LYD295 | 67972.4 | — | — | — | — | — | — | 61.8 | 0.20 | 16 |
| CONT. | — | 1.0 | — | — | 9.6 | — | — | 53.4 | — | — |
| LYD513 | 67217.3 | 0.9 | L | 19 | — | — | — | 49.3 | L | 22 |
| LYD512 | 67209.1 | 0.8 | 0.27 | 11 | — | — | — | — | — | — |
| LYD482 | 67334.1 | 0.8 | 0.26 | 11 | — | — | — | — | — | — |
| LYD482 | 67336.1 | 0.8 | 0.19 | 8 | — | — | — | — | — | — |
| LYD475 | 67204.4 | 0.8 | L | 13 | — | — | — | 47.9 | L | 18 |
| LYD472 | 67332.1 | 0.9 | 0.09 | 19 | — | — | — | 49.7 | 0.06 | 23 |
| LYD472 | 67332.4 | 0.9 | L | 23 | — | — | — | 49.9 | L | 23 |
| LYD466 | 67121.1 | 0.9 | L | 17 | — | — | — | 49.0 | L | 21 |
| LYD452 | 67106.2 | 0.8 | 0.20 | 5 | — | — | — | 43.4 | 0.20 | 7 |
| LYD451 | 67187.9 | 0.8 | 0.10 | 6 | — | — | — | 43.8 | 0.09 | 8 |
| LYD451 | 67188.1 | 0.8 | 0.30 | 10 | — | — | — | — | — | — |
| LYD451 | 67188.4 | 0.8 | 0.14 | 13 | — | — | — | 47.5 | 0.07 | 17 |
| LYD445 | 67352.3 | — | — | — | 9.8 | 0.27 | 2 | — | — | — |
| LYD445 | 67353.1 | 0.8 | 0.20 | 7 | — | — | — | 43.5 | 0.27 | 7 |
| LYD445 | 67353.2 | 0.8 | L | 12 | — | — | — | 46.8 | L | 16 |
| LYD445 | 67354.5 | — | — | — | — | — | — | 42.7 | 0.29 | 6 |
| LYD439 | 67094.1 | 0.8 | 0.17 | 12 | — | — | — | — | — | — |
| LYD439 | 67094.3 | 0.8 | 0.29 | 10 | — | — | — | 47.2 | 0.06 | 17 |
| LYD439 | 67095.6 | 0.8 | L | 12 | — | — | — | 45.9 | 0.02 | 13 |
| LYD415 | 67262.1 | 0.8 | 0.07 | 9 | — | — | — | 44.7 | 0.21 | 11 |
| LYD415 | 67264.5 | — | — | — | — | — | — | 43.5 | 0.13 | 7 |
| LYD415 | 67266.6 | 0.8 | 0.28 | 7 | — | — | — | — | — | — |
| LYD382 | 67174.1 | 0.8 | 0.30 | 15 | — | — | — | 45.8 | 0.19 | 13 |
| LYD382 | 67175.2 | 0.9 | 0.10 | 16 | — | — | — | 47.4 | 0.16 | 17 |
| LYD339 | 67247.3 | 0.8 | 0.11 | 6 | — | — | — | — | — | — |
| LYD324 | 67167.1 | — | — | — | 9.8 | 0.17 | 2 | — | — | — |
| LYD321 | 67280.1 | — | — | — | 9.9 | 0.07 | 3 | — | — | — |
| LYD321 | 67283.1 | 0.8 | L | 14 | — | — | — | 47.8 | 0.01 | 18 |
| LYD321 | 67283.3 | 0.8 | 0.16 | 9 | — | — | — | — | — | — |
| LYD321 | 67283.4 | 1.0 | 0.10 | 34 | — | — | — | 55.2 | 0.04 | 36 |
| LYD302 | 67414.3 | 0.9 | L | 16 | — | — | — | 46.2 | 0.03 | 14 |
| LYD302 | 67416.3 | 0.8 | 0.03 | 13 | — | — | — | 45.5 | 0.02 | 12 |
| LYD296 | 67358.6 | 0.9 | 0.24 | 21 | — | — | — | 50.1 | 0.14 | 24 |
| LYD296 | 67360.4 | — | — | — | 9.8 | 0.17 | 2 | — | — | — |
| LYD290 | 67233.3 | 0.8 | 0.26 | 4 | — | — | — | — | — | — |
| CONT. | — | 0.7 | — | — | 9.6 | — | — | 40.5 | — | — |
| LYD517 | 67221.3 | — | — | — | — | — | — | 30.1 | 0.14 | 6 |
| LYD517 | 67222.1 | 0.6 | 0.22 | 14 | — | — | — | — | — | — |
| LYD515 | 67151.1 | 0.6 | 0.01 | 18 | — | — | — | 33.3 | 0.08 | 17 |
| LYD515 | 67152.4 | 0.7 | L | 26 | — | — | — | 36.7 | L | 29 |
| LYD502 | 67340.4 | 0.6 | 0.19 | 9 | — | — | — | 31.9 | 0.09 | 13 |
| LYD502 | 67341.5 | 0.6 | 0.04 | 15 | 9.6 | 0.07 | 5 | 32.6 | 0.04 | 15 |
| LYD502 | 67342.1 | — | — | — | 9.4 | 0.16 | 2 | — | — | — |
| LYD502 | 67342.6 | 0.6 | 0.14 | 9 | — | — | — | 31.5 | 0.02 | 11 |
| LYD498 | 67252.3 | 0.6 | 0.04 | 15 | 9.4 | 0.16 | 2 | 33.3 | L | 17 |
| LYD498 | 67254.1 | 0.6 | 0.06 | 14 | — | — | — | 31.2 | 0.06 | 10 |
| LYD498 | 67254.3 | 0.6 | 0.03 | 15 | — | — | — | 32.9 | 0.01 | 16 |
| LYD492 | 67364.5 | 0.6 | 0.24 | 13 | — | — | — | 31.6 | 0.20 | 11 |
| LYD474 | 67196.1 | 0.6 | 0.26 | 12 | — | — | — | — | — | — |
| LYD474 | 67199.1 | 0.6 | 0.23 | 10 | 9.5 | 0.15 | 4 | 30.8 | 0.05 | 9 |
| LYD454 | 67192.5 | 0.6 | 0.04 | 19 | — | — | — | 33.5 | 0.02 | 18 |
| LYD450 | 67178.3 | 0.6 | 0.10 | 13 | 9.9 | 0.16 | 8 | 32.5 | 0.02 | 14 |
| LYD450 | 67180.2 | — | — | — | — | — | — | 31.6 | 0.27 | 11 |
| LYD450 | 67182.2 | 0.6 | 0.01 | 18 | 9.6 | 0.03 | 4 | 33.5 | 0.01 | 18 |
| LYD428 | 67474.4 | — | — | — | 9.6 | 0.22 | 4 | — | — | — |
| LYD397 | 67322.1 | — | — | — | — | — | — | 30.1 | 0.28 | 6 |

TABLE 57-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYD397 | 67324.2 | 0.7 | L | 29 | — | — | — | 36.3 | 0.04 | 28 |
| LYD323 | 67286.1 | 0.6 | 0.19 | 13 | — | — | — | 33.0 | 0.29 | 16 |
| LYD323 | 67287.3 | 0.6 | 0.04 | 15 | — | — | — | 32.8 | L | 16 |
| LYD312 | 67256.4 | 0.7 | 0.06 | 28 | 9.8 | 0.04 | 6 | 37.0 | 0.08 | 30 |
| LYD312 | 67256.5 | 0.6 | 0.03 | 15 | — | — | — | 32.9 | L | 16 |
| LYD310 | 67161.1 | 0.6 | 0.22 | 8 | — | — | — | 31.7 | 0.04 | 12 |
| LYD310 | 67164.1 | — | — | — | — | — | — | 30.5 | 0.08 | 7 |
| LYD301 | 67347.2 | 0.7 | 0.05 | 28 | — | — | — | 35.5 | 0.01 | 25 |
| LYD301 | 67347.4 | 0.6 | 0.10 | 12 | 9.6 | 0.03 | 4 | 31.7 | 0.13 | 12 |
| LYD298 | 66964.4 | 0.6 | 0.02 | 21 | 9.4 | 0.16 | 2 | 35.3 | 0.15 | 24 |
| LYD298 | 66966.2 | 0.6 | 0.06 | 12 | — | — | — | 32.7 | L | 15 |
| LYD291 | 67400.2 | — | — | — | 9.6 | 0.22 | 4 | — | — | — |
| LYD291 | 67402.2 | 0.6 | 0.14 | 11 | — | — | — | — | — | — |
| CONT. | — | 0.5 | — | — | 9.2 | — | — | 28.4 | — | — |
| LYD508 | 67823.1 | — | — | — | 9.9 | 0.26 | 4 | — | — | — |
| LYD508 | 67823.2 | 0.8 | 0.15 | 8 | — | — | — | 44.8 | 0.13 | 7 |
| LYD508 | 67824.3 | 0.9 | L | 16 | 10.2 | 0.10 | 6 | 49.5 | 0.08 | 18 |
| LYD503 | 67527.1 | — | — | — | 10.2 | 0.01 | 6 | — | — | — |
| LYD501 | 67887.3 | — | — | — | 10.1 | 0.21 | 6 | — | — | — |
| LYD497 | 67880.3 | — | — | — | 10.2 | 0.10 | 6 | — | — | — |
| LYD497 | 67881.4 | — | — | — | 9.8 | 0.23 | 2 | — | — | — |
| LYD497 | 67883.2 | — | — | — | 10.0 | 0.05 | 4 | — | — | — |
| LYD497 | 67883.4 | 0.8 | 0.03 | 9 | — | — | — | 46.0 | 0.03 | 10 |
| LYD479 | 67727.4 | 0.9 | 0.08 | 20 | 10.1 | 0.05 | 6 | 53.6 | 0.21 | 28 |
| LYD448 | 67917.2 | — | — | — | 9.9 | 0.22 | 3 | — | — | — |
| LYD441 | 67715.4 | — | — | — | 9.9 | 0.22 | 3 | — | — | — |
| LYD428 | 67473.3 | 0.9 | L | 21 | 10.3 | 0.21 | 8 | 54.1 | L | 29 |
| LYD428 | 67474.4 | 0.8 | 0.08 | 8 | — | — | — | — | — | — |
| CONT. | — | 0.7 | — | — | 9.6 | — | — | 42.0 | — | — |
| LYD484 | 67135.2 | 1.0 | 0.08 | 7 | — | — | — | — | — | — |
| LYD484 | 67135.3 | 1.0 | 0.21 | 5 | — | — | — | 64.6 | 0.05 | 6 |
| LYD470 | 67126.7 | 1.1 | 0.06 | 17 | — | — | — | 72.5 | L | 20 |
| LYD470 | 67127.3 | — | — | — | — | — | — | 61.9 | 0.25 | 2 |
| LYD459 | 67116.4 | 1.0 | 0.22 | 5 | — | — | — | — | — | — |
| LYD414 | 67089.4 | 1.0 | L | 7 | — | — | — | — | — | — |
| LYD414 | 67091.1 | 1.0 | 0.25 | 4 | — | — | — | — | — | — |
| LYD387 | 67317.4 | 1.1 | L | 16 | 11.8 | 0.17 | 7 | 75.4 | 0.06 | 24 |
| LYD347 | 67845.1 | 1.0 | 0.27 | 3 | — | — | — | — | — | — |
| LYD347 | 67848.2 | 1.0 | 0.04 | 7 | — | — | — | — | — | — |
| LYD341 | 67054.2 | 1.0 | 0.16 | 3 | — | — | — | — | — | — |
| LYD338 | 67442.3 | 1.1 | L | 15 | 11.5 | 0.25 | 4 | 73.2 | 0.12 | 21 |
| LYD337 | 66994.3 | 1.0 | 0.29 | 4 | — | — | — | 62.8 | 0.12 | 4 |
| LYD337 | 66995.5 | — | — | — | — | — | — | 65.5 | 0.23 | 8 |
| LYD322 | 66884.2 | 1.0 | L | 13 | — | — | — | 68.6 | L | 13 |
| LYD322 | 66887.1 | — | — | — | — | — | — | 66.0 | 0.02 | 9 |
| LYD307 | 66975.3 | — | — | — | — | — | — | 65.0 | 0.05 | 7 |
| LYD307 | 66975.4 | 1.0 | 0.02 | 6 | — | — | — | — | — | — |
| LYD307 | 66976.3 | 1.0 | L | 7 | — | — | — | — | — | — |
| LYD307 | 66977.3 | 1.0 | 0.07 | 13 | — | — | — | 69.9 | 0.13 | 15 |
| LYD303 | 67300.6 | 1.0 | 0.14 | 4 | — | — | — | — | — | — |
| LYD293 | 66958.1 | 1.0 | 0.09 | 4 | — | — | — | — | — | — |
| CONT. | — | 0.9 | — | — | 11.0 | — | — | 60.7 | — | — |
| LYD410 | 67546.3 | — | — | — | 10.8 | 0.12 | 11 | — | — | — |
| LYD409 | 67467.5 | 0.8 | 0.01 | 8 | — | — | — | — | — | — |
| LYD409 | 67468.1 | 0.8 | 0.21 | 6 | — | — | — | — | — | — |
| LYD405 | 67694.4 | — | — | — | 10.1 | 0.10 | 3 | — | — | — |
| LYD405 | 67697.2 | — | — | — | 9.9 | 0.28 | 2 | — | — | — |
| LYD379 | 67678.1 | 0.8 | 0.02 | 8 | 10.1 | 0.10 | 3 | 51.1 | 0.13 | 11 |
| LYD372 | 67673.3 | — | — | — | 10.1 | 0.12 | 4 | — | — | — |
| LYD348 | 67850.1 | — | — | — | 10.0 | 0.16 | 3 | — | — | — |
| LYD335 | 67558.2 | — | — | — | 10.1 | 0.28 | 3 | — | — | — |
| CONT. | — | 0.8 | — | — | 9.7 | — | — | 45.9 | — | — |
| LYD489 | 67785.4 | 1.0 | L | 13 | — | — | — | 52.0 | 0.18 | 6 |
| LYD489 | 67787.3 | — | — | — | 9.5 | L | 6 | — | — | — |
| LYD483 | 68056.5 | 1.0 | 0.25 | 6 | — | — | — | — | — | — |
| LYD472 | 67330.6 | 1.0 | 0.02 | 8 | — | — | — | — | — | — |
| LYD472 | 67332.4 | 1.0 | 0.03 | 12 | — | — | — | 54.0 | 0.18 | 10 |
| LYD456 | 67964.1 | — | — | — | 9.4 | 0.17 | 5 | — | — | — |
| LYD456 | 67966.3 | 1.0 | 0.07 | 6 | — | — | — | 53.4 | 0.06 | 8 |
| LYD456 | 67967.4 | 0.9 | 0.25 | 4 | 9.3 | 0.26 | 4 | 51.5 | 0.14 | 5 |
| LYD423 | 68216.3 | — | — | — | 9.2 | 0.19 | 3 | — | — | — |
| LYD423 | 68218.3 | — | — | — | 9.4 | 0.17 | 5 | — | — | — |

TABLE 57-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYD422 | 68103.3 | 1.0 | 0.16 | 11 | — | — | — | — | — | — |
| LYD422 | 68103.4 | 1.0 | 0.01 | 9 | — | — | — | — | — | — |
| LYD417 | 68042.2 | — | — | — | 9.4 | 0.17 | 5 | — | — | — |
| LYD417 | 68043.1 | 0.9 | 0.10 | 5 | — | — | — | — | — | — |
| LYD417 | 68043.5 | 1.0 | 0.23 | 6 | — | — | — | — | — | — |
| LYD392 | 68032.2 | 1.0 | 0.12 | 15 | — | — | — | 53.4 | 0.21 | 8 |
| LYD392 | 68033.3 | 1.0 | 0.13 | 16 | 9.4 | 0.09 | 5 | 58.1 | L | 18 |
| LYD392 | 68035.1 | 1.0 | 0.29 | 8 | — | — | — | — | — | — |
| LYD376 | 68025.1 | — | — | — | 9.2 | 0.15 | 3 | — | — | — |
| LYD376 | 68025.3 | — | — | — | 9.1 | 0.24 | 2 | — | — | — |
| LYD376 | 68026.5 | — | — | — | 9.2 | 0.15 | 3 | — | — | — |
| LYD365 | 68092.4 | 1.0 | 0.02 | 8 | — | — | — | 52.8 | 0.13 | 7 |
| LYD365 | 68092.5 | 1.1 | 0.08 | 16 | 9.6 | 0.12 | 7 | 57.9 | 0.22 | 18 |
| LYD365 | 68093.2 | 1.0 | 0.07 | 15 | 9.2 | 0.06 | 3 | 53.3 | 0.17 | 8 |
| LYD359 | 67946.3 | 1.0 | 0.01 | 10 | 9.2 | 0.19 | 3 | 51.7 | 0.29 | 5 |
| LYD359 | 67947.2 | 1.0 | 0.19 | 8 | — | — | — | — | — | — |
| LYD359 | 67949.4 | — | — | — | 9.7 | 0.22 | 8 | — | — | — |
| LYD351 | 68126.2 | 1.0 | L | 14 | — | — | — | 55.8 | L | 13 |
| LYD351 | 68129.3 | 1.0 | 0.04 | 7 | — | — | — | — | — | — |
| LYD351 | 68129.5 | 1.0 | 0.26 | 10 | — | — | — | 52.4 | 0.14 | 6 |
| LYD306 | 66971.1 | 1.0 | L | 13 | — | — | — | 56.4 | L | 14 |
| LYD299 | 68115.4 | — | — | — | 9.4 | 0.09 | 5 | — | — | — |
| LYD299 | 68115.7 | 1.1 | L | 21 | — | — | — | 57.4 | L | 17 |
| CONT. | — | 0.9 | — | — | 9.0 | — | — | 49.2 | — | — |
| LYD506 | 67144.2 | 1.0 | 0.02 | 16 | 11.4 | 0.26 | 6 | 67.1 | 0.01 | 19 |
| LYD506 | 67146.2 | 1.1 | 0.19 | 18 | 11.8 | 0.30 | 8 | 70.2 | 0.10 | 24 |
| LYD504 | 67136.2 | 1.0 | 0.23 | 7 | 11.5 | 0.30 | 6 | 63.0 | 0.04 | 12 |
| LYD504 | 67136.3 | 1.0 | 0.04 | 15 | 12.2 | 0.02 | 12 | 69.6 | L | 23 |
| LYD504 | 67138.1 | — | — | — | — | — | — | 62.5 | 0.16 | 11 |
| LYD504 | 67139.1 | 1.0 | 0.02 | 17 | 11.6 | L | 7 | 69.0 | 0.02 | 22 |
| LYD504 | 67140.1 | — | — | — | 11.4 | 0.05 | 5 | 61.8 | 0.13 | 9 |
| LYD466 | 67119.4 | 1.0 | 0.13 | 8 | — | — | — | 61.0 | 0.24 | 8 |
| LYD442 | 67104.3 | 1.0 | 0.14 | 15 | 11.4 | 0.22 | 5 | 69.3 | 0.20 | 23 |
| LYD440 | 66902.1 | 1.0 | 0.12 | 12 | — | — | — | 66.3 | 0.08 | 17 |
| LYD440 | 66902.2 | 1.0 | 0.06 | 12 | 11.1 | 0.20 | 2 | 65.6 | 0.08 | 16 |
| LYD440 | 66905.1 | — | — | — | 11.1 | 0.20 | 2 | — | — | — |
| LYD440 | 66906.1 | 1.0 | 0.06 | 12 | 11.3 | 0.02 | 4 | 67.4 | L | 19 |
| LYD432 | 67959.2 | 1.0 | 0.14 | 15 | 11.4 | 0.26 | 6 | 69.2 | 0.22 | 22 |
| LYD432 | 67961.2 | 1.0 | 0.07 | 11 | — | — | — | 67.5 | L | 19 |
| LYD425 | 67454.3 | — | — | — | 11.6 | L | 7 | 62.8 | 0.05 | 11 |
| LYD425 | 67454.5 | 1.0 | 0.24 | 11 | — | — | — | 64.7 | 0.15 | 15 |
| LYD408 | 67304.1 | 1.1 | 0.01 | 19 | 11.8 | L | 8 | 74.3 | L | 32 |
| LYD408 | 67305.6 | 1.1 | L | 23 | — | — | — | 74.5 | 0.07 | 32 |
| LYD408 | 67306.2 | 1.0 | 0.13 | 9 | 11.4 | 0.10 | 6 | 63.4 | 0.09 | 12 |
| LYD401 | 67084.2 | 1.0 | 0.11 | 9 | — | — | — | 60.9 | 0.17 | 8 |
| LYD375 | 67070.2 | 1.0 | 0.26 | 9 | — | — | — | 64.0 | 0.05 | 13 |
| LYD375 | 67073.2 | 1.1 | 0.02 | 19 | — | — | — | 65.9 | 0.03 | 17 |
| LYD342 | 67059.4 | 1.0 | 0.07 | 11 | — | — | — | 64.0 | 0.03 | 13 |
| LYD342 | 67062.1 | 1.0 | 0.01 | 18 | 12.0 | 0.16 | 11 | 72.6 | L | 28 |
| LYD329 | 67275.1 | — | — | — | — | — | — | 59.6 | 0.26 | 6 |
| LYD329 | 67277.4 | — | — | — | — | — | — | 65.4 | 0.04 | 16 |
| LYD320 | 67040.2 | — | — | — | 11.6 | L | 7 | 59.7 | 0.24 | 6 |
| LYD320 | 67043.1 | 1.0 | 0.20 | 7 | — | — | — | 60.1 | 0.20 | 6 |
| LYD318 | 66980.3 | — | — | — | — | — | — | 60.8 | 0.14 | 8 |
| LYD318 | 66980.5 | — | — | — | — | — | — | 62.6 | 0.08 | 11 |
| LYD318 | 66982.1 | — | — | — | 11.6 | L | 7 | 63.8 | 0.03 | 13 |
| LYD318 | 66983.4 | 1.0 | 0.03 | 15 | 12.3 | 0.08 | 14 | 70.6 | L | 25 |
| LYD316 | 67436.1 | 1.0 | 0.24 | 11 | 11.7 | 0.05 | 8 | 64.7 | 0.02 | 14 |
| LYD316 | 67437.2 | 1.0 | 0.05 | 12 | — | — | — | 65.1 | 0.02 | 15 |
| LYD316 | 67439.1 | 1.0 | 0.01 | 17 | 11.8 | 0.10 | 8 | 69.6 | L | 23 |
| LYD298 | 66963.4 | — | — | — | 11.8 | 0.21 | 8 | — | — | — |
| LYD292 | 66998.3 | 1.0 | 0.01 | 17 | 11.6 | 0.01 | 7 | 68.3 | L | 21 |
| LYD292 | 66999.2 | 1.1 | 0.04 | 24 | 11.6 | 0.13 | 7 | 74.8 | 0.05 | 32 |
| LYD292 | 66999.4 | 1.0 | 0.16 | 12 | — | — | — | 64.7 | 0.14 | 15 |
| LYD292 | 67000.1 | 1.1 | 0.02 | 21 | — | — | — | 75.6 | 0.01 | 34 |
| CONT. | — | 0.9 | — | — | 10.8 | — | — | 56.5 | — | — |
| LYD362 | 67543.5 | 0.75 | 0.12 | 10.2 | — | — | — | — | — | — |
| LYD362 | 67541.3 | 0.75 | 0.13 | 10 | — | — | — | — | — | — |
| LYD362 | 67538.2 | 0.74 | 0.15 | 9.3 | — | — | — | — | — | — |
| LYD362 | 67543.3 | 0.72 | 0.32 | 6.3 | — | — | — | — | — | — |
| LYD362 | 67543.6 | 0.72 | 0.34 | 6.1 | — | — | — | — | — | — |
| LYD366 | 67810.1 | 0.74 | 0.18 | 8.5 | — | — | — | — | — | — |

TABLE 57-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYD366 | 67812.5 | 0.73 | 0.29 | 6.8 | — | — | — | — | — | — |
| LYD386 | 67860.3 | 0.71 | 0.47 | 4.5 | — | — | — | — | — | — |
| LYD386 | 67856.1 | 0.71 | 0.50 | 4.2 | — | — | — | — | — | — |
| CONT. | — | 0.68 | — | — | — | — | — | — | — | — |
| LYD362 | 67543.5 | 0.74 | 0.06 | 12.3 | — | — | — | — | — | — |
| LYD362 | 67541.3 | 0.74 | 0.06 | 12.2 | — | — | — | — | — | — |
| LYD362 | 67538.2 | 0.74 | 0.07 | 12.0 | — | — | — | — | — | — |
| LYD362 | 67543.3 | 0.73 | 0.11 | 10.6 | — | — | — | — | — | — |
| LYD362 | 67543.6 | 0.73 | 0.11 | 10.5 | — | — | — | — | — | — |
| LYD366 | 67810.1 | 0.72 | 0.16 | 9.2 | — | — | — | — | — | — |
| LYD366 | 67812.5 | 0.72 | 0.19 | 8.4 | — | — | — | — | — | — |
| LYD366 | 67808.2 | 0.71 | 0.27 | 7.0 | — | — | — | — | — | — |
| LYD366 | 67812.1 | 0.70 | 0.33 | 6.1 | — | — | — | — | — | — |
| LYD366 | 67810.4 | 0.70 | 0.38 | 5.6 | — | — | — | — | — | — |
| LYD386 | 67860.3 | 0.70 | 0.39 | 5.3 | — | — | — | — | — | — |
| LYD386 | 67856.1 | 0.69 | 0.41 | 5.2 | — | — | — | — | — | — |
| CONT. | — | 0.66 | — | — | — | — | — | — | — | — |
| LYD434 | 67978.2 | — | — | — | 9.7 | 0.22 | 3.1 | — | — | — |
| LYD434 | 67977.3 | — | — | — | 9.6 | 0.32 | 2.1 | — | — | — |
| CONT. | — | — | — | — | 9.4 | — | — | — | — | — |

Table 57.
"CONT."—Control;
"Ave."—Average;
"% Incr." = % increment;
"p-val."—p-value,
L—p < 0.01.
The transgenes were under the transcriptional regulation of the new At6669 promoter (SEQ ID NO: 14467).
"—" = results are still unavailable.

TABLE 58

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD446 | 68109.4 | — | — | — | 8.2 | 0.23 | 15 | 0.5 | 0.16 | 9 |
| LYD446 | 68110.1 | — | — | — | 8.4 | 0.13 | 18 | — | — | — |
| LYD443 | 68163.1 | — | — | — | 8.3 | 0.15 | 16 | 0.5 | 0.14 | 8 |
| LYD443 | 68164.2 | — | — | — | 8.7 | 0.07 | 21 | 0.5 | 0.13 | 8 |
| LYD443 | 68165.3 | — | — | — | 8.4 | 0.11 | 18 | 0.5 | 0.05 | 11 |
| LYD436 | 68073.1 | — | — | — | — | — | — | 0.5 | 0.26 | 7 |
| LYD436 | 68073.3 | — | — | — | 8.7 | 0.07 | 22 | 0.5 | 0.20 | 7 |
| LYD436 | 68075.3 | — | — | — | 8.9 | 0.07 | 24 | 0.5 | 0.09 | 12 |
| LYD416 | 67904.3 | 0.7 | 0.29 | 16 | — | — | — | — | — | — |
| LYD416 | 67907.6 | — | — | — | — | — | — | 0.5 | 0.22 | 7 |
| LYD391 | 68160.4 | — | — | — | 9.2 | 0.02 | 29 | 0.5 | 0.01 | 15 |
| LYD388 | 68096.2 | — | — | — | 8.5 | 0.09 | 19 | 0.5 | 0.09 | 9 |
| LYD388 | 68098.2 | — | — | — | 9.3 | 0.01 | 30 | 0.5 | 0.02 | 12 |
| LYD388 | 68098.3 | — | — | — | — | — | — | 0.5 | 0.18 | 7 |
| LYD388 | 68098.4 | — | — | — | 8.7 | 0.08 | 22 | 0.5 | 0.14 | 9 |
| LYD367 | 68066.1 | — | — | — | 8.1 | 0.28 | 14 | 0.5 | 0.19 | 9 |
| LYD367 | 68066.5 | — | — | — | 9.2 | 0.02 | 29 | 0.5 | 0.02 | 13 |
| LYD367 | 68066.6 | — | — | — | 8.5 | 0.15 | 19 | 0.5 | 0.20 | 8 |
| LYD367 | 68068.5 | — | — | — | 8.4 | 0.16 | 17 | 0.5 | 0.15 | 8 |
| LYD364 | 68018.3 | — | — | — | 8.2 | 0.23 | 15 | 0.5 | 0.10 | 10 |
| LYD364 | 68018.4 | — | — | — | 8.1 | 0.22 | 14 | 0.5 | 0.12 | 9 |
| LYD364 | 68020.5 | — | — | — | 9.8 | L | 37 | 0.5 | 0.03 | 12 |
| LYD364 | 68022.1 | — | — | — | 8.3 | 0.15 | 16 | — | — | — |
| LYD360 | 68061.1 | — | — | — | 8.7 | 0.06 | 22 | 0.5 | 0.02 | 12 |
| LYD360 | 68061.2 | — | — | — | — | — | — | 0.5 | 0.26 | 6 |
| LYD360 | 68063.1 | — | — | — | — | — | — | 0.5 | 0.24 | 6 |
| LYD357 | 68228.1 | — | — | — | — | — | — | 0.5 | 0.13 | 8 |
| LYD354 | 68133.4 | — | — | — | 8.2 | 0.22 | 14 | — | — | — |
| LYD354 | 68133.6 | — | — | — | 8.0 | 0.29 | 12 | — | — | — |

TABLE 58-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD354 | 68134.8 | — | — | — | 8.2 | 0.21 | 15 | — | — | — |
| LYD349 | 68085.5 | — | — | — | 10.3 | L | 45 | 0.5 | 0.02 | 12 |
| LYD308 | 66881.2 | — | — | — | 8.4 | 0.12 | 18 | — | — | — |
| LYD295 | 67972.2 | — | — | — | 8.5 | 0.11 | 19 | 0.5 | 0.03 | 12 |
| LYD295 | 67972.4 | — | — | — | 8.2 | 0.18 | 15 | — | — | — |
| CONT. | — | 0.6 | — | — | 7.1 | — | — | 0.5 | — | — |
| LYD513 | 67217.3 | — | — | — | 6.0 | 0.05 | 22 | 0.4 | 0.06 | 10 |
| LYD512 | 67209.1 | — | — | — | 5.6 | 0.26 | 13 | 0.3 | 0.28 | 7 |
| LYD512 | 67209.4 | — | — | — | — | — | — | 0.3 | 0.27 | 6 |
| LYD482 | 67334.1 | — | — | — | — | — | — | 0.3 | 0.28 | 6 |
| LYD475 | 67204.4 | — | — | — | 5.9 | 0.08 | 19 | 0.4 | 0.04 | 11 |
| LYD472 | 67332.1 | — | — | — | 6.1 | 0.04 | 23 | 0.4 | 0.05 | 11 |
| LYD472 | 67332.3 | — | — | — | — | — | — | 0.3 | 0.26 | 7 |
| LYD472 | 67332.4 | — | — | — | 6.1 | 0.04 | 23 | 0.3 | 0.14 | 8 |
| LYD466 | 67121.1 | — | — | — | 5.9 | 0.07 | 20 | 0.4 | 0.06 | 10 |
| LYD451 | 67187.7 | — | — | — | — | — | — | 0.3 | 0.19 | 7 |
| LYD451 | 67188.1 | — | — | — | 5.8 | 0.13 | 18 | 0.4 | 0.02 | 14 |
| LYD451 | 67188.4 | — | — | — | 5.8 | 0.12 | 17 | 0.3 | 0.26 | 6 |
| LYD445 | 67353.2 | — | — | — | 5.6 | 0.19 | 14 | 0.3 | 0.26 | 6 |
| LYD439 | 67094.1 | — | — | — | 5.5 | 0.26 | 12 | 0.3 | 0.23 | 8 |
| LYD439 | 67094.3 | — | — | — | 5.8 | 0.12 | 18 | 0.3 | 0.13 | 8 |
| LYD439 | 67095.6 | — | — | — | 5.6 | 0.22 | 13 | — | — | — |
| LYD415 | 67266.6 | — | — | — | — | — | — | 0.3 | 0.27 | 7 |
| LYD382 | 67174.1 | — | — | — | 5.6 | 0.20 | 14 | — | — | — |
| LYD382 | 67175.2 | — | — | — | 5.7 | 0.15 | 16 | — | — | — |
| LYD382 | 67176.3 | — | — | — | — | — | — | 0.3 | 0.14 | 9 |
| LYD324 | 67167.1 | — | — | — | — | — | — | 0.3 | 0.23 | 7 |
| LYD321 | 67280.1 | — | — | — | — | — | — | 0.3 | 0.24 | 7 |
| LYD321 | 67283.1 | — | — | — | 5.8 | 0.10 | 18 | 0.4 | 0.09 | 9 |
| LYD321 | 67283.3 | — | — | — | — | — | — | 0.4 | 0.08 | 10 |
| LYD321 | 67283.4 | — | — | — | 6.8 | L | 37 | 0.4 | L | 16 |
| LYD302 | 67414.3 | — | — | — | 5.6 | 0.22 | 13 | 0.3 | 0.17 | 7 |
| LYD302 | 67416.3 | — | — | — | 5.6 | 0.20 | 14 | 0.4 | 0.09 | 9 |
| LYD296 | 67358.6 | — | — | — | 6.1 | 0.05 | 23 | 0.4 | 0.07 | 12 |
| LYD296 | 67359.3 | — | — | — | — | — | — | 0.3 | 0.25 | 6 |
| LYD296 | 67360.1 | — | — | — | — | — | — | 0.3 | 0.27 | 6 |
| CONT. | — | — | — | — | 4.9 | — | — | 0.3 | — | — |
| LYD517 | 67222.1 | — | — | — | 4.1 | 0.30 | 15 | 0.3 | 0.19 | 11 |
| LYD515 | 67151.1 | — | — | — | 4.2 | 0.20 | 18 | 0.4 | 0.11 | 12 |
| LYD515 | 67151.4 | — | — | — | — | — | — | 0.3 | 0.30 | 8 |
| LYD515 | 67152.4 | — | — | — | 4.7 | 0.04 | 31 | 0.4 | 0.05 | 15 |
| LYD502 | 67341.5 | — | — | — | 4.1 | 0.30 | 15 | 0.3 | 0.21 | 9 |
| LYD498 | 67252.3 | — | — | — | 4.2 | 0.20 | 18 | 0.3 | 0.20 | 9 |
| LYD498 | 67254.3 | — | — | — | 4.2 | 0.20 | 18 | 0.4 | 0.07 | 14 |
| LYD492 | 67364.5 | — | — | — | — | — | — | 0.3 | 0.28 | 8 |
| LYD454 | 67192.5 | — | — | — | 4.2 | 0.19 | 19 | — | — | — |
| LYD450 | 67178.3 | — | — | — | 4.1 | 0.29 | 15 | — | — | — |
| LYD450 | 67182.2 | — | — | — | 4.2 | 0.18 | 19 | 0.3 | 0.25 | 9 |
| LYD397 | 67324.2 | — | — | — | 4.6 | 0.05 | 29 | 0.4 | 0.08 | 14 |
| LYD323 | 67286.1 | — | — | — | 4.2 | 0.23 | 17 | 0.3 | 0.20 | 9 |
| LYD323 | 67287.3 | — | — | — | 4.2 | 0.22 | 18 | 0.3 | 0.24 | 9 |
| LYD323 | 67288.2 | — | — | — | 4.2 | 0.28 | 18 | — | — | — |
| LYD312 | 67256.4 | — | — | — | 4.6 | 0.05 | 30 | 0.3 | 0.21 | 9 |
| LYD312 | 67256.5 | — | — | — | 4.2 | 0.24 | 17 | — | — | — |
| LYD301 | 67347.2 | — | — | — | 4.5 | 0.06 | 28 | 0.4 | 0.01 | 20 |
| LYD298 | 66964.4 | — | — | — | 4.4 | 0.08 | 25 | 0.4 | 0.07 | 13 |
| LYD298 | 66966.2 | — | — | — | 4.1 | 0.29 | 15 | — | — | — |
| CONT. | — | — | — | — | 3.6 | — | — | 0.3 | — | — |
| LYD508 | 67824.3 | — | — | — | 5.8 | 0.11 | 19 | — | — | — |
| LYD479 | 67727.4 | — | — | — | 6.3 | 0.03 | 28 | 0.3 | 0.10 | 16 |
| LYD428 | 67473.3 | 0.8 | 0.20 | 17 | 6.4 | 0.02 | 31 | 0.3 | 0.07 | 17 |
| LYD346 | 67606.2 | — | — | — | 5.6 | 0.29 | 14 | — | — | — |
| CONT. | — | 0.6 | — | — | 4.9 | — | — | 0.3 | — | — |
| LYD470 | 67126.7 | — | — | — | 8.7 | 0.15 | 19 | 0.4 | 0.02 | 12 |
| LYD459 | 67116.4 | — | — | — | — | — | — | 0.4 | 0.24 | 6 |
| LYD387 | 67316.1 | — | — | — | — | — | — | 0.4 | 0.12 | 9 |
| LYD387 | 67317.4 | 0.8 | 0.25 | 12 | 9.3 | 0.04 | 26 | 0.4 | L | 15 |
| LYD347 | 67848.2 | — | — | — | — | — | — | 0.4 | 0.15 | 7 |
| LYD338 | 67442.3 | — | — | — | 9.0 | 0.09 | 22 | 0.4 | 0.02 | 12 |
| LYD337 | 66995.4 | — | — | — | — | — | — | 0.4 | 0.07 | 10 |
| LYD337 | 66995.5 | — | — | — | — | — | — | 0.4 | 0.10 | 8 |

TABLE 58-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD322 | 66884.1 | — | — | — | — | — | — | 0.4 | 0.24 | 6 |
| LYD322 | 66884.2 | — | — | — | 8.4 | 0.26 | 14 | 0.4 | 0.17 | 7 |
| LYD322 | 66886.6 | — | — | — | — | — | — | 0.4 | 0.12 | 8 |
| LYD322 | 66887.1 | — | — | — | — | — | — | 0.4 | 0.12 | 8 |
| LYD307 | 66975.3 | — | — | — | — | — | — | 0.4 | 0.11 | 8 |
| LYD307 | 66975.4 | — | — | — | — | — | — | 0.4 | 0.25 | 6 |
| LYD307 | 66976.3 | — | — | — | — | — | — | 0.4 | 0.12 | 8 |
| LYD307 | 66977.3 | — | — | — | 8.6 | 0.17 | 17 | 0.4 | 0.06 | 10 |
| LYD303 | 67298.1 | — | — | — | — | — | — | 0.4 | 0.20 | 7 |
| LYD303 | 67300.6 | — | — | — | — | — | — | 0.4 | 0.19 | 7 |
| CONT. | — | 0.7 | — | — | 7.4 | — | — | 0.4 | — | — |
| LYD410 | 67546.3 | 0.8 | 0.22 | 14 | — | — | — | — | — | — |
| LYD379 | 67678.1 | — | — | — | 6.1 | 0.29 | 12 | 0.3 | 0.25 | 9 |
| CONT. | — | 0.7 | — | — | 5.5 | — | — | 0.3 | — | — |
| LYD489 | 67787.3 | 0.7 | 0.14 | 24 | — | — | — | — | — | — |
| LYD483 | 68054.4 | 0.6 | 0.29 | 16 | — | — | — | — | — | — |
| LYD471 | 68050.2 | 0.7 | 0.20 | 22 | — | — | — | — | — | — |
| LYD456 | 67964.1 | 0.7 | 0.22 | 21 | — | — | — | — | — | — |
| LYD456 | 67967.4 | 0.6 | 0.24 | 19 | — | — | — | 0.5 | 0.17 | 11 |
| LYD423 | 68218.3 | 0.7 | 0.09 | 26 | — | — | — | — | — | — |
| LYD422 | 68103.4 | — | — | — | 7.3 | 0.28 | 13 | — | — | — |
| LYD392 | 68033.3 | — | — | — | 7.7 | 0.13 | 19 | — | — | — |
| LYD365 | 68092.5 | 0.6 | 0.24 | 19 | 7.7 | 0.13 | 19 | 0.5 | 0.14 | 12 |
| LYD359 | 67949.4 | 0.7 | 0.19 | 22 | — | — | — | — | — | — |
| LYD351 | 68126.2 | — | — | — | 7.4 | 0.24 | 14 | — | — | — |
| LYD306 | 66971.1 | — | — | — | 7.4 | 0.21 | 15 | — | — | — |
| LYD299 | 68115.7 | — | — | — | 7.6 | 0.15 | 18 | 0.5 | 0.28 | 8 |
| CONT. | — | 0.5 | — | — | 6.5 | — | — | 0.4 | — | — |
| LYD506 | 67144.2 | 0.8 | 0.25 | 10 | 8.3 | 0.10 | 22 | 0.4 | 0.25 | 9 |
| LYD506 | 67146.2 | — | — | — | 8.5 | 0.07 | 24 | — | — | — |
| LYD504 | 67136.2 | — | — | — | 7.8 | 0.26 | 14 | — | — | — |
| LYD504 | 67136.3 | 0.8 | 0.09 | 16 | 8.6 | 0.06 | 25 | 0.4 | 0.17 | 11 |
| LYD504 | 67139.1 | — | — | — | 8.4 | 0.08 | 23 | 0.4 | 0.18 | 11 |
| LYD442 | 67104.3 | — | — | — | 8.6 | 0.06 | 26 | — | — | — |
| LYD440 | 66902.1 | — | — | — | 8.1 | 0.16 | 19 | — | — | — |
| LYD440 | 66902.2 | — | — | — | 8.0 | 0.23 | 16 | 0.4 | 0.26 | 9 |
| LYD440 | 66906.1 | — | — | — | 8.2 | 0.15 | 20 | — | — | — |
| LYD432 | 67959.2 | — | — | — | 8.5 | 0.08 | 24 | 0.4 | 0.27 | 9 |
| LYD432 | 67961.2 | — | — | — | 8.3 | 0.12 | 21 | — | — | — |
| LYD425 | 67454.3 | 0.8 | 0.22 | 11 | 7.8 | 0.25 | 14 | — | — | — |
| LYD425 | 67454.5 | — | — | — | 8.0 | 0.21 | 16 | — | — | — |
| LYD408 | 67304.1 | 0.8 | 0.21 | 12 | 9.1 | 0.02 | 33 | 0.4 | 0.21 | 10 |
| LYD408 | 67305.6 | — | — | — | 9.0 | 0.02 | 32 | — | — | — |
| LYD401 | 67086.2 | — | — | — | 7.8 | 0.27 | 14 | — | — | — |
| LYD375 | 67070.2 | — | — | — | 8.0 | 0.19 | 17 | — | — | — |
| LYD375 | 67073.2 | — | — | — | 8.1 | 0.16 | 19 | — | — | — |
| LYD342 | 67059.4 | — | — | — | 7.9 | 0.22 | 16 | — | — | — |
| LYD342 | 67062.1 | — | — | — | 8.9 | 0.03 | 30 | — | — | — |
| LYD329 | 67277.4 | — | — | — | 8.0 | 0.18 | 17 | — | — | — |
| LYD320 | 67040.2 | 0.8 | 0.28 | 11 | — | — | — | — | — | — |
| LYD318 | 66980.7 | — | — | — | 7.8 | 0.29 | 14 | — | — | — |
| LYD318 | 66982.1 | — | — | — | 7.9 | 0.25 | 15 | — | — | — |
| LYD318 | 66983.4 | — | — | — | 8.6 | 0.06 | 25 | — | — | — |
| LYD316 | 67436.1 | 0.8 | 0.11 | 15 | 8.1 | 0.17 | 18 | — | — | — |
| LYD316 | 67437.2 | — | — | — | 8.1 | 0.18 | 18 | 0.4 | 0.29 | 8 |
| LYD316 | 67439.1 | 0.8 | 0.15 | 14 | 8.5 | 0.07 | 24 | — | — | — |
| LYD298 | 66963.4 | 0.9 | 0.07 | 18 | 7.9 | 0.28 | 15 | — | — | — |
| LYD292 | 66998.3 | — | — | — | 8.4 | 0.09 | 22 | — | — | — |
| LYD292 | 66999.2 | — | — | — | 9.2 | 0.01 | 34 | 0.4 | 0.26 | 9 |
| LYD292 | 66999.4 | — | — | — | 8.0 | 0.21 | 17 | — | — | — |

TABLE 58-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD292 | 67000.1 | — | — | — | 9.3 | 0.01 | 36 | 0.4 | 0.27 | 9 |
| CONT. | — | 0.7 | — | — | 6.9 | — | — | 0.4 | — | — |

Table 58.
"CONT."—Control;
"Ave."—Average;
"% Incr." = % increment;
"p-val."—p-value,
L—p < 0.01.
RGR = relative growth rate.
The transgenes were under the transcriptional regulation of the new At6669 promoter (SEQ ID NO: 14467).
"—" = results are still unavailable.

TABLE 59

Genes showing improved plant performance at Normal growth conditions under regulation of At6669 promoter

| Gene Name | Event # | Harvest Index | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD446 | 68109.4 | — | — | — | — | — | — | 5.0 | 0.26 | 8 |
| LYD446 | 68110.1 | — | — | — | 7.9 | 0.03 | 18 | 4.9 | 0.03 | 6 |
| LYD443 | 68163.1 | — | — | — | 7.8 | 0.14 | 17 | 5.0 | 0.13 | 8 |
| LYD443 | 68164.2 | — | — | — | 8.0 | 0.12 | 20 | 5.0 | L | 7 |
| LYD443 | 68165.3 | — | — | — | 7.9 | L | 18 | 5.1 | L | 9 |
| LYD436 | 68073.3 | — | — | — | 8.0 | 0.02 | 21 | 5.0 | L | 6 |
| LYD416 | 67904.3 | — | — | — | 7.1 | 0.03 | 6 | 4.7 | 0.29 | 1 |
| LYD416 | 67907.6 | — | — | — | — | — | — | 4.7 | 0.24 | 1 |
| LYD391 | 68156.4 | — | — | — | 7.2 | L | 9 | 4.8 | 0.12 | 3 |
| LYD391 | 68160.4 | — | — | — | 8.6 | 0.09 | 28 | 5.3 | 0.14 | 13 |
| LYD388 | 68096.2 | — | — | — | 7.9 | L | 19 | 5.0 | L | 8 |
| LYD388 | 68098.2 | — | — | — | 8.6 | L | 29 | 5.2 | L | 12 |
| LYD388 | 68098.3 | — | — | — | 7.2 | 0.14 | 9 | 4.9 | 0.22 | 5 |
| LYD388 | 68098.4 | — | — | — | — | — | — | 5.1 | 0.17 | 9 |
| LYD367 | 68066.5 | — | — | — | 8.6 | 0.14 | 29 | 5.2 | 0.07 | 11 |
| LYD364 | 68018.4 | — | — | — | 7.5 | 0.03 | 13 | 4.9 | 0.06 | 5 |
| LYD364 | 68020.1 | — | — | — | 6.9 | 0.29 | 3 | — | — | — |
| LYD364 | 68020.5 | — | — | — | 9.1 | L | 36 | 5.2 | L | 12 |
| LYD364 | 68022.1 | — | — | — | 7.8 | 0.15 | 17 | 4.9 | 0.16 | 6 |
| LYD361 | 68147.1 | — | — | — | 7.0 | 0.25 | 5 | — | — | — |
| LYD360 | 68061.1 | — | — | — | 8.1 | 0.02 | 22 | 5.2 | 0.03 | 11 |
| LYD360 | 68063.2 | — | — | — | 7.3 | 0.26 | 9 | 4.8 | 0.12 | 3 |
| LYD357 | 68228.1 | — | — | — | 7.2 | 0.20 | 8 | 4.8 | L | 4 |
| LYD354 | 68133.4 | — | — | — | 7.7 | 0.11 | 16 | 4.9 | 0.29 | 5 |
| LYD349 | 68085.3 | — | — | — | — | — | — | 4.7 | 0.14 | 2 |
| LYD349 | 68085.5 | — | — | — | 9.6 | 0.08 | 44 | 5.3 | 0.04 | 14 |
| LYD308 | 66881.2 | — | — | — | 7.9 | 0.02 | 18 | 4.9 | 0.02 | 5 |
| LYD295 | 67972.2 | — | — | — | 7.9 | 0.17 | 18 | 5.0 | 0.02 | 8 |
| LYD295 | 67972.4 | — | — | — | 7.7 | 0.20 | 16 | 4.9 | 0.22 | 6 |
| CONT. | — | — | — | — | 6.7 | — | — | 4.7 | — | — |
| LYD513 | 67217.3 | — | — | — | 6.2 | L | 22 | 4.3 | 0.04 | 10 |
| LYD512 | 67209.1 | — | — | — | — | — | — | 4.2 | 0.24 | 8 |
| LYD482 | 67334.1 | — | — | — | — | — | — | 4.2 | 0.24 | 7 |
| LYD482 | 67335.3 | — | — | — | — | — | — | 4.0 | 0.24 | 3 |
| LYD482 | 67336.1 | — | — | — | — | — | — | 4.1 | 0.23 | 4 |
| LYD475 | 67202.3 | — | — | — | — | — | — | 4.1 | 0.21 | 6 |
| LYD475 | 67204.4 | — | — | — | 6.0 | L | 18 | 4.2 | 0.03 | 9 |
| LYD472 | 67332.1 | — | — | — | 6.2 | 0.06 | 23 | 4.3 | 0.03 | 10 |
| LYD472 | 67332.3 | — | — | — | — | — | — | 4.2 | 0.21 | 7 |
| LYD472 | 67332.4 | — | — | — | 6.2 | L | 23 | 4.4 | L | 11 |
| LYD466 | 67121.1 | — | — | — | 6.1 | L | 21 | 4.3 | L | 11 |
| LYD452 | 67106.2 | — | — | — | 5.4 | 0.20 | 7 | — | — | — |
| LYD451 | 67187.9 | — | — | — | 5.5 | 0.09 | 8 | — | — | — |
| LYD451 | 67188.1 | — | — | — | — | — | — | 4.3 | 0.20 | 9 |
| LYD451 | 67188.4 | — | — | — | 5.9 | 0.07 | 17 | 4.1 | 0.12 | 6 |

TABLE 59-continued

Genes showing improved plant performance at Normal growth conditions under regulation of At6669 promoter

| Gene Name | Event # | Harvest Index Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| LYD445 | 67353.1 | — | — | — | 5.4 | 0.27 | 7 | — | — | — |
| LYD445 | 67353.2 | — | — | — | 5.9 | L | 16 | 4.2 | 0.01 | 8 |
| LYD445 | 67354.5 | — | — | — | 5.3 | 0.29 | 6 | — | — | — |
| LYD439 | 67094.1 | — | — | — | — | — | — | 4.2 | 0.22 | 7 |
| LYD439 | 67094.3 | — | — | — | 5.9 | 0.06 | 17 | 4.2 | 0.03 | 8 |
| LYD439 | 67095.2 | — | — | — | — | — | — | 4.1 | 0.16 | 6 |
| LYD439 | 67095.6 | — | — | — | 5.7 | 0.02 | 13 | 4.2 | 0.02 | 6 |
| LYD415 | 67262.1 | — | — | — | 5.6 | 0.21 | 11 | 4.2 | L | 8 |
| LYD415 | 67264.5 | — | — | — | 5.4 | 0.13 | 7 | 4.0 | 0.21 | 3 |
| LYD382 | 67174.1 | — | — | — | 5.7 | 0.19 | 13 | — | — | — |
| LYD382 | 67175.2 | — | — | — | 5.9 | 0.16 | 17 | 4.2 | 0.05 | 7 |
| LYD382 | 67176.3 | — | — | — | — | — | — | 4.2 | 0.06 | 7 |
| LYD339 | 67247.3 | — | — | — | — | — | — | 4.0 | 0.25 | 2 |
| LYD324 | 67167.1 | — | — | — | — | — | — | 4.1 | 0.30 | 4 |
| LYD321 | 67283.1 | — | — | — | 6.0 | 0.01 | 18 | 4.2 | 0.07 | 8 |
| LYD321 | 67283.3 | — | — | — | — | — | — | 4.2 | 0.13 | 6 |
| LYD321 | 67283.4 | — | — | — | 6.9 | 0.04 | 36 | 4.6 | 0.03 | 19 |
| LYD302 | 64414.3 | — | — | — | 5.8 | 0.03 | 14 | 4.2 | L | 8 |
| LYD302 | 67416.3 | — | — | — | 5.7 | 0.02 | 12 | 4.2 | 0.02 | 7 |
| LYD296 | 67358.6 | — | — | — | 6.3 | 0.14 | 24 | 4.4 | 0.24 | 12 |
| LYD296 | 67359.3 | — | — | — | — | — | — | 4.2 | 0.01 | 7 |
| LYD296 | 67360.1 | — | — | — | — | — | — | 4.1 | 0.08 | 5 |
| CONT. | — | — | — | — | 5.1 | — | — | 3.9 | — | — |
| LYD517 | 67221.3 | — | — | — | 3.8 | 0.14 | 6 | 3.6 | 0.03 | 7 |
| LYD517 | 67221.5 | — | — | — | — | — | — | 3.4 | 0.29 | 3 |
| LYD515 | 67151.1 | — | — | — | 4.2 | 0.08 | 17 | 3.8 | 0.02 | 12 |
| LYD515 | 67151.4 | — | — | — | — | — | — | 3.7 | 0.28 | 9 |
| LYD515 | 67151.6 | — | — | — | — | — | — | 3.6 | 0.05 | 7 |
| LYD515 | 67152.4 | — | — | — | 4.6 | L | 29 | 3.8 | 0.03 | 14 |
| LYD502 | 67340.4 | — | — | — | 4.0 | 0.09 | 13 | 3.6 | 0.12 | 6 |
| LYD502 | 67341.5 | — | — | — | 4.1 | 0.04 | 15 | 3.7 | 0.02 | 10 |
| LYD502 | 67342.6 | — | — | — | 3.9 | 0.02 | 11 | 3.5 | 0.09 | 5 |
| LYD498 | 67252.3 | — | — | — | 4.2 | L | 17 | 3.7 | 0.01 | 9 |
| LYD498 | 67254.1 | — | — | — | 3.9 | 0.06 | 10 | 3.5 | 0.06 | 6 |
| LYD498 | 67254.3 | — | — | — | 4.1 | 0.01 | 16 | 3.7 | L | 10 |
| LYD492 | 67364.5 | — | — | — | 3.9 | 0.20 | 11 | 3.6 | 0.20 | 7 |
| LYD474 | 67199.1 | — | — | — | 3.9 | 0.05 | 9 | — | — | — |
| LYD454 | 67192.5 | — | — | — | 4.2 | 0.02 | 18 | 3.6 | 0.02 | 9 |
| LYD450 | 67178.3 | — | — | — | 4.1 | 0.02 | 14 | 3.6 | 0.07 | 7 |
| LYD450 | 67180.2 | — | — | — | 4.0 | 0.27 | 11 | 3.6 | 0.18 | 7 |
| LYD450 | 67182.2 | — | — | — | 4.2 | 0.01 | 18 | 3.7 | 0.06 | 10 |
| LYD428 | 67472.2 | — | — | — | — | — | — | 3.5 | 0.11 | 5 |
| LYD397 | 67322.1 | — | — | — | 3.8 | 0.28 | 6 | — | — | — |
| LYD397 | 67324.2 | — | — | — | 4.5 | 0.04 | 28 | 3.8 | L | 14 |
| LYD323 | 67286.1 | — | — | — | 4.1 | 0.29 | 16 | 3.7 | 0.08 | 9 |
| LYD323 | 67287.3 | — | — | — | 4.1 | L | 16 | 3.6 | 0.02 | 7 |
| LYD312 | 67256.4 | — | — | — | 4.6 | 0.08 | 30 | 3.8 | 0.09 | 13 |
| LYD312 | 67256.5 | — | — | — | 4.1 | L | 16 | 3.6 | 0.02 | 7 |
| LYD310 | 67161.1 | — | — | — | 4.0 | 0.04 | 12 | 3.5 | 0.29 | 3 |
| LYD310 | 67164.1 | — | — | — | 3.8 | 0.08 | 7 | 3.5 | 0.22 | 3 |
| LYD301 | 67347.2 | — | — | — | 4.4 | 0.01 | 25 | 3.8 | 0.05 | 14 |
| LYD301 | 67347.4 | — | — | — | 4.0 | 0.13 | 12 | 3.6 | 0.08 | 6 |
| LYD298 | 66964.4 | — | — | — | 4.4 | 0.15 | 24 | 3.8 | 0.01 | 14 |
| LYD298 | 66966.2 | — | — | — | 4.1 | L | 15 | 3.6 | 0.02 | 7 |
| CONT. | — | — | — | — | 3.5 | — | — | 3.4 | — | — |
| LYD508 | 67823.1 | 0.4 | 0.23 | 14 | — | — | — | — | — | — |
| LYD508 | 67823.2 | 0.4 | 0.29 | 7 | 5.6 | 0.13 | 7 | 4.0 | 0.23 | 2 |
| LYD508 | 67823.4 | 0.4 | 0.14 | 11 | — | — | — | — | — | — |
| LYD508 | 67824.3 | — | — | — | 6.2 | 0.08 | 18 | 4.2 | 0.11 | 6 |
| LYD503 | 67526.2 | 0.4 | 0.08 | 17 | — | — | — | — | — | — |
| LYD503 | 67529.1 | 0.4 | 0.24 | 7 | — | — | — | — | — | — |
| LYD503 | 67529.3 | 0.4 | 0.27 | 8 | — | — | — | — | — | — |
| LYD497 | 67880.3 | 0.4 | 0.30 | 8 | — | — | — | — | — | — |
| LYD497 | 67883.4 | — | — | — | 5.8 | 0.03 | 10 | 4.1 | 0.08 | 5 |
| LYD491 | 67876.2 | 0.4 | 0.29 | 20 | — | — | — | — | — | — |
| LYD489 | 67787.4 | 0.4 | 0.16 | 9 | — | — | — | — | — | — |
| LYD479 | 67727.4 | — | — | — | 6.7 | 0.21 | 28 | 4.4 | L | 12 |
| LYD458 | 67922.2 | 0.4 | 0.29 | 11 | — | — | — | — | — | — |
| LYD435 | 67707.3 | 0.4 | 0.14 | 9 | — | — | — | — | — | — |
| LYD435 | 67708.2 | 0.4 | 0.03 | 15 | — | — | — | — | — | — |
| LYD433 | 67700.1 | 0.4 | 0.04 | 21 | — | — | — | — | — | — |

TABLE 59-continued

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD433 | 67704.4 | 0.4 | 0.19 | 9 | — | — | — | — | — | — |
| LYD428 | 67473.3 | 0.4 | 0.07 | 12 | 6.8 | L | 29 | 4.4 | L | 12 |
| LYD428 | 67474.3 | 0.4 | 0.08 | 14 | — | — | — | — | — | — |
| LYD305 | 67535.5 | 0.4 | 0.29 | 7 | — | — | — | — | — | — |
| CONT. | — | 0.4 | — | — | 5.2 | — | — | 3.9 | — | — |
| LYD484 | 67135.3 | — | — | — | 8.1 | 0.05 | 6 | 4.9 | 0.20 | 3 |
| LYD470 | 67126.7 | — | — | — | 9.1 | L | 20 | 5.2 | 0.04 | 9 |
| LYD470 | 67127.3 | — | — | — | 7.7 | 0.25 | 2 | 4.8 | 0.20 | 2 |
| LYD459 | 67116.4 | — | — | — | — | — | — | 4.9 | 0.02 | 3 |
| LYD387 | 67317.4 | — | — | — | 9.4 | 0.06 | 24 | 5.4 | L | 14 |
| LYD338 | 67442.3 | — | — | — | 9.2 | 0.12 | 21 | 5.3 | L | 11 |
| LYD337 | 66994.3 | — | — | — | 7.8 | 0.12 | 4 | — | — | — |
| LYD337 | 66995.4 | — | — | — | — | — | — | 5.0 | 0.27 | 5 |
| LYD337 | 66995.5 | — | — | — | 8.2 | 0.23 | 8 | — | — | — |
| LYD322 | 66884.1 | — | — | — | — | — | — | 4.9 | 0.03 | 3 |
| LYD322 | 66884.2 | — | — | — | 8.6 | L | 13 | 5.0 | L | 5 |
| LYD322 | 66886.6 | — | — | — | — | — | — | 4.9 | 0.04 | 4 |
| LYD322 | 66887.1 | — | — | — | 8.3 | 0.02 | 9 | 5.0 | 0.13 | 5 |
| LYD307 | 66975.3 | — | — | — | 8.1 | 0.05 | 7 | 4.9 | 0.02 | 4 |
| LYD307 | 66975.4 | — | — | — | — | — | — | 4.9 | 0.11 | 2 |
| LYD307 | 66977.3 | — | — | — | 8.7 | 0.13 | 15 | 5.1 | 0.21 | 8 |
| CONT. | — | — | — | — | 7.6 | — | — | 4.7 | — | — |
| LYD453 | 67484.1 | 0.4 | 0.07 | 12 | — | — | — | — | — | — |
| LYD453 | 67485.2 | 0.4 | 0.07 | 11 | — | — | — | — | — | — |
| LYD453 | 67485.5 | 0.4 | 0.10 | 15 | — | — | — | — | — | — |
| LYD410 | 67546.1 | 0.4 | 0.25 | 6 | — | — | — | — | — | — |
| LYD410 | 67548.3 | 0.4 | 0.08 | 11 | — | — | — | — | — | — |
| LYD409 | 67468.2 | 0.4 | 0.29 | 8 | — | — | — | — | — | — |
| LYD409 | 67469.1 | 0.4 | 0.29 | 5 | — | — | — | — | — | — |
| LYD405 | 67694.4 | 0.4 | 0.12 | 9 | — | — | — | — | — | — |
| LYD405 | 67695.2 | 0.5 | L | 22 | — | — | — | — | — | — |
| LYD405 | 67696.2 | 0.4 | 0.02 | 16 | — | — | — | — | — | — |
| LYD405 | 67697.2 | 0.4 | 0.16 | 7 | — | — | — | — | — | — |
| LYD404 | 67690.2 | 0.4 | 0.18 | 8 | — | — | — | — | — | — |
| LYD404 | 67690.4 | 0.4 | 0.24 | 16 | — | — | — | — | — | — |
| LYD403 | 67770.3 | 0.4 | 0.20 | 7 | — | — | — | — | — | — |
| LYD402 | 67762.1 | 0.4 | 0.19 | 8 | — | — | — | — | — | — |
| LYD402 | 67765.3 | 0.4 | 0.21 | 7 | — | — | — | — | — | — |
| LYD396 | 67754.1 | 0.4 | 0.11 | 17 | — | — | — | — | — | — |
| LYD396 | 67759.3 | 0.4 | 0.04 | 17 | — | — | — | — | — | — |
| LYD379 | 67678.1 | — | — | — | 6.4 | 0.13 | 11 | 4.2 | 0.02 | 5 |
| LYD372 | 67673.4 | — | — | — | — | — | — | 4.1 | 0.12 | 3 |
| LYD366 | 67810.4 | 0.4 | 0.19 | 16 | — | — | — | — | — | — |
| LYD366 | 67812.1 | 0.4 | 0.12 | 8 | — | — | — | — | — | — |
| LYD362 | 67538.2 | 0.4 | 0.03 | 13 | — | — | — | — | — | — |
| LYD362 | 67543.5 | 0.4 | 0.29 | 6 | — | — | — | — | — | — |
| LYD362 | 67543.6 | 0.4 | 0.01 | 19 | — | — | — | — | — | — |
| LYD355 | 67641.3 | 0.4 | 0.02 | 15 | — | — | — | — | — | — |
| LYD355 | 67641.4 | 0.4 | 0.11 | 9 | — | — | — | — | — | — |
| LYD355 | 67643.3 | 0.4 | 0.05 | 12 | — | — | — | — | — | — |
| LYD348 | 67851.6 | 0.4 | 0.25 | 6 | — | — | — | — | — | — |
| LYD348 | 67851.7 | 0.4 | L | 18 | — | — | — | — | — | — |
| LYD348 | 67853.1 | 0.5 | 0.08 | 24 | — | — | — | — | — | — |
| LYD348 | 67854.3 | 0.4 | 0.02 | 16 | — | — | — | — | — | — |
| LYD347 | 67844.2 | 0.4 | 0.10 | 9 | — | — | — | — | — | — |
| LYD347 | 67848.2 | 0.4 | 0.10 | 9 | — | — | — | — | — | — |
| CONT. | — | 0.4 | — | — | 5.7 | — | — | 4.0 | — | — |
| LYD489 | 67785.4 | — | — | — | 6.5 | 0.18 | 6 | — | — | — |
| LYD472 | 67332.4 | — | — | — | 6.7 | 0.18 | 10 | — | — | — |
| LYD458 | 67922.1 | — | — | — | — | — | — | 4.6 | 0.27 | 3 |
| LYD456 | 67966.3 | — | — | — | 6.7 | 0.06 | 8 | 4.7 | 0.14 | 4 |
| LYD456 | 67967.4 | — | — | — | 6.4 | 0.14 | 5 | 4.7 | 0.18 | 4 |
| LYD422 | 68103.3 | — | — | — | — | — | — | 4.7 | 0.15 | 4 |
| LYD417 | 68045.3 | — | — | — | — | — | — | 4.6 | 0.28 | 3 |
| LYD392 | 68032.2 | — | — | — | 6.7 | 0.21 | 8 | 4.7 | 0.09 | 6 |
| LYD392 | 68033.3 | — | — | — | 7.3 | L | 18 | 4.8 | 0.14 | 6 |
| LYD365 | 68092.4 | — | — | — | 6.6 | 0.13 | 7 | 4.6 | 0.26 | 3 |
| LYD365 | 68092.5 | — | — | — | 7.2 | 0.22 | 18 | 4.9 | 0.01 | 9 |
| LYD365 | 68093.2 | — | — | — | 6.7 | 0.17 | 8 | 4.7 | 0.27 | 4 |
| LYD359 | 67946.3 | — | — | — | 6.5 | 0.29 | 5 | — | — | — |
| LYD351 | 68126.2 | — | — | — | 7.0 | L | 13 | 4.7 | 0.09 | 5 |

TABLE 59-continued

Genes showing improved plant performance at Normal growth conditions under regulation of At6669 promoter

| Gene Name | Event # | Harvest Index Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| LYD351 | 68129.5 | — | — | — | 6.5 | 0.14 | 6 | — | — | — |
| LYD306 | 66971.1 | — | — | — | 7.0 | L | 14 | 4.8 | 0.06 | 6 |
| LYD299 | 68115.7 | — | — | — | 7.2 | L | 17 | 4.8 | 0.04 | 7 |
| CONT. | — | — | — | — | 6.2 | — | — | 4.5 | — | — |
| LYD506 | 67144.2 | — | — | — | 8.4 | 0.01 | 19 | 5.1 | L | 9 |
| LYD506 | 67146.2 | — | — | — | 8.8 | 0.10 | 24 | 5.1 | 0.28 | 9 |
| LYD504 | 67136.2 | — | — | — | 7.9 | 0.04 | 12 | 4.9 | 0.06 | 5 |
| LYD504 | 67136.3 | — | — | — | 8.7 | L | 23 | 5.1 | L | 10 |
| LYD504 | 67138.1 | — | — | — | 7.8 | 0.16 | 11 | — | — | — |
| LYD504 | 67139.1 | — | — | — | 8.6 | 0.02 | 22 | 5.1 | 0.02 | 10 |
| LYD504 | 67140.1 | — | — | — | 7.7 | 0.13 | 9 | 4.8 | 0.27 | 3 |
| LYD466 | 67119.4 | — | — | — | 7.6 | 0.24 | 8 | — | — | — |
| LYD442 | 67104.3 | — | — | — | 8.7 | 0.20 | 23 | 5.1 | 0.17 | 9 |
| LYD440 | 66902.1 | — | — | — | 8.3 | 0.08 | 17 | 5.0 | 0.03 | 6 |
| LYD440 | 66902.2 | — | — | — | 8.2 | 0.08 | 16 | 5.0 | 0.04 | 6 |
| LYD440 | 66906.1 | — | — | — | 8.4 | L | 19 | 5.0 | 0.03 | 7 |
| LYD432 | 67959.2 | — | — | — | 8.6 | 0.22 | 22 | 5.1 | 0.22 | 9 |
| LYD432 | 67961.2 | — | — | — | 8.4 | L | 19 | 5.1 | 0.10 | 9 |
| LYD425 | 67454.3 | — | — | — | 7.9 | 0.05 | 11 | 4.9 | 0.07 | 5 |
| LYD425 | 67454.5 | — | — | — | 8.1 | 0.15 | 15 | 4.9 | 0.22 | 5 |
| LYD408 | 67304.1 | — | — | — | 9.3 | L | 32 | 5.2 | 0.01 | 12 |
| LYD408 | 67305.6 | — | — | — | 9.3 | 0.07 | 32 | 5.3 | L | 14 |
| LYD408 | 67306.2 | — | — | — | 7.9 | 0.09 | 12 | — | — | — |
| LYD401 | 67084.2 | — | — | — | 7.6 | 0.17 | 8 | 4.8 | 0.27 | 3 |
| LYD401 | 67086.2 | — | — | — | — | — | — | 4.9 | 0.19 | 6 |
| LYD375 | 67070.2 | — | — | — | 8.0 | 0.05 | 13 | 4.9 | 0.05 | 5 |
| LYD375 | 67073.2 | — | — | — | 8.2 | 0.03 | 17 | 5.0 | 0.03 | 7 |
| LYD342 | 67059.4 | — | — | — | 8.0 | 0.03 | 13 | 4.9 | 0.05 | 5 |
| LYD342 | 67062.1 | — | — | — | 9.1 | L | 28 | 5.1 | L | 9 |
| LYD329 | 67275.1 | — | — | — | 7.5 | 0.26 | 6 | — | — | — |
| LYD329 | 67277.4 | — | — | — | 8.2 | 0.04 | 16 | 5.0 | 0.25 | 7 |
| LYD320 | 67040.2 | — | — | — | 7.5 | 0.24 | 6 | — | — | — |
| LYD320 | 67043.1 | — | — | — | 7.5 | 0.20 | 6 | 4.8 | 0.14 | 4 |
| LYD318 | 66980.3 | — | — | — | 7.6 | 0.14 | 8 | 4.9 | 0.12 | 5 |
| LYD318 | 66980.5 | — | — | — | 7.8 | 0.08 | 11 | 4.8 | 0.17 | 4 |
| LYD318 | 66982.1 | — | — | — | 8.0 | 0.03 | 13 | 4.9 | 0.17 | 4 |
| LYD318 | 66983.4 | — | — | — | 8.8 | L | 25 | 5.1 | L | 10 |
| LYD316 | 67436.1 | — | — | — | 8.1 | 0.02 | 14 | 4.9 | 0.19 | 5 |
| LYD316 | 67437.2 | — | — | — | 8.1 | 0.02 | 15 | 5.0 | 0.10 | 8 |
| LYD316 | 67439.1 | — | — | — | 8.7 | L | 23 | 5.1 | 0.02 | 10 |
| LYD311 | 67425.1 | — | — | — | — | — | — | 4.8 | 0.27 | 4 |
| LYD292 | 66998.3 | — | — | — | 8.5 | L | 21 | 5.0 | 0.02 | 7 |
| LYD292 | 66999.2 | — | — | — | 9.3 | 0.05 | 32 | 5.3 | L | 13 |
| LYD292 | 66999.4 | — | — | — | 8.1 | 0.14 | 15 | — | — | — |
| LYD292 | 67000.1 | — | — | — | 9.5 | 0.01 | 34 | 5.2 | 0.04 | 11 |
| CONT. | — | — | — | — | 7.1 | — | — | 4.7 | — | — |

Table 59.
"CONT."—Control;
"Ave."—Average;
"% Incr." = % increment;
"p-val."—p-value,
L—p < 0.01. The transgenes were under the transcriptional regulation of the new At6669 promoter (SEQ ID NO: 14467).
"—" = results are still unavailable.

TABLE 60

Genes showing improved plant performance at Normal growth conditions under regulation of At6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LYD508 | 67823.2 | 459.9 | 0.08 | 18 | — | — | — |
| LYD508 | 67823.4 | 432.1 | 0.24 | 11 | — | — | — |
| LYD508 | 67824.3 | 455.4 | 0.08 | 17 | — | — | — |
| LYD503 | 67529.1 | 430.3 | 0.25 | 10 | — | — | — |
| LYD503 | 67529.3 | 417.3 | 0.13 | 7 | — | — | — |
| LYD497 | 67883.1 | 427.1 | 0.08 | 9 | — | — | — |
| LYD489 | 67784.4 | 413.4 | 0.18 | 6 | — | — | — |
| LYD435 | 67706.1 | 426.1 | 0.11 | 9 | — | — | — |
| LYD435 | 67708.1 | 417.9 | 0.24 | 7 | — | — | — |
| LYD433 | 67700.1 | 487.3 | 0.01 | 25 | — | — | — |

TABLE 60-continued

Genes showing improved plant performance at Normal growth conditions under regulation of At6669 promoter

| Gene | | Seed Yield [mg] | | | 1000 Seed Weight [mg] | | |
|---|---|---|---|---|---|---|---|
| Name | Event # | Ave. | P-Val. | % Incr. | Ave. | P-Val. | % Incr. |
| LYD433 | 67704.4 | 435.2 | 0.11 | 11 | — | — | — |
| LYD428 | 67473.3 | 494.4 | 0.06 | 27 | — | — | — |
| LYD428 | 67474.3 | 444.4 | 0.20 | 14 | — | — | — |
| LYD346 | 67605.4 | 444.8 | 0.06 | 14 | — | — | — |
| CONT. | — | 390.4 | — | — | — | — | — |
| LYD453 | 67485.2 | 454.1 | 0.13 | 7 | — | — | — |
| LYD410 | 67546.3 | 454.3 | 0.06 | 7 | — | — | — |
| LYD409 | 67468.2 | 490.5 | 0.18 | 15 | — | — | — |
| LYD405 | 67695.2 | 511.4 | 0.02 | 20 | — | — | — |
| LYD405 | 67696.2 | 534.5 | 0.28 | 26 | — | — | — |
| LYD396 | 67759.5 | 483.5 | L | 14 | — | — | — |
| LYD379 | 67677.1 | 476.9 | 0.19 | 12 | — | — | — |
| LYD366 | 67812.5 | 478.3 | 0.14 | 12 | — | — | — |
| LYD362 | 67538.2 | 499.0 | L | 17 | — | — | — |
| LYD355 | 67641.3 | 470.8 | 0.08 | 11 | — | — | — |
| LYD348 | 67851.7 | 476.1 | 0.01 | 12 | — | — | — |
| LYD348 | 67853.1 | 519.8 | 0.18 | 22 | — | — | — |
| LYD348 | 67854.3 | 472.8 | 0.29 | 11 | — | — | — |
| LYD347 | 67844.2 | 497.9 | L | 17 | — | — | — |
| CONT. | — | 425.5 | — | — | — | — | — |

Table 60.
"CONT."—Control;
"Ave."—Average;
"% Incr." = % increment;
"p-val."—p-value,
L—p < 0.01. The transgenes were under the transcriptional regulation of the new At6669 promoter (SEQ ID NO: 14467).
"—" = results are still unavailable.

Example 17

Evaluation of Transgenic *Arabidopsis* for Seed Yield and Plant Growth Rate Under Normal Conditions in Greenhouse Assays Until Bolting (GH-SB Assays)

Assay 2: Plant performance improvement measured until bolting stage: plant biomass and plant growth rate under normal greenhouse conditions (GH-SB Assays)—This assay follows the plant biomass formation and the rosette area growth of plants grown in the greenhouse under normal growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing of 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until bolting stage. Plant biomass (the above ground tissue) was weight in directly after harvesting the rosette (plant fresh weight [FW]). Following plants were dried in an oven at 50° C. for 48 hours and weighted (plant dry weight [DW]).

Each construct was validated at its $T_2$ generation. Transgenic plants transformed with a construct conformed by an empty vector carrying the 35S promoter and the selectable marker was used as control.

The plants were analyzed for their overall size, growth rate, fresh weight and dry matter. Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol:// rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number (Formula IX, described above), rosette area (Formula VIII described above) and plot coverage (Formula XIII, described above) were calculated using the indicated formulas.

Plant fresh and dry weight—On about day 80 from sowing, the plants were harvested and directly weight for the determination of the plant fresh weight (FW) and left to dry at 50° C. in a drying chamber for about 48 hours before weighting to determine plant dry weight (DW).

Statistical analyses—To identify outperforming genes and constructs, results from the independent transformation events tested were analyzed separately. Data was analyzed using Student's t-test and results are considered significant if the p value was less than 0.1. The JMP statistics software package was used (Version 5.2.1, SAS Institute Inc., Cary, N.C., USA).

Experimental Results:

Tables 61-64 summarize the observed phenotypes of transgenic plants expressing the genes constructs using the GH-SB Assays.

The genes listed in Tables 61-64 improved plant performance when grown at normal conditions. These genes produced larger plants with a larger photosynthetic area, biomass (fresh weight, dry weight, rosette diameter, rosette area and plot coverage), relative growth rate, blade relative area and petiole relative area. The genes were cloned under the regulation of a constitutive At6669 promoter (SEQ ID NO:14467). The evaluation of each gene was performed by testing the performance of different number of events. Event with p-value <0.1 was considered statistically significant.

TABLE 61

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val | % Incr. | Leaf Number Ave. | P-Val. | % Incr. |
|---|---|---|---|---|---|---|---|---|---|---|
| LYD511 | 67774.3 | 426.2 | 0.21 | 7 | — | — | — | — | — | — |
| LYD441 | 67714.3 | — | — | — | — | — | — | 10.2 | 0.11 | 3 |
| LYD410 | 67546.2 | 431.2 | 0.23 | 8 | 5181.2 | 0.14 | 7 | — | — | — |
| LYD410 | 67546.3 | — | — | — | — | — | — | 10.6 | 0.13 | 7 |
| LYD396 | 67754.1 | 426.2 | 0.22 | 7 | 5081.2 | 0.25 | 5 | 10.6 | 0.14 | 7 |
| LYD396 | 67759.3 | 453.8 | 0.26 | 14 | — | — | — | — | — | — |
| CONT. | — | 398.3 | — | — | 4845.8 | — | — | 9.9 | — | — |
| LYD504 | 67136.2 | — | — | — | 5918.8 | 0.02 | 8 | 10.8 | 0.03 | 3 |
| LYD504 | 67140.1 | 383.1 | 0.15 | 6 | — | — | — | — | — | — |
| LYD484 | 67133.3 | — | — | — | 5720.5 | 0.19 | 4 | — | — | — |
| LYD478 | 67272.3 | 389.4 | 0.20 | 8 | — | — | — | 10.7 | 0.13 | 2 |
| LYD470 | 67125.4 | 391.4 | 0.17 | 9 | — | — | — | — | — | — |
| LYD470 | 67126.7 | — | — | — | 5968.8 | 0.25 | 9 | — | — | — |
| LYD466 | 67118.1 | — | — | — | 5606.2 | 0.19 | 2 | — | — | — |
| LYD466 | 67120.2 | 377.5 | 0.17 | 5 | — | — | — | — | — | — |
| LYD442 | 67103.1 | 380.6 | 0.09 | 6 | — | — | — | — | — | — |
| LYD440 | 66903.1 | 383.1 | 0.15 | 6 | 6168.8 | L | 13 | 11.2 | 0.14 | 8 |
| LYD438 | 66899.2 | — | — | — | 6087.5 | 0.23 | 11 | 11.1 | 0.27 | 6 |
| LYD438 | 66900.3 | 379.4 | 0.28 | 5 | — | — | — | — | — | — |
| LYD408 | 67305.6 | 373.8 | 0.24 | 4 | — | — | — | — | — | — |
| LYD395 | 67080.6 | — | — | — | 5843.8 | 0.01 | 7 | — | — | — |
| LYD387 | 67317.1 | 389.4 | 0.03 | 8 | — | — | — | — | — | — |
| LYD387 | 67317.4 | — | — | — | — | — | — | 10.9 | 0.08 | 4 |
| LYD385 | 66891.2 | — | — | — | 5762.5 | 0.04 | 5 | — | — | — |
| LYD385 | 66893.1 | — | — | — | 5850.0 | L | 7 | — | — | — |
| LYD375 | 67070.2 | — | — | — | 5818.8 | 0.10 | 6 | — | — | — |
| LYD375 | 67070.3 | 383.8 | 0.19 | 6 | 5756.2 | 0.18 | 5 | — | — | — |
| LYD375 | 67071.4 | — | — | — | 6281.2 | 0.18 | 15 | — | — | — |
| LYD342 | 67063.2 | — | — | — | 5937.5 | 0.11 | 8 | — | — | — |
| LYD330 | 67046.2 | 417.5 | L | 16 | 5912.5 | 0.17 | 8 | 11.1 | 0.27 | 6 |
| LYD330 | 67050.2 | — | — | — | — | — | — | 11.1 | L | 6 |
| LYD330 | 67050.5 | — | — | — | — | — | — | 10.7 | 0.13 | 2 |
| LYD329 | 67277.4 | 373.1 | 0.29 | 3 | 5700.0 | 0.04 | 4 | — | — | — |
| LYD325 | 67015.4 | 373.1 | 0.29 | 3 | — | — | — | — | — | — |
| LYD322 | 66884.2 | — | — | — | 5700.0 | 0.19 | 4 | — | — | — |
| LYD320 | 67043.1 | — | — | — | 5706.2 | 0.28 | 4 | — | — | — |
| LYD320 | 67044.2 | — | — | — | 5748.8 | 0.02 | 5 | — | — | — |
| LYD318 | 66983.4 | 409.4 | 0.04 | 14 | 6275.0 | 0.15 | 15 | — | — | — |
| LYD315 | 67004.4 | — | — | — | — | — | — | 11.3 | 0.06 | 8 |
| LYD315 | 67005.2 | — | — | — | 5656.2 | 0.25 | 3 | — | — | — |
| LYD315 | 67007.4 | 413.8 | 0.04 | 15 | 5875.0 | 0.26 | 7 | 11.3 | 0.06 | 8 |
| LYD298 | 66962.3 | 382.0 | 0.20 | 6 | — | — | — | — | — | — |
| LYD293 | 66957.2 | — | — | — | 5793.8 | L | 6 | — | — | — |
| LYD292 | 66998.3 | 413.1 | 0.11 | 15 | 6712.5 | L | 23 | — | — | — |
| LYD292 | 67000.1 | 380.6 | 0.09 | 6 | 6362.5 | 0.10 | 16 | — | — | — |
| CONT. | — | 360.6 | — | — | 5474.6 | — | — | 10.5 | — | — |
| LYD471 | 68050.2 | 353.8 | 0.05 | 26 | 4675.0 | 0.10 | 25 | — | — | — |
| LYD471 | 68050.4 | — | — | — | 4656.2 | 0.15 | 25 | 9.8 | 0.10 | 4 |
| LYD446 | 68109.4 | — | — | — | 4143.8 | 0.17 | 11 | — | — | — |
| LYD446 | 68110.1 | — | — | — | 3943.8 | 0.28 | 6 | 9.7 | 0.30 | 4 |
| LYD446 | 68110.3 | 302.5 | 0.24 | 8 | 4593.8 | 0.10 | 23 | — | — | — |
| LYD446 | 68111.4 | — | — | — | — | — | — | 9.8 | 0.15 | 4 |
| LYD432 | 67959.2 | — | — | — | 3937.5 | 0.30 | 6 | — | — | — |
| LYD432 | 67960.6 | — | — | — | — | — | — | 9.8 | 0.18 | 5 |
| LYD422 | 68102.3 | — | — | — | 4537.5 | 0.23 | 22 | 9.7 | 0.16 | 4 |
| LYD422 | 68103.3 | 366.9 | 0.29 | 31 | 4587.5 | 0.01 | 23 | — | — | — |
| LYD417 | 68043.1 | 315.0 | 0.09 | 12 | 4487.5 | 0.27 | 20 | — | — | — |
| LYD417 | 68043.3 | — | — | — | 4065.2 | 0.17 | 9 | — | — | — |
| LYD417 | 68043.5 | 302.5 | 0.28 | 8 | — | — | — | — | — | — |
| LYD385 | 66891.2 | 305.0 | 0.21 | 9 | 4306.2 | 0.04 | 15 | — | — | — |
| LYD385 | 66891.3 | — | — | — | — | — | — | 9.9 | 0.07 | 6 |
| LYD368 | 67661.1 | 324.4 | 0.23 | 16 | 4050.0 | 0.21 | 9 | — | — | — |
| LYD364 | 68018.3 | — | — | — | 4137.5 | 0.07 | 11 | — | — | — |
| LYD364 | 68020.1 | 306.9 | 0.17 | 9 | — | — | — | — | — | — |
| LYD364 | 68020.2 | — | — | — | — | — | — | 9.8 | 0.18 | 5 |
| LYD351 | 68129.3 | — | — | — | 4131.2 | 0.09 | 11 | — | — | — |
| LYD344 | 68123.2 | — | — | — | 4400.0 | 0.08 | 18 | — | — | — |
| LYD335 | 67557.5 | — | — | — | — | — | — | 9.7 | 0.16 | 4 |
| LYD330 | 67047.8 | — | — | — | 4156.2 | 0.09 | 11 | 9.7 | 0.16 | 4 |
| LYD315 | 67004.4 | — | — | — | — | — | — | 9.7 | 0.16 | 4 |
| LYD315 | 67007.4 | 362.5 | 0.29 | 29 | 4312.5 | 0.24 | 16 | — | — | — |
| LYD309 | 67421.4 | — | — | — | — | — | — | 9.8 | 0.18 | 5 |

TABLE 61-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYD308 | 66880.2 | 331.2 | 0.03 | 18 | 4075.0 | 0.11 | 9 | — | — | — |
| LYD299 | 68114.6 | — | — | — | — | — | — | 9.6 | 0.29 | 3 |
| LYD299 | 68115.4 | — | — | — | 4331.2 | 0.02 | 16 | — | — | — |
| LYD299 | 68115.6 | 339.4 | 0.01 | 21 | 4056.3 | 0.28 | 9 | — | — | — |
| LYD299 | 68115.7 | — | — | — | 4006.2 | 0.17 | 7 | — | — | — |
| LYD299 | 68118.5 | 347.5 | 0.24 | 24 | 4537.5 | L | 22 | — | — | — |
| CONT. | — | 280.6 | — | — | 3731.2 | — | — | 9.4 | — | — |
| LYD517 | 67221.3 | 508.8 | 0.20 | 10 | 7375.0 | 0.03 | 8 | — | — | — |
| LYD517 | 67221.5 | 493.8 | 0.09 | 7 | 7412.5 | 0.03 | 9 | — | — | — |
| LYD517 | 67222.1 | 503.1 | 0.08 | 9 | 7550.0 | L | 11 | — | — | — |
| LYD515 | 67151.1 | 517.5 | 0.05 | 12 | 8000.0 | 0.08 | 18 | — | — | — |
| LYD515 | 67151.4 | 512.5 | 0.12 | 11 | 7343.8 | 0.12 | 8 | — | — | — |
| LYD515 | 67151.6 | — | — | — | 7612.5 | L | 12 | — | — | — |
| LYD512 | 67209.1 | 485.0 | 0.16 | 5 | 7556.2 | 0.24 | 11 | — | — | — |
| LYD512 | 67211.4 | 509.4 | 0.02 | 11 | 7362.5 | 0.03 | 8 | — | — | — |
| LYD512 | 67212.2 | 501.2 | 0.04 | 9 | 7331.2 | 0.04 | 8 | — | — | — |
| LYD502 | 67342.6 | 490.0 | 0.18 | 6 | 7381.2 | 0.03 | 8 | — | — | — |
| LYD498 | 67254.3 | 488.8 | 0.11 | 6 | 7081.2 | 0.25 | 4 | — | — | — |
| LYD492 | 67364.5 | 512.5 | 0.15 | 11 | 7468.8 | 0.14 | 10 | — | — | — |
| LYD482 | 67334.1 | 506.9 | 0.03 | 10 | 7637.5 | L | 12 | — | — | — |
| LYD475 | 67204.2 | — | — | — | 7437.5 | 0.23 | 9 | — | — | — |
| LYD475 | 67204.4 | — | — | — | 7681.2 | 0.26 | 13 | — | — | — |
| LYD454 | 67192.5 | 523.8 | 0.01 | 14 | 7275.0 | 0.25 | 7 | — | — | — |
| LYD454 | 67193.4 | — | — | — | 7387.5 | 0.12 | 9 | — | — | — |
| LYD452 | 67106.2 | 545.0 | 0.09 | 18 | 7637.5 | 0.11 | 12 | — | — | — |
| LYD451 | 67187.7 | 483.1 | 0.24 | 5 | 7112.5 | 0.19 | 5 | — | — | — |
| LYD451 | 67188.4 | 534.4 | 0.04 | 16 | 7893.8 | 0.08 | 16 | 10.2 | 0.07 | 5 |
| LYD450 | 67182.2 | — | — | — | 7425.0 | 0.25 | 9 | — | — | — |
| LYD445 | 67353.1 | — | — | — | 7325.0 | 0.08 | 8 | — | — | — |
| LYD439 | 67094.1 | — | — | — | — | — | — | 10.1 | 0.17 | 4 |
| LYD439 | 67096.1 | — | — | — | — | — | — | 10.4 | 0.03 | 7 |
| LYD415 | 67262.1 | — | — | — | 7781.2 | L | 14 | — | — | — |
| LYD415 | 67266.1 | — | — | — | 7612.5 | 0.27 | 12 | — | — | — |
| LYD415 | 67266.3 | — | — | — | 7681.2 | L | 13 | — | — | — |
| LYD415 | 67266.6 | 500.0 | 0.04 | 9 | 7393.8 | 0.22 | 9 | — | — | — |
| LYD399 | 67448.3 | 556.2 | 0.20 | 21 | 8118.8 | L | 19 | 10.7 | 0.02 | 10 |
| LYD397 | 67322.2 | 482.5 | 0.23 | 5 | — | — | — | — | — | — |
| LYD397 | 67323.2 | — | — | — | 7225.0 | 0.13 | 6 | — | — | — |
| LYD339 | 67247.3 | — | — | — | — | — | — | 10.0 | 0.23 | 3 |
| LYD328 | 67238.2 | 491.9 | 0.10 | 7 | — | — | — | — | — | — |
| LYD328 | 67242.1 | 512.5 | 0.30 | 11 | 7468.8 | 0.02 | 10 | — | — | — |
| LYD324 | 67168.4 | 492.5 | 0.09 | 7 | 7143.8 | 0.15 | 5 | — | — | — |
| LYD323 | 67287.3 | — | — | — | 7087.5 | 0.23 | 4 | — | — | — |
| LYD323 | 67288.2 | — | — | — | 7662.5 | 0.29 | 13 | — | — | — |
| LYD321 | 67280.1 | 519.4 | L | 13 | 7356.2 | 0.07 | 8 | — | — | — |
| LYD321 | 67281.6 | 498.8 | 0.05 | 8 | 7331.2 | 0.29 | 8 | — | — | — |
| LYD321 | 67283.1 | 484.4 | 0.17 | 5 | — | — | — | — | — | — |
| LYD321 | 67283.3 | 508.8 | 0.10 | 10 | 7300.0 | 0.25 | 7 | — | — | — |
| LYD316 | 67437.2 | 512.5 | 0.01 | 11 | 7412.5 | 0.07 | 9 | — | — | — |
| LYD316 | 67439.1 | — | — | — | 7356.2 | 0.11 | 8 | — | — | — |
| LYD312 | 67256.4 | 518.8 | L | 13 | 7868.8 | L | 16 | — | — | — |
| LYD312 | 67257.3 | 511.9 | 0.01 | 11 | 7293.8 | 0.05 | 7 | — | — | — |
| LYD310 | 67163.1 | 486.9 | 0.26 | 6 | 7343.8 | 0.04 | 8 | — | — | — |
| LYD310 | 67164.1 | 494.4 | 0.24 | 7 | — | — | — | 10.1 | 0.15 | 4 |
| LYD309 | 67418.3 | 518.1 | L | 12 | 7737.5 | 0.02 | 14 | — | — | — |
| LYD296 | 67359.1 | 515.0 | 0.01 | 12 | 7718.8 | L | 13 | 10.1 | 0.17 | 4 |
| LYD291 | 67400.2 | 529.1 | 0.17 | 15 | 7560.7 | 0.07 | 11 | — | — | — |
| LYD291 | 67400.5 | — | — | — | 7806.2 | 0.11 | 15 | — | — | — |
| LYD290 | 67233.3 | — | — | — | 7187.5 | 0.21 | 6 | — | — | — |
| LYD290 | 67233.5 | — | — | — | 7331.2 | 0.12 | 8 | — | — | — |
| LYD290 | 67236.4 | — | — | — | 7368.8 | 0.18 | 8 | — | — | — |
| CONT. | — | 460.8 | — | — | 6804.7 | L | — | 9.7 | — | — |
| LYD489 | 67785.4 | — | — | — | 5331.2 | L | 10 | — | — | — |
| LYD489 | 67787.4 | — | — | — | 5093.8 | 0.22 | 5 | — | — | — |
| LYD458 | 67922.2 | 434.4 | 0.24 | 6 | — | — | — | — | — | — |
| LYD453 | 67484.1 | 436.9 | 0.07 | 6 | — | — | — | — | — | — |
| LYD453 | 67485.1 | — | — | — | — | — | — | 10.6 | 0.20 | 4 |
| LYD453 | 67487.2 | — | — | — | — | — | — | 11.8 | L | 15 |
| LYD448 | 67918.2 | — | — | — | 5168.8 | 0.16 | 7 | 10.6 | 0.15 | 4 |
| LYD433 | 67700.1 | — | — | — | 5162.5 | 0.26 | 7 | — | — | — |
| LYD433 | 67704.4 | — | — | — | — | — | — | 10.9 | 0.21 | 7 |
| LYD409 | 67467.4 | — | — | — | 5193.8 | 0.05 | 7 | — | — | — |

TABLE 61-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val | % Incr. | Ave. | P-Val. | % Incr. |
| LYD409 | 67468.1 | — | — | — | 5300.0 | 0.30 | 10 | 11.4 | 0.08 | 12 |
| LYD404 | 67690.2 | — | — | — | 5464.6 | 0.13 | 13 | — | — | — |
| LYD403 | 67768.3 | — | — | — | 5087.5 | 0.16 | 5 | — | — | — |
| LYD403 | 67771.1 | — | — | — | 5375.0 | 0.16 | 11 | — | — | — |
| LYD402 | 67760.2 | 451.5 | 0.02 | 10 | 5151.8 | 0.05 | 6 | — | — | — |
| LYD402 | 67762.3 | — | — | — | — | — | — | 11.1 | 0.02 | 9 |
| LYD402 | 67765.3 | — | — | — | 5168.8 | 0.06 | 7 | — | — | — |
| LYD368 | 67659.1 | — | — | — | 5520.5 | 0.24 | 14 | 11.1 | 0.27 | 8 |
| LYD368 | 67659.5 | 460.6 | 0.23 | 12 | — | — | — | — | — | — |
| LYD368 | 67661.1 | — | — | — | 5325.0 | 0.30 | 10 | — | — | — |
| LYD355 | 67640.1 | — | — | — | 5106.2 | 0.20 | 6 | — | — | — |
| LYD347 | 67844.2 | — | — | — | 5450.0 | 0.13 | 13 | — | — | — |
| LYD346 | 67605.4 | — | — | — | 5231.2 | 0.19 | 8 | — | — | — |
| CONT. | — | 411.0 | — | — | 4839.6 | — | — | 10.2 | — | — |
| LYD483 | 68054.3 | 264.4 | 0.16 | 13 | 3631.2 | 0.12 | 12 | — | — | — |
| LYD483 | 68054.4 | 256.2 | 0.14 | 9 | 3487.5 | 0.27 | 8 | — | — | — |
| LYD483 | 68056.4 | 265.0 | 0.06 | 13 | — | — | — | — | — | — |
| LYD478 | 67268.1 | — | — | — | — | — | — | 9.8 | 0.02 | 5 |
| LYD478 | 67269.2 | 265.6 | 0.05 | 13 | 3956.2 | L | 22 | — | — | — |
| LYD478 | 67270.1 | — | — | — | 3637.5 | 0.16 | 12 | — | — | — |
| LYD460 | 67930.1 | 286.2 | L | 22 | — | — | — | — | — | — |
| LYD460 | 67930.3 | — | — | — | — | — | — | 10.3 | 0.04 | 11 |
| LYD423 | 68216.2 | — | — | — | 3600.0 | 0.23 | 11 | — | — | — |
| LYD423 | 68216.3 | 262.5 | 0.06 | 12 | 3600.0 | 0.10 | 11 | — | — | — |
| LYD423 | 68218.7 | — | — | — | 3768.8 | 0.03 | 16 | — | — | — |
| LYD395 | 67077.1 | — | — | — | 3806.2 | 0.14 | 18 | — | — | — |
| LYD395 | 67078.1 | — | — | — | — | — | — | 9.8 | 0.14 | 6 |
| LYD395 | 67080.6 | — | — | — | 3600.0 | 0.21 | 11 | — | — | — |
| LYD392 | 68032.2 | 257.5 | 0.11 | 10 | — | — | — | 9.6 | 0.13 | 3 |
| LYD392 | 68033.3 | — | — | — | 3525.0 | 0.28 | 9 | — | — | — |
| LYD388 | 68098.3 | — | — | — | — | — | — | 9.6 | 0.13 | 3 |
| LYD376 | 68024.2 | — | — | — | 3963.4 | L | 22 | — | — | — |
| LYD376 | 68025.1 | — | — | — | — | — | — | 9.6 | 0.06 | 4 |
| LYD376 | 68026.2 | — | — | — | 3637.5 | 0.08 | 12 | — | — | — |
| LYD367 | 68066.5 | 270.0 | 0.18 | 15 | 3731.2 | 0.11 | 15 | — | — | — |
| LYD367 | 68066.6 | — | — | — | 3550.0 | 0.18 | 10 | — | — | — |
| LYD367 | 68068.5 | 257.5 | 0.11 | 10 | — | — | — | — | — | — |
| LYD365 | 68092.3 | — | — | — | 3556.2 | 0.23 | 10 | — | — | — |
| LYD365 | 68092.4 | — | — | — | 3518.8 | 0.19 | 9 | — | — | — |
| LYD365 | 68092.5 | — | — | — | 3525.0 | 0.20 | 9 | — | — | — |
| LYD361 | 68145.9 | — | — | — | — | — | — | 9.6 | 0.13 | 3 |
| LYD361 | 68146.7 | 255.0 | 0.14 | 9 | 3668.8 | 0.07 | 13 | — | — | — |
| LYD361 | 68147.1 | — | — | — | — | — | — | 9.9 | 0.20 | 6 |
| LYD360 | 68061.2 | — | — | — | — | — | — | 9.8 | 0.14 | 6 |
| LYD360 | 68064.1 | — | — | — | — | — | — | 9.6 | 0.13 | 3 |
| LYD356 | 68139.2 | — | — | — | 3737.5 | 0.04 | 15 | 9.6 | 0.13 | 3 |
| LYD356 | 68140.3 | — | — | — | — | — | — | 9.9 | 0.04 | 6 |
| LYD354 | 68133.6 | — | — | — | 3712.5 | 0.09 | 15 | — | — | — |
| LYD349 | 68084.1 | — | — | — | 3562.5 | 0.14 | 10 | — | — | — |
| LYD349 | 68085.5 | — | — | — | — | — | — | 9.5 | 0.20 | 2 |
| LYD349 | 68085.6 | — | — | — | — | — | — | 9.6 | 0.15 | 4 |
| LYD332 | 66988.1 | 321.2 | L | 37 | 3981.2 | L | 23 | — | — | — |
| LYD332 | 66989.2 | 286.2 | L | 22 | 3700.0 | 0.05 | 14 | — | — | — |
| LYD325 | 67015.4 | — | — | — | 3506.2 | 0.20 | 8 | — | — | — |
| LYD297 | 67227.5 | — | — | — | — | — | — | 9.8 | 0.14 | 6 |
| CONT. | — | 234.6 | — | — | 3237.5 | — | — | 9.3 | — | — |
| LYD434 | 67978.2 | — | — | — | — | — | — | 9.7 | 0.22 | 3.1 |
| LYD434 | 67977.3 | — | — | — | — | — | — | 9.6 | 0.32 | 2.1 |
| CONT. | — | — | — | — | — | — | — | 9.4 | — | — |
| LYD305 | 67535.2 | 440.3 | 0.19 | 10 | 4865.8 | 0.84 | 1.2 | — | — | — |
| CONT. | — | 400.4 | — | — | 4808.2 | — | — | — | — | — |
| LYD481 | 67778.1 | 471.2 | 0.07 | 18.3 | — | — | — | — | — | — |
| LYD491 | 67874.3 | 428.1 | 0.45 | 7.5 | — | — | — | — | — | — |
| LYD435 | 67709.2 | 420.0 | 0.58 | 5.4 | — | — | — | — | — | — |

TABLE 61-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val | % Incr. | Ave. | P-Val. | % Incr. |
| LYD481 | 67779.4 | 420.0 | 0.58 | 5.4 | — | — | — | — | — | — |
| CONT. | — | 398.3 | — | — | — | — | — | — | — | — |

Table 61.
"CONT."—Control;
"Ave."—Average;
"% Incr." = % increment;
"p-val."—p-value,
L—p < 0.01. The transgenes were under the transcriptional regulation of the new At6669 promoter (SEQ ID NO: 14467).
"—" = results are still unavailable.

TABLE 62

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD479 | 67728.5 | — | — | — | — | — | — | 4.5 | 0.07 | 8 |
| LYD396 | 67754.1 | — | — | — | — | — | — | 4.5 | 0.27 | 6 |
| CONT. | — | — | — | — | — | — | — | 4.2 | — | — |
| LYD504 | 67136.2 | 79.9 | 0.03 | 16 | 10.0 | 0.03 | 16 | 5.5 | L | 10 |
| LYD484 | 67135.3 | — | — | — | — | — | — | 5.2 | 0.15 | 4 |
| LYD478 | 67269.2 | 79.6 | L | 15 | 10.0 | L | 15 | 5.5 | L | 11 |
| LYD478 | 67272.3 | 74.9 | 0.16 | 8 | 9.4 | 0.16 | 8 | — | — | — |
| LYD470 | 67126.7 | — | — | — | — | — | — | 5.1 | 0.24 | 3 |
| LYD470 | 67127.3 | — | — | — | — | — | — | 5.1 | 0.19 | 3 |
| LYD440 | 66903.1 | 75.7 | 0.06 | 9 | 9.5 | 0.06 | 9 | 5.3 | L | 7 |
| LYD438 | 66898.3 | — | — | — | — | — | — | 5.2 | 0.16 | 4 |
| LYD438 | 66899.2 | 82.4 | 0.21 | 19 | 10.3 | 0.21 | 19 | 5.6 | 0.05 | 12 |
| LYD438 | 66900.3 | 74.5 | 0.15 | 8 | 9.3 | 0.15 | 8 | 5.2 | 0.18 | 5 |
| LYD414 | 67091.1 | — | — | — | — | — | — | 5.1 | 0.25 | 2 |
| LYD408 | 67305.6 | 74.4 | 0.26 | 8 | 9.3 | 0.26 | 8 | — | — | — |
| LYD387 | 67317.4 | 74.5 | 0.07 | 8 | 9.3 | 0.07 | 8 | 5.3 | 0.09 | 7 |
| LYD385 | 66893.1 | — | — | — | — | — | — | 5.2 | 0.08 | 4 |
| LYD385 | 66893.2 | — | — | — | — | — | — | 5.2 | 0.09 | 5 |
| LYD342 | 67063.2 | — | — | — | — | — | — | 5.2 | 0.05 | 4 |
| LYD337 | 66995.4 | — | — | — | — | — | — | 5.1 | 0.19 | 3 |
| LYD332 | 66988.2 | 74.4 | 0.20 | 7 | 9.3 | 0.20 | 7 | 5.4 | 0.06 | 7 |
| LYD330 | 67046.2 | 83.5 | L | 21 | 10.4 | L | 21 | 5.5 | 0.01 | 11 |
| LYD330 | 67050.2 | — | — | — | — | — | — | 5.5 | 0.02 | 10 |
| LYD329 | 67277.4 | 74.2 | 0.07 | 7 | 9.3 | 0.07 | 7 | 5.1 | 0.19 | 3 |
| LYD320 | 67040.2 | — | — | — | — | — | — | 5.4 | 0.26 | 7 |
| LYD318 | 66983.4 | 76.1 | 0.08 | 10 | 9.5 | 0.08 | 10 | 5.3 | 0.03 | 7 |
| LYD315 | 67005.2 | — | — | — | — | — | — | 5.2 | 0.25 | 3 |
| LYD315 | 67007.1 | 75.7 | 0.09 | 9 | 9.5 | 0.09 | 9 | 5.3 | L | 7 |
| LYD307 | 66975.3 | — | — | — | — | — | — | 5.1 | 0.20 | 3 |
| LYD307 | 66976.3 | — | — | — | — | — | — | 5.2 | 0.09 | 4 |
| CONT. | — | 69.2 | — | — | 8.6 | — | — | 5.0 | — | — |
| LYD471 | 68050.2 | 48.2 | 0.06 | 21 | 6.0 | 0.06 | 21 | 4.3 | 0.09 | 6 |
| LYD471 | 68050.4 | 47.6 | 0.02 | 19 | 6.0 | 0.02 | 19 | 4.5 | 0.07 | 10 |
| LYD446 | 68109.4 | 45.8 | 0.06 | 15 | 5.7 | 0.06 | 15 | 4.4 | L | 9 |
| LYD446 | 68110.3 | 48.1 | L | 20 | 6.0 | L | 20 | 4.3 | 0.10 | 5 |
| LYD438 | 66899.2 | 42.4 | 0.20 | 6 | 5.3 | 0.20 | 6 | — | — | — |
| LYD432 | 67961.5 | — | — | — | — | — | — | 4.2 | 0.22 | 2 |
| LYD422 | 68103.3 | 46.3 | 0.18 | 16 | 5.8 | 0.18 | 16 | 4.2 | 0.25 | 4 |
| LYD417 | 68043.3 | 44.3 | 0.04 | 11 | 5.5 | 0.04 | 11 | — | — | — |
| LYD385 | 66891.2 | 47.1 | L | 18 | 5.9 | L | 18 | 4.3 | 0.02 | 7 |
| LYD385 | 66891.3 | 51.9 | 0.04 | 30 | 6.5 | 0.04 | 30 | 4.5 | 0.04 | 10 |
| LYD368 | 67660.4 | 45.4 | 0.07 | 14 | 5.7 | 0.07 | 14 | 4.2 | 0.11 | 5 |
| LYD364 | 68018.3 | 42.2 | 0.21 | 6 | 5.3 | 0.21 | 6 | — | — | — |
| LYD364 | 68020.5 | 49.9 | 0.05 | 25 | 6.2 | 0.05 | 25 | 4.4 | 0.10 | 9 |
| LYD351 | 68126.2 | 48.4 | 0.12 | 21 | 6.1 | 0.12 | 21 | 4.3 | 0.07 | 6 |
| LYD351 | 68129.3 | 45.3 | 0.24 | 13 | 5.7 | 0.24 | 13 | 4.2 | 0.23 | 3 |
| LYD330 | 67047.8 | 43.2 | 0.13 | 8 | 5.4 | 0.13 | 8 | 4.2 | 0.10 | 4 |
| LYD315 | 67004.4 | 43.3 | 0.10 | 8 | 5.4 | 0.10 | 8 | — | — | — |
| LYD315 | 67006.2 | 42.2 | 0.24 | 6 | 5.3 | 0.24 | 6 | — | — | — |
| LYD315 | 67007.4 | 43.6 | 0.09 | 9 | 5.4 | 0.09 | 9 | — | — | — |

TABLE 62-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD299 | 68115.4 | 46.1 | 0.07 | 16 | 5.8 | 0.07 | 16 | 4.3 | 0.16 | 6 |
| LYD299 | 68118.5 | 45.0 | 0.02 | 13 | 5.6 | 0.02 | 13 | 4.2 | 0.08 | 4 |
| CONT. | — | 39.9 | — | — | 5.0 | — | — | 4.1 | — | — |
| LYD517 | 67221.3 | 51.3 | 0.17 | 16 | 6.4 | 0.17 | 16 | 4.5 | 0.23 | 8 |
| LYD517 | 67221.5 | 54.1 | 0.02 | 22 | 6.8 | 0.02 | 22 | 4.8 | L | 15 |
| LYD517 | 67222.1 | 53.1 | 0.21 | 20 | 6.6 | 0.21 | 20 | 4.6 | 0.11 | 10 |
| LYD515 | 67151.1 | 61.3 | L | 39 | 7.7 | L | 39 | 5.0 | L | 21 |
| LYD515 | 67151.6 | — | — | — | — | — | — | 4.4 | 0.19 | 6 |
| LYD515 | 67152.4 | — | — | — | — | — | — | 4.5 | 0.17 | 8 |
| LYD512 | 67209.1 | 49.2 | 0.14 | 11 | 6.2 | 0.14 | 11 | 4.5 | 0.10 | 8 |
| LYD512 | 67212.2 | 56.4 | 0.05 | 27 | 7.0 | 0.05 | 27 | 4.8 | 0.15 | 15 |
| LYD502 | 67342.6 | 53.2 | 0.05 | 20 | 6.7 | 0.05 | 20 | 4.6 | 0.04 | 11 |
| LYD498 | 67254.3 | 49.2 | 0.19 | 11 | 6.2 | 0.19 | 11 | — | — | — |
| LYD482 | 67334.1 | 55.2 | 0.15 | 25 | 6.9 | 0.15 | 25 | 4.7 | 0.16 | 14 |
| LYD475 | 67204.2 | 48.0 | 0.28 | 8 | 6.0 | 0.28 | 8 | 4.5 | 0.14 | 9 |
| LYD454 | 67193.4 | 54.9 | 0.13 | 24 | 6.9 | 0.13 | 24 | 4.6 | 0.05 | 11 |
| LYD452 | 67106.1 | 47.7 | 0.29 | 8 | 6.0 | 0.29 | 8 | 4.4 | 0.14 | 7 |
| LYD452 | 67106.2 | 52.5 | 0.05 | 19 | 6.6 | 0.05 | 19 | 4.6 | 0.03 | 11 |
| LYD452 | 67106.4 | — | — | — | — | — | — | 4.4 | 0.15 | 7 |
| LYD452 | 67108.1 | 48.2 | 0.30 | 9 | 6.0 | 0.30 | 9 | 4.3 | 0.28 | 5 |
| LYD451 | 67187.7 | 51.3 | 0.20 | 16 | 6.4 | 0.20 | 16 | 4.7 | 0.22 | 12 |
| LYD451 | 67188.4 | 52.6 | 0.02 | 19 | 6.6 | 0.02 | 19 | 4.6 | 0.04 | 11 |
| LYD450 | 67182.2 | 51.4 | 0.11 | 16 | 6.4 | 0.11 | 16 | 4.5 | 0.11 | 9 |
| LYD445 | 67352.3 | — | — | — | — | — | — | 4.5 | 0.23 | 8 |
| LYD439 | 67094.1 | 50.3 | 0.19 | 14 | 6.3 | 0.19 | 14 | 4.5 | 0.08 | 10 |
| LYD439 | 67096.1 | 61.0 | 0.16 | 38 | 7.6 | 0.16 | 38 | 4.9 | 0.11 | 19 |
| LYD415 | 67262.1 | 58.2 | L | 31 | 7.3 | L | 31 | 4.9 | L | 18 |
| LYD415 | 67264.5 | 49.1 | 0.22 | 11 | 6.1 | 0.22 | 11 | 4.4 | 0.20 | 6 |
| LYD415 | 67266.3 | 55.6 | L | 26 | 7.0 | L | 26 | 4.8 | 0.01 | 15 |
| LYD415 | 67266.6 | 51.7 | 0.04 | 17 | 6.5 | 0.04 | 17 | 4.6 | 0.07 | 10 |
| LYD399 | 67448.3 | 63.9 | L | 44 | 8.0 | L | 44 | 5.1 | L | 23 |
| LYD339 | 67247.3 | 54.4 | 0.01 | 23 | 6.8 | 0.01 | 23 | 4.8 | L | 16 |
| LYD328 | 67242.1 | 53.5 | 0.03 | 21 | 6.7 | 0.03 | 21 | 4.7 | 0.05 | 12 |
| LYD324 | 67168.4 | 49.9 | 0.15 | 13 | 6.2 | 0.15 | 13 | 4.4 | 0.11 | 7 |
| LYD323 | 67287.1 | — | — | — | — | — | — | 4.7 | 0.26 | 14 |
| LYD323 | 67288.2 | 57.9 | 0.04 | 31 | 7.2 | 0.04 | 31 | 4.7 | 0.05 | 14 |
| LYD321 | 67280.1 | 58.2 | 0.09 | 31 | 7.3 | 0.09 | 31 | 4.8 | 0.17 | 15 |
| LYD321 | 67281.6 | 52.6 | 0.27 | 19 | 6.6 | 0.27 | 19 | — | — | — |
| LYD321 | 67283.1 | 54.3 | 0.11 | 23 | 6.8 | 0.11 | 23 | 4.7 | 0.10 | 13 |
| LYD316 | 67439.1 | 49.5 | 0.12 | 12 | 6.2 | 0.12 | 12 | 4.4 | 0.21 | 5 |
| LYD312 | 67256.3 | 49.3 | 0.14 | 11 | 6.2 | 0.14 | 11 | 4.3 | 0.25 | 5 |
| LYD312 | 67256.4 | 57.2 | 0.09 | 29 | 7.2 | 0.09 | 29 | 4.7 | 0.18 | 14 |
| LYD312 | 67257.3 | 52.2 | 0.05 | 18 | 6.5 | 0.05 | 18 | 4.6 | 0.02 | 12 |
| LYD310 | 67163.1 | 53.5 | 0.06 | 21 | 6.7 | 0.06 | 21 | 4.7 | 0.01 | 14 |
| LYD309 | 67418.1 | — | — | — | — | — | — | 4.4 | 0.22 | 6 |
| LYD309 | 67418.3 | 52.8 | 0.04 | 19 | 6.6 | 0.04 | 19 | 4.5 | 0.06 | 9 |
| LYD309 | 67420.1 | 47.7 | 0.29 | 8 | 6.0 | 0.29 | 8 | 4.3 | 0.25 | 5 |
| LYD296 | 67359.1 | 61.2 | L | 38 | 7.7 | L | 38 | 5.0 | L | 21 |
| LYD296 | 67359.3 | 63.9 | 0.13 | 44 | 8.0 | 0.13 | 44 | 5.2 | 0.02 | 26 |
| LYD291 | 67400.2 | 47.9 | 0.25 | 8 | 6.0 | 0.25 | 8 | 4.4 | 0.12 | 7 |
| LYD291 | 67400.5 | 55.9 | L | 26 | 7.0 | L | 26 | 4.7 | L | 13 |
| LYD291 | 67401.4 | 53.5 | 0.02 | 21 | 6.7 | 0.02 | 21 | 4.7 | L | 13 |
| LYD290 | 67233.3 | — | — | — | — | — | — | 4.4 | 0.17 | 7 |
| LYD290 | 67236.4 | — | — | — | — | — | — | 4.4 | 0.29 | 6 |
| CONT. | — | 44.3 | — | — | 5.5 | — | — | 4.1 | — | — |
| LYD501 | 67889.1 | — | — | — | — | — | — | 4.9 | 0.07 | 8 |
| LYD489 | 67787.3 | — | — | — | — | — | — | 4.9 | 0.22 | 7 |
| LYD453 | 67487.2 | 70.8 | 0.08 | 18 | 8.8 | 0.08 | 18 | 5.0 | 0.25 | 10 |
| LYD448 | 67918.2 | 70.5 | 0.02 | 18 | 8.8 | 0.02 | 18 | 5.0 | 0.02 | 10 |
| LYD409 | 67468.1 | 73.2 | L | 22 | 9.2 | L | 22 | 4.9 | 0.05 | 9 |
| LYD403 | 67770.3 | 67.0 | 0.22 | 12 | 8.4 | 0.22 | 12 | — | — | — |
| LYD402 | 67762.3 | 78.1 | L | 30 | 9.8 | L | 30 | 5.3 | L | 16 |
| LYD368 | 67659.1 | 74.3 | 0.27 | 24 | 9.3 | 0.27 | 24 | 5.0 | 0.19 | 11 |
| LYD347 | 67844.2 | 71.5 | 0.23 | 19 | 8.9 | 0.23 | 19 | 5.0 | 0.19 | 9 |
| LYD347 | 67845.1 | — | — | — | — | — | — | 4.9 | 0.23 | 7 |
| LYD347 | 67847.3 | — | — | — | — | — | — | 4.9 | 0.27 | 7 |
| LYD346 | 67605.4 | 74.1 | L | 24 | 9.3 | L | 24 | 5.1 | L | 13 |
| LYD346 | 67606.2 | — | — | — | — | — | — | 5.0 | 0.02 | 10 |
| CONT. | — | 59.9 | — | — | 7.5 | — | — | 4.6 | — | — |
| LYD483 | 68054.1 | — | — | — | — | — | — | 3.8 | 0.25 | 4 |
| LYD483 | 68054.4 | — | — | — | — | — | — | 3.8 | 0.21 | 4 |
| LYD483 | 68056.4 | 36.5 | 0.22 | 9 | 4.6 | 0.22 | 9 | 3.9 | 0.25 | 6 |
| LYD483 | 68056.5 | 36.2 | L | 8 | 4.5 | L | 8 | 3.9 | 0.01 | 8 |

TABLE 62-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD478 | 67269.2 | 37.7 | 0.08 | 12 | 4.7 | 0.08 | 12 | 4.0 | L | 9 |
| LYD478 | 67270.1 | 39.6 | 0.10 | 18 | 4.9 | 0.10 | 18 | 4.0 | 0.03 | 9 |
| LYD423 | 68216.2 | 41.1 | 0.17 | 22 | 5.1 | 0.17 | 22 | 4.1 | 0.21 | 13 |
| LYD423 | 68218.7 | 38.9 | L | 16 | 4.9 | L | 16 | 4.0 | 0.16 | 10 |
| LYD395 | 67077.1 | 39.0 | L | 16 | 4.9 | L | 16 | 4.0 | L | 10 |
| LYD395 | 67080.6 | 38.9 | L | 16 | 4.9 | L | 16 | 3.9 | 0.22 | 7 |
| LYD392 | 68030.1 | 38.4 | L | 14 | 4.8 | L | 14 | 4.0 | L | 9 |
| LYD392 | 68032.2 | — | — | — | — | — | — | 4.1 | 0.16 | 13 |
| LYD392 | 68033.3 | 44.4 | 0.13 | 32 | 5.6 | 0.13 | 32 | 4.2 | 0.14 | 16 |
| LYD392 | 68035.1 | — | — | — | — | — | — | 3.9 | 0.18 | 8 |
| LYD388 | 68096.5 | — | — | — | — | — | — | 3.8 | 0.03 | 3 |
| LYD388 | 68098A | — | — | — | — | — | — | 3.9 | 0.20 | 7 |
| LYD376 | 68024.2 | 41.1 | 0.23 | 22 | 5.1 | 0.23 | 22 | 4.1 | 0.23 | 12 |
| LYD376 | 68026.2 | 36.7 | 0.08 | 9 | 4.6 | 0.08 | 9 | 4.0 | L | 8 |
| LYD367 | 68066.1 | — | — | — | — | — | — | 3.9 | 0.08 | 7 |
| LYD367 | 68066.5 | 36.8 | 0.01 | 10 | 4.6 | 0.01 | 10 | 4.0 | L | 9 |
| LYD367 | 68068.5 | 36.3 | 0.07 | 8 | 4.5 | 0.07 | 8 | — | — | — |
| LYD365 | 68092.3 | 35.3 | 0.24 | 5 | 4.4 | 0.24 | 5 | 3.8 | 0.10 | 4 |
| LYD365 | 68092.4 | 40.4 | L | 20 | 5.1 | L | 20 | 4.0 | 0.01 | 10 |
| LYD365 | 68092.5 | — | — | — | — | — | — | 3.9 | 0.03 | 6 |
| LYD361 | 68146.7 | 40.3 | 0.10 | 20 | 5.0 | 0.10 | 20 | 4.1 | 0.08 | 11 |
| LYD360 | 68061.2 | 42.2 | 0.06 | 26 | 5.3 | 0.06 | 26 | 4.1 | 0.12 | 11 |
| LYD360 | 68064.1 | — | — | — | — | — | — | 3.7 | 0.11 | 3 |
| LYD356 | 68139.2 | 39.9 | 0.11 | 19 | 5.0 | 0.11 | 19 | 4.0 | 0.16 | 9 |
| LYD356 | 68142.2 | — | — | — | — | — | — | 3.8 | 0.07 | 4 |
| LYD354 | 68133.6 | 40.8 | 0.01 | 21 | 5.1 | 0.01 | 21 | 4.1 | L | 12 |
| LYD354 | 68133.9 | — | — | — | — | — | — | 3.8 | 0.05 | 3 |
| LYD354 | 68134.1 | — | — | — | — | — | — | 3.7 | 0.13 | 2 |
| LYD349 | 68084.1 | 36.3 | 0.26 | 8 | 4.5 | 0.26 | 8 | 3.9 | 0.26 | 5 |
| LYD349 | 68085.3 | 40.7 | 0.03 | 21 | 5.1 | 0.03 | 21 | 4.0 | L | 9 |
| LYD332 | 669S8.1 | 41.2 | L | 22 | 5.1 | L | 22 | 4.2 | L | 14 |
| LYD332 | 66988.2 | — | — | — | — | — | — | 3.9 | 0.16 | 7 |
| LYD332 | 66989.2 | — | — | — | — | — | — | 3.9 | 0.24 | 8 |
| LYD325 | 67013.2 | — | — | — | — | — | — | 3.8 | 0.09 | 5 |
| CONT. | — | 33.6 | — | — | 4.2 | — | — | 3.7 | — | — |

Table 62.
"CONT."—Control;
"Ave."—Average;
"% Incr." = % increment;
"p-val."—p-value,
L—p < 0.01. The transgenes were under the transcriptional regulation of the new At6669 promoter (SEQ ID NO: 14467).
"—" = results are still unavailable.

TABLE 63

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD496 | 67741.5 | 0.8 | 0.25 | 14 | — | — | — | — | — | — |
| LYD479 | 67728.5 | — | — | — | — | — | — | 0.4 | 0.27 | 10 |
| LYD396 | 67754.1 | — | — | — | 7.2 | 0.25 | 16 | — | — | — |
| CONT. | — | 0.7 | — | — | 6.2 | — | — | 0.4 | — | — |
| LYD504 | 67136.2 | — | — | — | 10.1 | 0.15 | 16 | 0.5 | 0.15 | 9 |
| LYD484 | 67133.3 | 0.8 | 0.10 | 12 | — | — | — | — | — | — |
| LYD484 | 67135.3 | — | — | — | — | — | — | 0.5 | 0.29 | 7 |
| LYD478 | 67269.2 | — | — | — | 10.2 | 0.11 | 17 | 0.5 | 0.02 | 15 |
| LYD466 | 67118.1 | 0.9 | 0.01 | 23 | — | — | — | 0.5 | 0.30 | 7 |
| LYD440 | 66903.1 | 0.8 | 0.06 | 16 | 9.7 | 0.29 | 11 | 0.5 | 0.20 | 8 |
| LYD438 | 66899.2 | — | — | — | 10.5 | 0.07 | 20 | 0.5 | 0.04 | 14 |
| LYD387 | 67317.4 | 0.8 | 0.13 | 11 | — | — | — | 0.5 | 0.11 | 11 |
| LYD385 | 66893.1 | — | — | — | — | — | — | 0.5 | 0.28 | 7 |
| LYD375 | 67071.4 | — | — | — | — | — | — | 0.5 | 0.21 | 9 |
| LYD342 | 67063.2 | — | — | — | — | — | — | 0.5 | 0.24 | 7 |
| LYD334 | 67294.3 | 0.8 | 0.03 | 17 | — | — | — | — | — | — |

TABLE 63-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD332 | 66988.2 | — | — | — | — | — | — | 0.5 | 0.22 | 8 |
| LYD330 | 67046.2 | — | — | — | 10.5 | 0.06 | 20 | 0.5 | 0.07 | 12 |
| LYD330 | 67050.2 | 0.8 | 0.25 | 9 | 10.1 | 0.16 | 16 | 0.5 | 0.06 | 12 |
| LYD330 | 67050.5 | 0.8 | 0.20 | 9 | — | — | — | — | — | — |
| LYD318 | 66973.4 | — | — | — | — | — | — | 0.5 | 0.07 | 12 |
| LYD315 | 67004.4 | 0.8 | 0.04 | 15 | — | — | — | — | — | — |
| LYD315 | 67007.1 | 0.8 | 0.07 | 15 | — | — | — | — | — | — |
| LYD315 | 67007.4 | 0.8 | 0.12 | 13 | — | — | — | 0.5 | 0.24 | 8 |
| LYD307 | 66976.3 | 0.8 | 0.12 | 11 | — | — | — | 0.5 | 0.20 | 8 |
| LYD272 | 66998.3 | — | — | — | 10.0 | 0.18 | 15 | — | — | — |
| CONT. | — | 0.7 | — | — | 8.7 | — | — | 0.4 | — | — |
| LYD471 | 68050.2 | — | — | — | 6.2 | 0.14 | 22 | — | — | — |
| LYD471 | 68050.4 | — | — | — | 6.0 | 0.19 | 19 | — | — | — |
| LYD446 | 68110.3 | — | — | — | 6.2 | 0.15 | 22 | — | — | — |
| LYD422 | 68102.3 | — | — | — | 6.1 | 0.17 | 22 | — | — | — |
| LYD422 | 68103.3 | — | — | — | 5.9 | 0.26 | 17 | — | — | — |
| LYD417 | 68043.1 | — | — | — | 5.9 | 0.28 | 17 | — | — | — |
| LYD385 | 66891.3 | — | — | — | 6.6 | 0.04 | 32 | — | — | — |
| LYD364 | 68020.5 | — | — | — | 6.4 | 0.09 | 26 | — | — | — |
| LYD351 | 68126.2 | — | — | — | 6.1 | 0.19 | 20 | — | — | — |
| LYD330 | 67046.2 | — | — | — | 6.0 | 0.22 | 19 | — | — | — |
| LYD309 | 67421.4 | 0.7 | 0.16 | 21 | — | — | — | — | — | — |
| CONT. | — | 0.6 | — | — | 5.0 | — | — | — | — | — |
| LYD517 | 67221.5 | — | — | — | 6.9 | 0.16 | 22 | 0.4 | 0.15 | 19 |
| LYD517 | 67222.1 | — | — | — | 6.8 | 0.20 | 21 | — | — | — |
| LYD515 | 67151.1 | — | — | — | 7.9 | 0.02 | 39 | 0.4 | 0.07 | 24 |
| LYD512 | 67212.2 | — | — | — | 7.2 | 0.10 | 27 | 0.4 | 0.21 | 16 |
| LYD502 | 67342.6 | — | — | — | 6.8 | 0.20 | 20 | — | — | — |
| LYD482 | 67334.1 | — | — | — | 7.1 | 0.13 | 25 | 0.4 | 0.14 | 19 |
| LYD475 | 67204.2 | — | — | — | — | — | — | 0.4 | 0.20 | 16 |
| LYD475 | 67204.4 | — | — | — | 7.1 | 0.14 | 25 | 0.4 | 0.30 | 15 |
| LYD454 | 67193.4 | — | — | — | 7.1 | 0.13 | 25 | 0.4 | 0.30 | 13 |
| LYD452 | 67106.2 | — | — | — | 6.7 | 0.25 | 18 | — | — | — |
| LYD451 | 67188.4 | — | — | — | 6.7 | 0.26 | 18 | — | — | — |
| LYD439 | 67096.1 | — | — | — | 7.8 | 0.03 | 38 | 0.4 | 0.15 | 19 |
| LYD415 | 67262.1 | — | — | — | 7.5 | 0.06 | 31 | 0.4 | 0.11 | 20 |
| LYD415 | 67266.3 | — | — | — | 7.1 | 0.11 | 26 | 0.4 | 0.19 | 17 |
| LYD399 | 67448.3 | — | — | — | 8.3 | L | 46 | 0.5 | 0.04 | 28 |
| LYD339 | 67247.3 | — | — | — | 7.0 | 0.14 | 24 | 0.4 | 0.10 | 21 |
| LYD328 | 67242.1 | — | — | — | 6.9 | 0.17 | 22 | 0.4 | 0.15 | 18 |
| LYD323 | 67287.1 | — | — | — | 7.1 | 0.15 | 24 | 0.4 | 0.26 | 15 |
| LYD323 | 67288.2 | — | — | — | 7.4 | 0.06 | 31 | 0.4 | 0.25 | 15 |
| LYD321 | 67280.1 | — | — | — | 7.5 | 0.05 | 33 | 0.4 | 0.16 | 18 |
| LYD321 | 67281.6 | — | — | — | 6.7 | 0.25 | 19 | — | — | — |
| LYD321 | 67283.1 | — | — | — | 6.9 | 0.17 | 22 | — | — | — |
| LYD316 | 67437.2 | — | — | — | 6.8 | 0.25 | 20 | — | — | — |
| LYD312 | 67256.4 | — | — | — | 7.3 | 0.07 | 29 | 0.4 | 0.26 | 15 |
| LYD312 | 67257.3 | — | — | — | 6.6 | 0.29 | 17 | — | — | — |
| LYD310 | 67163.1 | — | — | — | 6.8 | 0.21 | 20 | 0.4 | 0.26 | 15 |
| LYD309 | 67418.3 | — | — | — | 6.7 | 0.24 | 19 | — | — | — |
| LYD296 | 67359.1 | — | — | — | 7.9 | 0.02 | 39 | 0.5 | 0.05 | 25 |
| LYD296 | 67359.3 | — | — | — | 8.1 | 0.01 | 44 | 0.5 | 0.03 | 29 |
| LYD291 | 67400.5 | — | — | — | 7.1 | 0.11 | 26 | 0.4 | 0.23 | 15 |
| LYD291 | 67401.4 | — | — | — | 6.9 | 0.19 | 21 | 0.4 | 0.22 | 16 |
| CONT. | — | — | — | — | 5.7 | — | — | 0.4 | — | — |
| LYD453 | 67487.2 | 0.8 | 0.18 | 17 | 8.8 | 0.14 | 17 | — | — | — |
| LYD448 | 67918.2 | — | — | — | 8.9 | 0.12 | 17 | — | — | — |
| LYD409 | 67468.1 | — | — | — | 9.0 | 0.09 | 19 | — | — | — |
| LYD403 | 67770.3 | — | — | — | 8.5 | 0.28 | 13 | — | — | — |
| LYD402 | 67762.1 | — | — | — | 8.8 | 0.27 | 17 | — | — | — |
| LYD402 | 67762.3 | — | — | — | 9.6 | 0.03 | 27 | — | — | — |
| LYD368 | 67659.1 | — | — | — | 9.3 | 0.06 | 23 | — | — | — |
| LYD347 | 67844.2 | — | — | — | 8.9 | 0.13 | 18 | — | — | — |
| LYD346 | 67605.4 | — | — | — | 9.2 | 0.06 | 22 | 0.5 | 0.18 | 12 |
| CONT | — | 0.7 | — | — | 7.5 | — | — | 0.4 | — | — |
| LYD478 | 67270.1 | — | — | — | 4.9 | 0.24 | 17 | — | — | — |
| LYD460 | 67930.3 | 0.8 | 0.03 | 36 | — | — | — | — | — | — |
| LYD460 | 67931.2 | 0.6 | 0.28 | 16 | — | — | — | — | — | — |
| LYD423 | 68216.2 | — | — | — | 5.2 | 0.11 | 24 | 0.4 | 0.18 | 14 |
| LYD423 | 68218.3 | 0.7 | 0.21 | 20 | — | — | — | — | — | — |
| LYD423 | 68218.7 | — | — | — | 4.9 | 0.24 | 17 | 0.3 | 0.23 | 12 |

TABLE 63-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD395 | 67077.1 | — | — | — | 4.9 | 0.23 | 17 | 0.3 | 0.26 | 11 |
| LYD395 | 67080.6 | — | — | — | 4.9 | 0.25 | 16 | — | — | — |
| LYD392 | 68032.2 | — | — | — | 4.9 | 0.25 | 17 | 0.4 | 0.17 | 14 |
| LYD392 | 68033.3 | — | — | — | 5.5 | 0.05 | 31 | 0.4 | 0.17 | 15 |
| LYD392 | 68035.1 | — | — | — | — | — | — | 0.3 | 0.27 | 11 |
| LYD376 | 68024.2 | — | — | — | 5.2 | 0.14 | 22 | 0.4 | 0.19 | 14 |
| LYD376 | 68025.3 | 0.6 | 0.25 | 17 | — | — | — | — | — | — |
| LYD376 | 68026.2 | — | — | — | — | — | — | 0.3 | 0.26 | 11 |
| LYD367 | 68066.5 | — | — | — | — | — | — | 0.3 | 0.24 | 13 |
| LYD365 | 68092.4 | — | — | — | 5.1 | 0.14 | 21 | 0.3 | 0.24 | 11 |
| LYD361 | 68146.5 | — | — | — | 4.9 | 0.28 | 16 | — | — | — |
| LYD361 | 68146.7 | — | — | — | 5.1 | 0.14 | 21 | 0.6 | 0.22 | 12 |
| LYD360 | 68061.2 | — | — | — | 5.3 | 0.10 | 25 | — | — | — |
| LYD360 | 68063.2 | 0.7 | 0.28 | 18 | — | — | — | — | — | — |
| LYD356 | 68139.2 | — | — | — | 5.0 | 0.21 | 18 | — | — | — |
| LYD356 | 68142.2 | 0.7 | 0.20 | 20 | — | — | — | — | — | — |
| LYD354 | 68133.6 | — | — | — | 5.2 | 0.13 | 22 | 0.3 | 0.23 | 12 |
| LYD349 | 68085.3 | — | — | — | 5.1 | 0.15 | 21 | — | — | — |
| LYD332 | 66988.1 | — | — | — | 5.2 | 0.12 | 23 | 0.4 | 0.10 | 17 |
| LYD332 | 66989.2 | — | — | — | 4.9 | 0.27 | 16 | — | — | — |
| CONT. | — | 0.6 | — | — | 4.2 | — | — | 0.3 | — | — |

Table 63.
"CONT."—Control;
"Ave."—Average;
"% Incr." = % increment;
"p-val"—p-value,
L—p < 0.01.
The transgenes were under the transcriptional regulation of the new At6669 promoter (SEQ ID NO: 14467).
"—" = results are still unavailable.

TABLE 64

Genes showing improved plant performance at Normal growth conditions under regulation of At6669 promoter

| Gene Name | Event # | Petiole Relative Area TP2 | | | Petiole Relative Area TP3 | | | Petiole Relative Area TP4 | | |
|---|---|---|---|---|---|---|---|---|---|---|
| | | Ave. | P-Val. | % Incr. | Ave. | P-Val. | % Incr. | Ave. | P-Val. | % Incr. |
| LYD520 | 67310.2 | 11.6 | 0.068 | 14.9 | 14.2 | 0.53 | 2.9 | | | |
| LYD520 | 67310.1 | 11.6 | 0.074 | 14.3 | | | | | | |
| LYD520 | 67310.3 | 11.5 | 0.076 | 14.0 | | | | | | |
| LYD520 | 67313.3 | 11.5 | 0.078 | 13.9 | | | | | | |
| LYD520 | 67312.1 | 11.5 | 0.085 | 13.2 | | | | | | |
| LYD519 | 67156.2 | 10.8 | 0.42 | 6.9 | | | | | | |
| LYD519 | 67157.2 | 10.7 | 0.43 | 6.5 | | | | | | |
| LYD519 | 67154.3 | 10.7 | 0.44 | 6.3 | | | | | | |

Table 64.
"CONT."—Control;
"Ave."—Average;
"% Incr." = % increment;
"p-val"—p-value,
L—p < 0.01.
The transgenes were under the transcriptional regulation of the new At6669 promoter (SEQ ID NO: 14467).
"TP" = a relative time point between measurements.
"—" = results are still unavailable.

Example 18

Evaluating Transgenic *Arabidopsis* Under Normal Conditions Using In Vitro Assays [Tissue Culture T2 and T1 Plants, TC-T2 and TC-T1 Assays]

Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N). For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-F). An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate for the various seedling parameters was calculated according to the following formulas XIV (RGR leaf area), and XV (RGR root length).

Relative growth rate of leaf area=Regression coefficient of leaf area along time course.      Formula XIV:

Relative growth rate of root length=Regression coefficient of root length along time course.      Formula XV:

At the end of the experiment, plantlets were removed from the media and weighed for the determination of plant fresh weight. Plantlets were then dried for 24 hours at 60° C., and weighed again to measure plant dry weight for later statistical analysis. The fresh and dry weights are provided for each *Arabidopsis* plant. Growth rate was determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events were examined in replicates.

Statistical analyses—To identify genes conferring significantly improved plant vigor or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if $p \leq 0.1$. The JMP statistics software package was used (Version 5.2.1, SAS Institute Inc., Cary, N.C., USA).

Experimental Results:

Tables 65-67 summarize the observed phenotypes of transgenic plants expressing the gene constructs using the TC-T2 Assays.

The genes presented in Table 65 showed a significant improvement as they produced larger plant biomass (plant fresh and dry weight) in T2 generation when grown under normal growth conditions, compared to control plants. The genes were cloned under the regulation of a constitutive promoter (At6669, SEQ ID NO:14467).

The evaluation of each gene was carried out by testing the performance of different number of events. Some of the genes were evaluated in more than one tissue culture assay. The results obtained in these second experiments were significantly positive as well.

TABLE 65

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYD480 | 68333.4 | 11.6 | 0.02 | 88 | 223.1 | 0.03 | 95 |
| LYD477 | 68234.4 | 10.0 | 0.16 | 62 | 194.1 | 0.12 | 70 |
| LYD477 | 68237.2 | 8.6 | 0.14 | 39 | 170.6 | 0.06 | 49 |
| LYD470 | 67126.7 | 10.0 | 0.06 | 62 | 181.5 | 0.04 | 59 |
| LYD420 | 68342.1 | 14.1 | 0.02 | 128 | 242.3 | 0.02 | 112 |
| LYD419 | 67911.3 | 11.7 | 0.11 | 90 | 216.0 | 0.11 | 89 |
| LYD418 | 68336.1 | 8.1 | 0.25 | 32 | — | — | — |
| LYD398 | 68038.2 | 8.0 | 0.29 | 29 | 152.2 | 0.21 | 33 |
| LYD377 | 67952.3 | 8.1 | 0.29 | 31 | — | — | — |
| LYD358 | 68274.1 | — | — | — | 158.3 | 0.22 | 39 |
| LYD352 | 68328.3 | 8.8 | 0.25 | 43 | 160.3 | 0.18 | 40 |
| CONT. | — | 6.2 | — | — | 114.3 | — | — |
| LYD507 | 67552.3 | 14.5 | L | 133 | 276.8 | L | 125 |
| LYD507 | 67552.5 | 9.8 | 0.10 | 57 | 180.2 | 0.16 | 47 |
| LYD507 | 67553.4 | 10.3 | 0.28 | 65 | 209.9 | 0.24 | 71 |
| LYD487 | 67498.1 | — | — | — | 156.7 | 0.24 | 27 |
| LYD487 | 67498.3 | 9.8 | 0.02 | 58 | 212.8 | 0.02 | 73 |
| LYD487 | 67500.1 | 9.4 | 0.26 | 51 | 186.9 | 0.20 | 52 |
| LYD473 | 67493.1 | 8.9 | 0.24 | 43 | 175.0 | 0.29 | 42 |
| LYD473 | 67494.1 | 8.6 | 0.18 | 38 | 169.2 | 0.26 | 38 |
| LYD465 | 67569.2 | 9.6 | 0.03 | 55 | 189.4 | 0.01 | 54 |
| LYD461 | 67522.6 | 9.3 | 0.23 | 49 | 196.8 | 0.21 | 60 |
| LYD449 | 67479.1 | 8.9 | 0.06 | 44 | 181.7 | 0.10 | 48 |
| LYD449 | 67482.2 | 8.1 | 0.30 | 30 | — | — | — |
| LYD393 | 67563.1 | 11.4 | 0.09 | 82 | 214.9 | 0.09 | 75 |
| LYD331 | 67592.1 | 11.7 | 0.10 | 88 | 221.7 | 0.08 | 80 |
| LYD331 | 67593.1 | 10.5 | 0.01 | 69 | 197.5 | 0.03 | 61 |

TABLE 65-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| LYD327 | 67589.5 | 11.6 | 0.09 | 86 | 204.0 | 0.06 | 66 |
| LYD313 | 67430.1 | 8.6 | 0.29 | 37 | — | — | — |
| LYD313 | 67432.1 | 11.9 | 0.09 | 91 | 223.8 | 0.10 | 82 |
| LYD294 | 67406.1 | 13.1 | 0.03 | 110 | 274.1 | 0.04 | 123 |
| LYD294 | 67407.4 | 8.8 | 0.14 | 41 | 167.2 | 0.21 | 36 |
| LYD289 | 67461.4 | 9.2 | 0.23 | 48 | 206.1 | 0.13 | 68 |
| CONT. | — | 6.2 | — | — | 122.9 | — | — |
| LYD477 | 68234.1 | 14.1 | 0.12 | 55 | 270.7 | 0.07 | 77 |
| LYD377 | 67952.4 | 12.3 | 0.05 | 35 | 201.3 | 0.08 | 32 |
| LYD359 | 67947.2 | 14.9 | 0.02 | 63 | 257.8 | L | 69 |
| LYD343 | 67067.3 | 14.8 | L | 62 | 269.9 | L | 77 |
| LYD343 | 67068.6 | — | — | — | 210.3 | 0.26 | 38 |
| LYD319 | 67833.3 | 10.5 | 0.24 | 15 | — | — | — |
| LYD295 | 67971.5 | 15.4 | 0.03 | 69 | 253.8 | 0.03 | 66 |
| CONT. | — | 9.1 | — | — | 152.8 | — | — |
| LYD507 | 67552.2 | 14.1 | L | 140 | 268.5 | L | 144 |
| LYD507 | 67552.3 | 11.8 | 0.02 | 101 | 204.2 | 0.06 | 85 |
| LYD507 | 67553.5 | 10.3 | L | 76 | 188.6 | L | 71 |
| LYD487 | 67496.1 | 7.3 | 0.26 | 25 | — | — | — |
| LYD473 | 67493.1 | 11.2 | 0.03 | 91 | 195.3 | 0.02 | 77 |
| LYD393 | 67562.3 | 7.6 | 0.28 | 29 | — | — | — |
| LYD393 | 67563.5 | 10.0 | 0.17 | 71 | 183.9 | 0.22 | 67 |
| LYD390 | 67684.3 | 7.9 | 0.19 | 35 | 142.8 | 0.18 | 30 |
| LYD390 | 67686.2 | 9.7 | 0.11 | 64 | 176.7 | 0.05 | 60 |
| LYD370 | 67665.2 | 8.0 | 0.25 | 36 | — | — | — |
| LYD370 | 67666.2 | 13.1 | 0.06 | 122 | 244.0 | 0.05 | 121 |
| LYD340 | 67600.3 | 8.3 | 0.20 | 41 | 141.1 | 0.24 | 28 |
| LYD340 | 67600.5 | 10.2 | 0.05 | 74 | 169.2 | 0.11 | 54 |
| LYD340 | 67601.3 | 13.4 | L | 128 | 255.6 | L | 132 |
| LYD331 | 67593.5 | 8.3 | 0.16 | 42 | 158.7 | 0.09 | 44 |
| LYD331 | 67594.1 | 9.4 | 0.26 | 60 | — | — | — |
| LYD331 | 67594.3 | 7.5 | 0.24 | 28 | 142.8 | 0.16 | 30 |
| LYD327 | 67588.1 | — | — | — | 167.5 | 0.24 | 52 |
| LYD327 | 67589.3 | 10.3 | 0.11 | 75 | 189.2 | 0.07 | 72 |
| LYD327 | 67589.6 | 10.3 | 0.03 | 75 | 204.8 | 0.08 | 86 |
| LYD313 | 67432.1 | 9.2 | 0.08 | 56 | 161.1 | 0.15 | 46 |
| LYD294 | 67407.6 | 8.2 | 0.17 | 40 | 144.1 | 0.29 | 31 |
| CONT. | — | 5.9 | — | — | 110.2 | — | — |
| LYD518 | 67750.1 | 15.4 | 0.05 | 57 | 241.9 | 0.22 | 27 |
| LYD516 | 67743.4 | 16.0 | 0.19 | 63 | 277.8 | 0.24 | 45 |
| LYD516 | 67744.2 | 12.8 | 0.12 | 30 | 250.6 | 0.10 | 31 |
| LYD516 | 67745.4 | 11.7 | 0.24 | 19 | — | — | — |
| LYD514 | 67511.4 | 15.9 | 0.02 | 61 | 278.0 | 0.03 | 46 |
| LYD510 | 67828.2 | 19.2 | L | 95 | 341.3 | L | 79 |
| LYD510 | 67829.1 | 18.4 | L | 87 | 304.9 | 0.04 | 60 |
| LYD505 | 67502.1 | 15.2 | L | 54 | 268.8 | 0.04 | 41 |
| LYD505 | 67505.2 | 14.6 | 0.17 | 48 | 262.1 | 0.22 | 37 |
| LYD505 | 67507.2 | 14.1 | 0.05 | 43 | 245.7 | 0.26 | 29 |
| LYD469 | 67937.2 | 12.1 | 0.19 | 23 | — | — | — |
| LYD462 | 67868.3 | 19.1 | L | 93 | 337.3 | L | 77 |
| LYD462 | 67870.1 | 17.3 | L | 76 | 298.7 | 0.01 | 56 |
| LYD462 | 67871.3 | 16.1 | 0.14 | 64 | 276.5 | 0.17 | 45 |
| LYD462 | 67872.2 | 16.5 | L | 68 | 307.1 | 0.02 | 61 |
| LYD455 | 67816.3 | 13.1 | 0.12 | 33 | — | — | — |
| LYD455 | 67817.1 | 12.4 | 0.29 | 26 | — | — | — |
| LYD424 | 67797.2 | 15.6 | 0.12 | 58 | 270.6 | 0.18 | 42 |
| LYD424 | 67798.5 | 13.1 | 0.24 | 33 | — | — | — |
| LYD419 | 67913.2 | 12.6 | 0.08 | 28 | 231.2 | 0.25 | 21 |
| LYD326 | 67842.3 | 14.5 | 0.15 | 47 | 289.7 | 0.25 | 52 |
| LYD304 | 67806.2 | 15.5 | 0.06 | 57 | 274.3 | 0.13 | 44 |
| CONT. | — | 9.8 | — | — | 191.1 | — | — |
| LYD518 | 67750.1 | 7.6 | 0.03 | 45 | 149.3 | 0.06 | 35 |
| LYD516 | 67743.4 | 10.6 | L | 101 | 224.0 | L | 103 |
| LYD514 | 67508.2 | 8.1 | 0.09 | 54 | 162.0 | 0.06 | 47 |
| LYD514 | 67511.2 | 10.2 | 0.03 | 95 | 208.6 | L | 89 |
| LYD514 | 67511.4 | 7.8 | 0.20 | 48 | 163.8 | 0.10 | 49 |
| LYD510 | 67829.5 | 9.0 | 0.02 | 71 | 181.5 | L | 65 |
| LYD505 | 67505.3 | 11.2 | L | 112 | 204.8 | 0.02 | 86 |
| LYD505 | 67507.1 | 8.7 | 0.11 | 66 | 186.7 | 0.07 | 69 |
| LYD469 | 67934.3 | 8.9 | 0.03 | 70 | 172.6 | 0.07 | 57 |
| LYD469 | 67935.3 | 9.0 | 0.10 | 71 | 182.8 | 0.08 | 66 |
| LYD469 | 67936.3 | 6.3 | 0.20 | 21 | 133.8 | 0.08 | 21 |
| LYD469 | 67937.2 | 6.6 | 0.28 | 27 | — | — | — |
| LYD462 | 67868.3 | 6.7 | 0.11 | 27 | 143.0 | 0.06 | 30 |
| LYD462 | 67872.2 | 14.1 | L | 169 | 285.9 | L | 159 |
| LYD455 | 67818.5 | 8.6 | 0.08 | 63 | 172.6 | 0.13 | 57 |
| LYD437 | 67899.1 | 7.2 | 0.17 | 38 | 156.8 | 0.04 | 42 |
| LYD437 | 67899.4 | 10.0 | 0.07 | 90 | 205.9 | 0.08 | 87 |
| LYD437 | 67900.1 | 11.5 | 0.01 | 120 | 214.7 | 0.04 | 95 |
| LYD437 | 67900.2 | 8.4 | 0.21 | 60 | 181.7 | 0.15 | 65 |
| LYD437 | 67902.5 | 9.8 | 0.02 | 88 | 224.6 | 0.03 | 104 |
| LYD424 | 67798.5 | 7.7 | 0.11 | 47 | 145.4 | 0.15 | 32 |
| LYD424 | 67798.6 | 8.0 | 0.10 | 52 | 160.6 | 0.04 | 46 |
| LYD424 | 67799.5 | 10.6 | L | 101 | 218.0 | L | 98 |
| LYD326 | 67838.1 | — | — | — | 127.4 | 0.18 | 16 |
| LYD326 | 67839.4 | 10.4 | L | 98 | 202.5 | L | 84 |
| LYD326 | 67840.1 | 6.6 | 0.15 | 25 | — | — | — |
| LYD304 | 67805.1 | 6.5 | 0.22 | 23 | — | — | — |
| LYD304 | 67806.1 | 11.2 | 0.03 | 112 | 234.1 | 0.01 | 112 |
| LYD304 | 67806.2 | 13.1 | 0.01 | 150 | 256.8 | L | 133 |
| CONT. | — | 5.2 | — | — | 110.2 | — | — |

Table 65.

"CONT."—Control;

"Ave."—Average;

"% Incr." = % increment;

"p-val"—p-value,

L—p < 0.01.

The transgenes were under the transcriptional regulation of the new At6669 promoter (SEQ ID NO: 14467).

"—" = results are still unavailable.

The genes presented in Tables 66 and 67 show a significant improvement in plant performance since they produced a larger leaf biomass (leaf area) and root biomass (root length and root coverage) (Table 66) and a higher relative growth rate of leaf area, root coverage and root length (Table 67) when grown under normal growth conditions, compared to control plants. Plants producing larger root biomass have better possibilities to absorb larger amount of nitrogen from soil. Plants producing larger leaf biomass have better ability to produce assimilates. The genes were cloned under the regulation of a constitutive promoter (At6669). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant.

TABLE 66

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD480 | 68331.4 | — | — | — | — | — | — | 6.6 | 0.18 | 9 |
| LYD480 | 68331.6 | — | — | — | — | — | — | 6.7 | 0.11 | 11 |
| LYD480 | 68333.4 | 0.8 | L | 58 | 11.3 | 0.08 | 67 | 6.8 | 0.23 | 12 |
| LYD480 | 68335.1 | — | — | — | — | — | — | 6.7 | 0.21 | 10 |
| LYD477 | 68234.1 | — | — | — | — | — | — | 6.9 | 0.06 | 13 |
| LYD477 | 68234.4 | 0.8 | 0.07 | 56 | 9.8 | 0.20 | 45 | 6.8 | 0.23 | 12 |
| LYD477 | 68237.1 | 0.7 | 0.05 | 31 | 9.3 | 0.11 | 39 | 7.1 | 0.02 | 17 |
| LYD477 | 68237.2 | 0.7 | 0.02 | 37 | — | — | — | — | — | — |
| LYD470 | 67126.7 | 0.7 | 0.01 | 46 | — | — | — | — | — | — |
| LYD420 | 68342.1 | 0.9 | 0.01 | 72 | 13.3 | 0.02 | 98 | 6.8 | 0.20 | 13 |
| LYD420 | 68343.2 | 0.6 | 0.10 | 26 | — | — | — | — | — | — |
| LYD420 | 68344.2 | — | — | — | — | — | — | 6.6 | 0.24 | 9 |
| LYD419 | 67911.3 | 0.7 | 0.13 | 45 | 11.2 | 0.20 | 66 | — | — | — |
| LYD418 | 68336.1 | 0.6 | 0.10 | 25 | 9.5 | 0.09 | 41 | 7.1 | 0.05 | 17 |
| LYD398 | 68037.1 | — | — | — | — | — | — | 6.7 | 0.10 | 11 |
| LYD398 | 68038.2 | 0.6 | 0.11 | 24 | 9.5 | 0.10 | 40 | 6.8 | 0.14 | 11 |
| LYD398 | 68038.6 | — | — | — | — | — | — | 6.7 | 0.15 | 10 |
| LYD377 | 67952.3 | 0.7 | 0.06 | 35 | 9.0 | 0.17 | 34 | — | — | — |
| LYD377 | 67952.4 | 0.7 | 0.09 | 30 | — | — | — | 7.0 | 0.02 | 16 |
| LYD377 | 67953.3 | — | — | — | — | — | — | 6.9 | 0.10 | 13 |
| LYD358 | 68274.1 | 0.6 | 0.30 | 21 | 9.0 | 0.24 | 33 | 6.6 | 0.27 | 9 |
| LYD352 | 68327.3 | — | — | — | — | — | — | 6.8 | 0.08 | 12 |
| LYD352 | 68328.3 | 0.7 | 0.08 | 29 | — | — | — | — | — | — |
| LYD319 | 67833.3 | 0.6 | 0.16 | 21 | — | — | — | — | — | — |
| LYD509 | | | | | | | | 6.1 | 0.89 | 2 |
| CONT. | — | 0.5 | — | — | 6.7 | — | — | 6.1 | — | — |
| LYD507 | 67552.3 | 1.1 | L | 85 | 13.3 | L | 44 | 7.9 | 0.16 | 5 |
| LYD507 | 67552.5 | 0.8 | 0.09 | 33 | — | — | — | — | — | — |
| LYD507 | 67553.4 | 0.8 | 0.15 | 37 | — | — | — | 7.9 | 0.26 | 5 |
| LYD487 | 67498.3 | 0.8 | 0.02 | 34 | 11.1 | 0.14 | 20 | — | — | — |
| LYD487 | 67500.1 | 0.8 | 0.13 | 31 | 11.4 | 0.13 | 24 | 8.0 | 0.06 | 6 |
| LYD473 | 67494.1 | 0.8 | 0.07 | 27 | — | — | — | — | — | — |
| LYD465 | 67569.2 | 0.8 | 0.04 | 27 | — | — | — | — | — | — |
| LYD461 | 67522.6 | 0.8 | 0.18 | 27 | — | — | — | — | — | — |
| LYD449 | 67479.1 | 0.8 | 0.14 | 24 | — | — | — | — | — | — |
| LYD393 | 67563.1 | 0.8 | 0.07 | 37 | 12.7 | 0.10 | 38 | 8.1 | 0.19 | 8 |
| LYD370 | 67666.2 | 0.7 | 0.28 | 20 | — | — | — | — | — | — |
| LYD331 | 67592.1 | 0.8 | 0.10 | 34 | — | — | — | — | — | — |
| LYD331 | 67593.1 | 0.8 | 0.10 | 27 | — | — | — | — | — | — |
| LYD327 | 67589.5 | 0.8 | 0.07 | 36 | 11.3 | 0.29 | 22 | — | — | — |
| LYD313 | 67430.1 | 0.8 | 0.20 | 22 | — | — | — | — | — | — |
| LYD313 | 67432.1 | 0.9 | 0.10 | 47 | 14.3 | 0.12 | 55 | 8.4 | 0.09 | 12 |
| LYD294 | 67406.1 | 0.9 | 0.03 | 48 | 11.9 | 0.18 | 29 | — | — | — |
| LYD294 | 67407.4 | 0.8 | 0.05 | 28 | — | — | — | — | — | — |
| LYD289 | 67461.4 | 0.9 | 0.06 | 38 | 12.0 | 0.09 | 31 | 7.9 | 0.21 | 4 |
| CONT. | — | 0.6 | — | — | 9.2 | — | — | 7.5 | — | — |
| LYD477 | 68234.1 | 1.0 | 0.07 | 34 | 15.3 | 0.08 | 37 | 8.1 | 0.06 | 6 |
| LYD456 | 67966.3 | — | — | — | 13.3 | 0.20 | 20 | — | — | — |
| LYD436 | 68073.1 | — | — | — | — | — | — | 8.0 | 0.19 | 5 |
| LYD377 | 67952.4 | 1.0 | 0.01 | 31 | — | — | — | — | — | — |
| LYD359 | 67947.2 | 1.0 | L | 39 | 13.9 | 0.06 | 25 | — | — | — |
| LYD359 | 67947.4 | 0.9 | 0.18 | 23 | — | — | — | — | — | — |
| LYD343 | 67064.3 | 0.8 | 0.19 | 14 | — | — | — | — | — | — |
| LYD343 | 67066.2 | — | — | — | 15.4 | 0.08 | 38 | 8.6 | L | 13 |
| LYD343 | 67067.3 | 1.1 | L | 44 | 17.4 | L | 57 | 8.2 | 0.09 | 8 |
| LYD319 | 67833.3 | 0.9 | L | 29 | — | — | — | — | — | — |
| LYD295 | 67971.5 | 1.1 | L | 52 | 15.6 | 0.06 | 40 | 8.2 | 0.03 | 8 |
| CONT. | — | 0.7 | — | — | 11.1 | — | — | 7.6 | — | — |
| LYD507 | 67552.2 | 1.1 | L | 95 | 14.4 | 0.02 | 67 | 7.8 | 0.09 | 10 |
| LYD507 | 67552.3 | 0.9 | 0.01 | 55 | 13.0 | L | 50 | 7.9 | 0.03 | 11 |
| LYD507 | 67553.5 | 0.8 | 0.01 | 45 | 11.6 | 0.02 | 35 | — | — | — |
| LYD473 | 67493.1 | 0.8 | 0.02 | 42 | 12.6 | 0.06 | 46 | 7.7 | 0.12 | 8 |
| LYD473 | 67494.1 | — | — | — | 10.5 | 0.15 | 21 | — | — | — |
| LYD465 | 67569.2 | — | — | — | 10.7 | 0.18 | 24 | 7.9 | 0.11 | 10 |
| LYD461 | 67520.5 | — | — | — | — | — | — | 7.5 | 0.24 | 5 |
| LYD461 | 67522.1 | — | — | — | — | — | — | 7.8 | 0.05 | 10 |
| LYD461 | 67522.2 | 0.7 | 0.22 | 19 | 10.6 | 0.20 | 23 | 7.6 | 0.23 | 7 |
| LYD393 | 67563.5 | 0.8 | 0.20 | 33 | — | — | — | — | — | — |
| LYD390 | 67683.5 | — | — | — | 10.5 | 0.17 | 22 | 7.6 | 0.27 | 7 |
| LYD390 | 67684.3 | 0.7 | 0.19 | 26 | 10.8 | 0.23 | 26 | — | — | — |
| LYD390 | 67686.2 | 0.8 | 0.03 | 44 | 12.7 | 0.03 | 47 | 7.6 | 0.17 | 7 |

TABLE 66-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD370 | 67665.2 | — | — | — | 10.2 | 0.20 | 19 | 7.6 | 0.28 | 6 |
| LYD370 | 67666.2 | 1.0 | 0.03 | 78 | 11.8 | 0.06 | 36 | — | — | — |
| LYD370 | 67667.1 | — | — | — | — | — | — | 7.5 | 0.24 | 5 |
| LYD370 | 67667.4 | — | — | — | — | — | — | 7.6 | 0.19 | 7 |
| LYD340 | 67600.3 | 0.7 | 0.24 | 21 | — | — | — | — | — | — |
| LYD340 | 67600.5 | 0.7 | 0.16 | 29 | — | — | — | — | — | — |
| LYD331 | 67601.3 | 1.0 | L | 66 | 13.3 | L | 55 | 7.8 | 0.12 | 10 |
| LYD331 | 67593.5 | 0.7 | 0.20 | 19 | 11.4 | 0.03 | 32 | 7.8 | 0.11 | 9 |
| LYD331 | 67594.3 | — | — | — | 10.2 | 0.18 | 19 | 7.6 | 0.17 | 6 |
| LYD327 | 67587.4 | 0.7 | 0.08 | 25 | — | — | — | — | — | — |
| LYD327 | 67588.1 | 0.8 | 0.17 | 44 | 13.6 | 0.12 | 57 | 8.1 | 0.11 | 13 |
| LYD327 | 67588.2 | 0.7 | 0.27 | 16 | 10.0 | 0.26 | 16 | — | — | — |
| LYD327 | 67589.5 | 0.8 | 0.02 | 47 | 10.7 | 0.17 | 25 | — | — | — |
| LYD327 | 67589.6 | 0.8 | 0.02 | 40 | 11.1 | 0.12 | 28 | — | — | — |
| LYD313 | 67432.1 | 0.7 | 0.18 | 28 | 11.6 | 0.13 | 35 | — | — | — |
| LYD294 | 67407.6 | — | — | — | 12.5 | 0.04 | 45 | 7.7 | 0.10 | 8 |
| LYD289 | 67461.1 | — | — | — | 10.0 | 0.28 | 16 | — | — | — |
| LYD289 | 67461.4 | — | — | — | — | — | — | 7.8 | 0.08 | 9 |
| CONT. | — | 0.6 | — | — | 8.6 | — | — | 7.1 | — | — |
| LYD518 | 67748.2 | — | — | — | 15.1 | 0.02 | 27 | 8.4 | 0.01 | 16 |
| LYD518 | 67748.4 | — | — | — | 13.9 | 0.21 | 16 | 8.4 | L | 17 |
| LYD518 | 67750.1 | 0.9 | 0.28 | 17 | 19.1 | 0.02 | 60 | 8.7 | L | 21 |
| LYD518 | 67750.6 | 0.9 | 0.25 | 15 | 13.8 | 0.23 | 15 | 7.8 | 0.14 | 8 |
| LYD516 | 67743.4 | 1.0 | 0.15 | 34 | 17.1 | 0.03 | 44 | 8.4 | L | 17 |
| LYD516 | 67744.2 | 0.9 | 0.06 | 19 | 14.8 | 0.06 | 24 | 8.6 | L | 19 |
| LYD516 | 67745.4 | 0.9 | 0.17 | 14 | 15.1 | 0.06 | 27 | 8.3 | L | 15 |
| LYD514 | 67508.1 | 0.9 | 0.15 | 15 | 16.5 | 0.09 | 39 | 8.1 | 0.08 | 12 |
| LYD514 | 67508.2 | — | — | — | — | — | — | 7.8 | 0.10 | 8 |
| LYD514 | 67511.4 | 1.0 | L | 30 | 15.3 | 0.09 | 28 | 8.0 | 0.02 | 11 |
| LYD510 | 67828.2 | 1.2 | L | 52 | 17.7 | L | 49 | 8.2 | 0.06 | 13 |
| LYD510 | 67829.1 | 1.1 | L | 47 | 16.2 | 0.02 | 36 | 7.9 | 0.07 | 10 |
| LYD510 | 67830.6 | — | — | — | 13.8 | 0.11 | 15 | 8.0 | 0.01 | 10 |
| LYD505 | 67502.1 | 1.0 | L | 34 | 14.2 | 0.06 | 19 | 7.8 | 0.15 | 8 |
| LYD505 | 67505.2 | 1.0 | 0.14 | 27 | 15.3 | L | 28 | 8.4 | L | 17 |
| LYD505 | 67505.3 | — | — | — | — | — | — | 7.8 | 0.19 | 8 |
| LYD505 | 67507.1 | 1.0 | 0.08 | 24 | 13.5 | 0.27 | 13 | — | — | — |
| LYD505 | 67507.2 | 1.0 | 0.05 | 26 | 14.3 | 0.11 | 20 | 8.0 | 0.12 | 11 |
| LYD469 | 67934.3 | — | — | — | — | — | — | 7.9 | 0.03 | 9 |
| LYD469 | 67935.1 | — | — | — | 15.2 | 0.27 | 28 | 8.3 | 0.06 | 15 |
| LYD469 | 67937.1 | — | — | — | — | — | — | 7.6 | 0.22 | 5 |
| LYD462 | 67868.3 | 1.2 | L | 58 | 19.7 | L | 65 | 8.6 | L | 19 |
| LYD462 | 67870.1 | 1.1 | L | 45 | 16.0 | 0.01 | 34 | 8.3 | L | 15 |
| LYD462 | 67871.3 | 1.1 | 0.08 | 38 | 16.0 | 0.05 | 34 | 8.0 | 0.05 | 10 |
| LYD462 | 67872.2 | 1.0 | L | 35 | 17.2 | L | 44 | 8.3 | L | 15 |
| LYD455 | 67815.1 | — | — | — | — | — | — | 7.7 | 0.19 | 6 |
| LYD455 | 67816.3 | 0.9 | 0.03 | 21 | 15.5 | 0.02 | 30 | 8.5 | L | 18 |
| LYD455 | 67817.1 | 0.9 | 0.29 | 13 | — | — | — | — | — | — |
| LYD455 | 67818.4 | 0.9 | 0.18 | 11 | — | — | — | — | — | — |
| LYD455 | 67818.5 | — | — | — | 14.4 | 0.05 | 21 | 7.8 | 0.19 | 8 |
| LYD437 | 67899.4 | — | — | — | — | — | — | 7.8 | 0.06 | 9 |
| LYD437 | 67900.1 | — | — | — | — | — | — | 7.8 | 0.08 | 8 |
| LYD437 | 67900.2 | 0.9 | 0.22 | 22 | 14.1 | 0.18 | 19 | 7.8 | 0.10 | 8 |
| LYD437 | 67902.5 | — | — | — | — | — | — | 7.8 | 0.22 | 8 |
| LYD424 | 67797.2 | 1.1 | 0.02 | 43 | 15.0 | 0.17 | 26 | 7.8 | 0.13 | 8 |
| LYD424 | 67798.5 | 0.9 | 0.13 | 21 | — | — | — | — | — | — |
| LYD424 | 67799.5 | 0.9 | 0.17 | 12 | — | — | — | — | — | — |
| LYD419 | 67912.4 | — | — | — | — | — | — | 8.5 | L | 17 |
| LYD419 | 67913.2 | 0.9 | 0.21 | 15 | — | — | — | — | — | — |
| LYD326 | 67838.1 | — | — | — | — | — | — | 8.4 | L | 17 |
| LYD326 | 67840.1 | — | — | — | 14.0 | 0.08 | 18 | 8.3 | L | 15 |
| LYD326 | 67842.3 | 1.0 | 0.08 | 25 | — | — | — | — | — | — |
| LYD304 | 67803.3 | 0.9 | 0.29 | 13 | 15.3 | L | 28 | 8.3 | L | 15 |
| LYD304 | 67806.2 | 1.0 | L | 34 | 14.9 | 0.08 | 25 | 8.0 | 0.07 | 10 |
| CONT. | — | 0.8 | — | — | 11.9 | — | — | 7.2 | — | — |
| LYD518 | 67748.4 | — | — | — | 9.4 | 0.21 | 34 | 7.5 | 0.11 | 9 |
| LYD518 | 67750.1 | 0.6 | 0.19 | 13 | 11.2 | 0.02 | 60 | 7.9 | 0.01 | 16 |
| LYD516 | 67743.4 | 0.9 | L | 60 | 13.3 | L | 89 | 8.1 | 0.02 | 18 |
| LYD516 | 67744.1 | 0.7 | 0.29 | 21 | 9.1 | 0.20 | 29 | 7.7 | 0.07 | 13 |
| LYD514 | 67508.1 | — | — | — | 8.8 | 0.06 | 25 | 7.3 | 0.14 | 7 |
| LYD514 | 67508.2 | 0.8 | 0.02 | 37 | 11.6 | L | 64 | 7.6 | 0.02 | 11 |
| LYD514 | 67511.2 | 0.8 | L | 46 | 10.9 | 0.02 | 55 | — | — | — |

TABLE 66-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD514 | 67511.3 | — | — | — | 9.3 | 0.06 | 31 | 7.7 | L | 13 |
| LYD514 | 67511.4 | 0.7 | 0.02 | 27 | 10.6 | L | 50 | 7.7 | 0.02 | 13 |
| LYD510 | 67828.2 | — | — | — | 10.5 | 0.09 | 50 | 7.8 | L | 14 |
| LYD510 | 67829.5 | 0.8 | L | 46 | 9.9 | 0.01 | 40 | — | — | — |
| LYD505 | 67505.3 | 0.9 | L | 58 | 12.0 | L | 70 | 8.0 | L | 17 |
| LYD505 | 67507.1 | 0.8 | 0.07 | 41 | 9.9 | 0.07 | 40 | — | — | — |
| LYD469 | 67934.3 | 0.8 | 0.06 | 35 | 10.2 | 0.04 | 45 | 7.5 | 0.13 | 9 |
| LYD469 | 67935.3 | 0.7 | 0.05 | 27 | — | — | — | — | — | — |
| LYD469 | 67936.3 | 0.6 | 0.17 | 15 | — | — | — | — | — | — |
| LYD469 | 67937.1 | — | — | — | 8.9 | 0.27 | 26 | — | — | — |
| LYD469 | 67937.2 | 0.7 | 0.23 | 18 | 8.7 | 0.22 | 23 | — | — | — |
| LYD462 | 67868.3 | 0.7 | 0.09 | 20 | 9.9 | 0.04 | 40 | 7.7 | 0.01 | 13 |
| LYD462 | 67871.3 | 0.7 | 0.19 | 18 | 9.4 | 0.11 | 33 | 7.4 | 0.12 | 8 |
| LYD462 | 67872.2 | 1.0 | L | 76 | 14.5 | L | 106 | 8.2 | L | 20 |
| LYD455 | 67816.3 | — | — | — | 9.3 | 0.06 | 32 | 7.8 | 0.18 | 14 |
| LYD455 | 67818.4 | — | — | — | 8.0 | 0.21 | 14 | — | — | — |
| LYD455 | 67818.5 | 0.8 | 0.06 | 44 | 10.9 | 0.09 | 54 | — | — | — |
| LYD437 | 67899.1 | 0.7 | L | 32 | — | — | — | — | — | — |
| LYD437 | 67899.4 | 0.9 | 0.04 | 61 | 11.0 | 0.09 | 56 | 8.2 | L | 20 |
| LYD437 | 67900.1 | 0.9 | L | 56 | 11.7 | 0.02 | 66 | 8.0 | 0.06 | 17 |
| LYD437 | 67900.2 | 0.7 | 0.09 | 33 | 10.9 | 0.01 | 54 | 7.5 | 0.17 | 9 |
| LYD437 | 67902.5 | 0.8 | L | 45 | 11.7 | 0.03 | 66 | 7.3 | 0.24 | 6 |
| LYD424 | 67798.5 | 0.8 | 0.03 | 36 | 8.9 | 0.21 | 26 | — | — | — |
| LYD424 | 67798.6 | 0.7 | 0.04 | 34 | — | — | — | — | — | — |
| LYD424 | 67799.5 | 0.9 | L | 56 | 10.8 | 0.06 | 53 | — | — | — |
| LYD326 | 67838.1 | 0.6 | 0.15 | 15 | — | — | — | — | — | — |
| LYD326 | 67839.4 | 0.8 | L | 47 | 12.0 | L | 70 | 7.4 | 0.22 | 8 |
| LYD326 | 67840.1 | 0.6 | 0.19 | 10 | 8.3 | 0.11 | 18 | — | — | — |
| LYD326 | 67842.2 | 0.6 | 0.14 | 13 | — | — | — | — | — | — |
| LYD304 | 67803.1 | 0.6 | 0.27 | 14 | 9.7 | 0.09 | 38 | — | — | — |
| LYD304 | 67805.1 | 0.7 | 0.11 | 22 | — | — | — | — | — | — |
| LYD304 | 67806.1 | 0.9 | L | 55 | 12.6 | 0.01 | 79 | 8.0 | L | 17 |
| LYD304 | 67806.2 | 0.9 | L | 65 | 14.3 | L | 103 | 8.0 | L | 17 |
| LYD304 | 67807.2 | 0.6 | 0.29 | 17 | 9.2 | 0.23 | 30 | 7.5 | 0.03 | 10 |
| CONT. | — | 0.6 | — | — | 7.0 | — | — | 6.8 | — | — |

Table 66.
"CONT."—Control;
"Ave."—Average;
"% Incr." = % increment;
"p-val"—p-value,
L—p < 0.01.
The transgenes were under the transcriptional regulation of the new At6669 promoter (SEQ ID NO: 14467).
"—" = results are still unavailable.

TABLE 67

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYD480 | 68333.4 | 0.1 | L | 60 | 1.4 | 0.04 | 71 | — | — | — |
| LYD477 | 68234.1 | — | — | — | — | — | — | 0.7 | 0.15 | 17 |
| LYD477 | 68234.4 | 0.1 | 0.05 | 56 | 1.2 | 0.18 | 46 | — | — | — |
| LYD477 | 68237.1 | 0.1 | 0.24 | 26 | 1.1 | 0.20 | 38 | 0.8 | 0.08 | 24 |
| LYD477 | 68237.2 | 0.1 | 0.21 | 27 | — | — | — | — | — | — |
| LYD470 | 67126.7 | 0.1 | 0.04 | 48 | — | — | — | — | — | — |
| LYD420 | 68342.1 | 0.1 | L | 82 | 1.6 | L | 102 | 0.7 | 0.24 | 16 |
| LYD419 | 67911.3 | 0.1 | 0.06 | 51 | 1.4 | 0.08 | 72 | — | — | — |
| LYD418 | 68336.1 | — | — | — | 1.2 | 0.16 | 42 | 0.7 | 0.23 | 15 |
| LYD398 | 68037.1 | — | — | — | — | — | — | 0.7 | 0.16 | 17 |
| LYD398 | 68038.2 | 0.1 | 0.28 | 24 | 1.2 | 0.15 | 42 | — | — | — |
| LYD398 | 68038.6 | — | — | — | — | — | — | 0.7 | 0.25 | 14 |
| LYD377 | 67952.3 | 0.1 | 0.15 | 33 | 1.1 | 0.23 | 36 | — | — | — |

TABLE 67-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYD377 | 67952.4 | 0.1 | 0.25 | 26 | — | — | — | 0.7 | 0.22 | 14 |
| LYD377 | 67953.3 | — | — | — | — | — | — | 0.7 | 0.12 | 19 |
| LYD358 | 68274.1 | 0.1 | 0.24 | 28 | 1.1 | 0.24 | 36 | — | — | — |
| LYD352 | 68327.3 | — | — | — | — | — | — | 0.7 | 0.19 | 15 |
| LYD352 | 68328.3 | 0.1 | 0.25 | 26 | — | — | — | — | — | — |
| CONT. | — | 0.1 | — | — | 0.8 | — | — | 0.6 | — | — |
| LYD507 | 67552.3 | 0.1 | L | 92 | 1.6 | 0.02 | 44 | 0.8 | 0.03 | 17 |
| LYD507 | 67552.5 | 0.1 | 0.03 | 43 | — | — | — | — | — | — |
| LYD507 | 67553.4 | 0.1 | 0.05 | 44 | — | — | — | — | — | — |
| LYD487 | 67498.3 | 0.1 | 0.02 | 43 | 1.4 | 0.24 | 22 | 0.8 | 0.10 | 12 |
| LYD487 | 67500.1 | 0.1 | 0.06 | 37 | 1.4 | 0.18 | 25 | 0.8 | 0.08 | 12 |
| LYD473 | 67494.1 | 0.1 | 0.08 | 31 | — | — | — | — | — | — |
| LYD465 | 67569.2 | 0.1 | 0.08 | 30 | — | — | — | — | — | — |
| LYD461 | 67522.6 | 0.1 | 0.16 | 28 | — | — | — | — | — | — |
| LYD449 | 67479.1 | 0.1 | 0.11 | 28 | — | — | — | — | — | — |
| LYD449 | 67482.1 | — | — | — | — | — | — | 0.8 | 0.11 | 13 |
| LYD393 | 67563.1 | 0.1 | 0.03 | 42 | 1.6 | 0.07 | 39 | 0.8 | 0.11 | 14 |
| LYD390 | 67684.2 | 0.1 | 0.30 | 21 | — | — | — | — | — | — |
| LYD370 | 67666.2 | 0.1 | 0.28 | 20 | — | — | — | — | — | — |
| LYD370 | 67667.1 | — | — | — | — | — | — | 0.8 | 0.28 | 8 |
| LYD331 | 67592.1 | 0.1 | 0.04 | 41 | — | — | — | — | — | — |
| LYD331 | 67593.1 | 0.1 | 0.06 | 35 | — | — | — | — | — | — |
| LYD327 | 67589.5 | 0.1 | 0.05 | 39 | 1.4 | 0.24 | 24 | 0.8 | 0.13 | 14 |
| LYD313 | 67430.1 | 0.1 | 0.20 | 23 | — | — | — | — | — | — |
| LYD313 | 67432.1 | 0.1 | 0.04 | 48 | 1.8 | 0.02 | 56 | 0.9 | 0.03 | 18 |
| LYD294 | 67406.1 | 0.1 | L | 52 | 1.5 | 0.13 | 31 | — | — | — |
| LYD294 | 67407.4 | 0.1 | 0.06 | 32 | — | — | — | — | — | — |
| LYD289 | 67461.4 | 0.1 | 0.03 | 43 | 1.5 | 0.09 | 31 | 0.8 | 0.08 | 12 |
| CONT. | — | 0.1 | — | — | 1.1 | — | — | 0.7 | — | — |
| LYD477 | 68234.1 | 0.1 | 0.03 | 35 | 1.9 | 0.03 | 39 | 0.8 | 0.13 | 13 |
| LYD456 | 67966.3 | — | — | — | 1.6 | 0.20 | 21 | — | — | — |
| LYD436 | 68073.1 | — | — | — | — | — | — | 0.8 | 0.15 | 12 |
| LYD436 | 68075.1 | — | — | — | — | — | — | 0.8 | 0.19 | 11 |
| LYD377 | 67952.4 | 0.1 | 0.11 | 21 | — | — | — | — | — | — |
| LYD359 | 67947.2 | 0.1 | L | 41 | 1.7 | 0.08 | 27 | — | — | — |
| LYD359 | 67947.4 | 0.1 | 0.21 | 19 | 1.6 | 0.27 | 21 | — | — | — |
| LYD343 | 67064.3 | 0.1 | 0.22 | 16 | — | — | — | — | — | — |
| LYD343 | 67066.2 | — | — | — | 1.9 | 0.03 | 39 | 0.8 | 0.07 | 15 |
| LYD343 | 67067.3 | 0.1 | L | 44 | 2.1 | L | 59 | 0.8 | 0.15 | 14 |
| LYD319 | 67833.3 | 0.1 | 0.07 | 22 | — | — | — | — | — | — |
| LYD295 | 67971.5 | 0.1 | L | 52 | 1.9 | 0.02 | 42 | 0.8 | 0.06 | 17 |
| CONT. | — | 0.1 | — | — | 1.3 | — | — | 0.7 | — | — |
| LYD507 | 67552.2 | 0.1 | L | 103 | 1.7 | L | 70 | 0.7 | 0.22 | 13 |
| LYD507 | 67552.3 | 0.1 | 0.01 | 55 | 1.6 | L | 53 | 0.8 | 0.05 | 20 |
| LYD507 | 67553.5 | 0.1 | 0.02 | 51 | 1.4 | 0.03 | 39 | 0.7 | 0.20 | 14 |
| LYD473 | 67493.1 | 0.1 | 0.02 | 48 | 1.5 | 0.02 | 48 | — | — | — |
| LYD473 | 67494.1 | — | — | — | 1.3 | 0.19 | 23 | — | — | — |
| LYD465 | 67569.2 | — | — | — | 1.3 | 0.17 | 26 | 0.7 | 0.17 | 15 |
| LYD461 | 67522.1 | — | — | — | — | — | — | 0.7 | 0.25 | 12 |
| LYD461 | 67522.2 | 0.1 | 0.28 | 21 | 1.2 | 0.21 | 23 | — | — | — |
| LYD393 | 67563.5 | 0.1 | 0.15 | 34 | — | — | — | — | — | — |
| LYD390 | 67683.5 | — | — | — | 1.3 | 0.18 | 25 | 0.7 | 0.28 | 12 |
| LYD390 | 67684.3 | 0.1 | 0.18 | 29 | 1.3 | 0.17 | 26 | — | — | — |
| LYD390 | 67686.2 | 0.1 | 0.02 | 48 | 1.5 | 0.01 | 49 | — | — | — |
| LYD370 | 67665.2 | — | — | — | 1.2 | 0.24 | 20 | — | — | — |
| LYD370 | 67666.2 | 0.1 | L | 81 | 1.4 | 0.04 | 39 | 0.7 | 0.28 | 11 |
| LYD370 | 67667.1 | — | — | — | — | — | — | 0.7 | 0.29 | 11 |
| LYD340 | 67600.5 | 0.1 | 0.16 | 30 | — | — | — | — | — | — |
| LYD340 | 67601.3 | 0.1 | L | 73 | 1.6 | L | 59 | 0.8 | 0.08 | 19 |
| LYD331 | 67593.5 | 0.1 | 0.29 | 21 | 1.4 | 0.06 | 34 | — | — | — |
| LYD331 | 67594.1 | — | — | — | 1.4 | 0.15 | 36 | 0.7 | 0.22 | 15 |
| LYD331 | 67594.3 | — | — | — | 1.2 | 0.26 | 20 | — | — | — |
| LYD327 | 67587.4 | 0.1 | 0.17 | 26 | 1.2 | 0.26 | 22 | — | — | — |
| LYD327 | 67588.1 | 0.1 | 0.08 | 42 | 1.6 | 0.01 | 59 | 0.8 | 0.08 | 22 |
| LYD327 | 67589.5 | 0.1 | 0.02 | 50 | 1.3 | 0.15 | 27 | 0.7 | 0.26 | 12 |
| LYD327 | 67589.6 | 0.1 | 0.04 | 42 | 1.3 | 0.11 | 30 | — | — | — |
| LYD313 | 67432.1 | 0.1 | 0.25 | 25 | 1.4 | 0.07 | 36 | — | — | — |
| LYD294 | 67407.6 | — | — | — | 1.5 | 0.02 | 49 | 0.7 | 0.28 | 11 |
| CONT. | — | 0.1 | — | — | 1.0 | — | — | 0.6 | — | — |
| LYD518 | 67748.2 | — | — | — | 1.8 | 0.02 | 27 | 0.8 | 0.01 | 23 |
| LYD518 | 67748.4 | — | — | — | 1.6 | 0.20 | 15 | 0.8 | 0.05 | 18 |

TABLE 67-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYD518 | 67750.1 | 0.1 | 0.23 | 18 | 2.3 | L | 60 | 0.8 | 0.01 | 25 |
| LYD518 | 67750.6 | 0.1 | 0.25 | 16 | 1.7 | 0.18 | 17 | 0.8 | 0.04 | 17 |
| LYD516 | 67743.4 | 0.1 | 0.05 | 37 | 2.0 | L | 44 | 0.8 | 0.06 | 18 |
| LYD516 | 67744.2 | 0.1 | 0.09 | 22 | 1.8 | 0.05 | 24 | 0.8 | 0.01 | 24 |
| LYD516 | 67745.4 | 0.1 | 0.22 | 17 | 1.8 | 0.03 | 28 | 0.8 | 0.01 | 22 |
| LYD514 | 67508.1 | 0.1 | 0.13 | 21 | 2.0 | L | 41 | 0.8 | 0.21 | 13 |
| LYD514 | 67511.4 | 0.1 | 0.02 | 32 | 1.8 | 0.04 | 26 | — | — | — |
| LYD510 | 67828.2 | 0.1 | L | 59 | 2.1 | L | 50 | 0.8 | 0.03 | 23 |
| LYD510 | 67829.1 | 0.1 | L | 52 | 1.9 | L | 36 | 0.8 | 0.12 | 14 |
| LYD510 | 67830.6 | — | — | — | 1.7 | 0.12 | 18 | 0.8 | 0.02 | 18 |
| LYD505 | 67502.1 | 0.1 | L | 37 | 1.7 | 0.09 | 19 | 0.7 | 0.17 | 12 |
| LYD505 | 67505.2 | 0.1 | 0.08 | 28 | 1.8 | 0.01 | 29 | 0.9 | L | 27 |
| LYD505 | 67507.1 | 0.1 | 0.08 | 26 | — | — | — | — | — | — |
| LYD505 | 67507.2 | 0.1 | 0.06 | 27 | 1.7 | 0.11 | 20 | 0.8 | 0.19 | 13 |
| LYD469 | 67934.3 | — | — | — | 1.6 | 0.27 | 14 | — | — | — |
| LYD469 | 67935.1 | 0.1 | 0.26 | 23 | 1.8 | 0.10 | 28 | 0.8 | 0.04 | 20 |
| LYD469 | 67937.1 | — | — | — | — | — | — | 0.7 | 0.26 | 9 |
| LYD462 | 67868.3 | 0.1 | L | 64 | 2.3 | L | 63 | 0.8 | 0.12 | 16 |
| LYD462 | 67870.1 | 0.1 | L | 50 | 1.9 | L | 34 | 0.8 | L | 25 |
| LYD462 | 67871.3 | 0.1 | 0.02 | 40 | 1.9 | 0.01 | 33 | 0.7 | 0.25 | 11 |
| LYD462 | 67872.2 | 0.1 | L | 40 | 2.0 | L | 43 | 0.8 | 0.12 | 15 |
| LYD455 | 67815.1 | — | — | — | — | — | — | 0.7 | 0.17 | 11 |
| LYD455 | 67816.3 | 0.1 | 0.06 | 25 | 1.9 | 0.01 | 31 | 0.9 | L | 27 |
| LYD455 | 67817.1 | 0.1 | 0.29 | 14 | — | — | — | — | — | — |
| LYD455 | 67818.4 | 0.1 | 0.27 | 14 | — | — | — | — | — | — |
| LYD455 | 67818.5 | — | — | — | 1.7 | 0.07 | 21 | — | — | — |
| LYD437 | 67899.4 | — | — | — | — | — | — | 0.7 | 0.23 | 10 |
| LYD437 | 67900.1 | — | — | — | — | — | — | 0.7 | 0.20 | 11 |
| LYD437 | 67900.2 | 0.1 | 0.15 | 23 | 1.7 | 0.17 | 18 | — | — | — |
| LYD424 | 67797.2 | 0.1 | L | 51 | 1.8 | 0.06 | 28 | 0.8 | 0.02 | 22 |
| LYD424 | 67798.5 | 0.1 | 0.08 | 25 | — | — | — | — | — | — |
| LYD424 | 67799.5 | 0.1 | 0.25 | 14 | — | — | — | 0.8 | 0.12 | 15 |
| LYD419 | 67912.4 | — | — | — | — | — | — | 0.8 | L | 23 |
| LYD419 | 67913.2 | 0.1 | 0.19 | 18 | — | — | — | — | — | — |
| LYD326 | 67838.1 | 0.1 | 0.19 | 25 | — | — | — | 0.8 | 0.02 | 20 |
| LYD326 | 67840.1 | — | — | — | 1.7 | 0.13 | 18 | 0.8 | 0.03 | 19 |
| LYD326 | 67842.3 | 0.1 | 0.04 | 30 | — | — | — | — | — | — |
| LYD304 | 67803.3 | 0.1 | 0.28 | 15 | 1.8 | 0.02 | 28 | 0.8 | 0.04 | 19 |
| LYD304 | 67806.2 | 0.1 | L | 38 | 1.7 | 0.07 | 23 | — | — | — |
| CONT. | — | 0.1 | — | — | 1.4 | — | — | 0.7 | — | — |
| LYD518 | 67748.4 | — | — | — | 1.1 | 0.07 | 34 | — | — | — |
| LYD518 | 67750.1 | 0.1 | 0.30 | 14 | 1.4 | L | 61 | 0.8 | 0.07 | 14 |
| LYD516 | 67743.4 | 0.1 | L | 65 | 1.6 | L | 87 | 0.8 | 0.08 | 15 |
| LYD516 | 67744.1 | 0.1 | 0.10 | 30 | 1.1 | 0.12 | 30 | 0.8 | 0.02 | 20 |
| LYD516 | 67745.4 | — | — | — | 1.0 | 0.26 | 20 | — | — | — |
| LYD514 | 67508.1 | — | — | — | 1.1 | 0.13 | 25 | — | — | — |
| LYD514 | 67508.2 | 0.1 | 0.01 | 39 | 1.4 | L | 62 | — | — | — |
| LYD514 | 67511.2 | 0.1 | L | 52 | 1.3 | L | 52 | — | — | — |
| LYD514 | 67511.3 | — | — | — | 1.1 | 0.06 | 31 | 0.8 | 0.16 | 10 |
| LYD514 | 67511.4 | 0.1 | 0.03 | 30 | 1.3 | L | 47 | — | — | — |
| LYD510 | 67828.2 | 0.1 | 0.22 | 19 | 1.3 | 0.02 | 46 | 0.8 | 0.14 | 11 |
| LYD510 | 67829.5 | 0.1 | L | 54 | 1.2 | 0.02 | 38 | — | — | — |
| LYD510 | 67830.2 | 0.1 | 0.24 | 21 | 1.1 | 0.20 | 28 | — | — | — |
| LYD505 | 67505.3 | 0.1 | L | 70 | 1.5 | L | 70 | 0.8 | L | 21 |
| LYD505 | 67507.1 | 0.1 | L | 47 | 1.2 | 0.04 | 37 | — | — | — |
| LYD469 | 67934.3 | 0.1 | 0.01 | 41 | 1.2 | 0.02 | 43 | — | — | — |
| LYD469 | 67935.3 | 0.1 | 0.04 | 32 | — | — | — | — | — | — |
| LYD469 | 67936.3 | 0.1 | 0.13 | 21 | — | — | — | — | — | — |
| LYD469 | 67937.1 | — | — | — | 1.1 | 0.18 | 25 | — | — | — |
| LYD469 | 67937.2 | 0.1 | 0.23 | 18 | 1.1 | 0.19 | 23 | — | — | — |
| LYD462 | 67868.3 | 0.1 | 0.10 | 23 | 1.2 | 0.03 | 38 | 0.7 | 0.21 | 9 |
| LYD462 | 67871.3 | 0.1 | 0.18 | 21 | 1.1 | 0.06 | 33 | — | — | — |
| LYD462 | 67872.2 | 0.1 | L | 91 | 1.7 | L | 104 | 0.8 | 0.01 | 20 |
| LYD455 | 67816.3 | — | — | — | 1.1 | 0.06 | 32 | 0.8 | 0.28 | 10 |
| LYD455 | 67818.5 | 0.1 | L | 53 | 1.3 | 0.01 | 55 | 0.8 | 0.13 | 13 |
| LYD437 | 67899.1 | 0.1 | L | 38 | — | — | — | — | — | — |
| LYD437 | 67899.4 | 0.1 | L | 72 | 1.3 | 0.02 | 52 | 0.8 | 0.04 | 16 |
| LYD437 | 67900.1 | 0.1 | L | 66 | 1.4 | L | 67 | 0.8 | 0.03 | 19 |
| LYD437 | 67900.2 | 0.1 | 0.01 | 43 | 1.3 | L | 54 | — | — | — |
| LYD437 | 67902.5 | 0.1 | L | 55 | 1.4 | L | 66 | — | — | — |
| LYD424 | 67798.5 | 0.1 | L | 47 | 1.1 | 0.13 | 27 | — | — | — |

TABLE 67-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYD424 | 67798.6 | 0.1 | 0.01 | 41 | — | — | — | — | — | — |
| LYD424 | 67799.5 | 0.1 | L | 69 | 1.3 | L | 54 | — | — | — |
| LYD326 | 67838.1 | 0.1 | 0.20 | 18 | — | — | — | — | — | — |
| LYD326 | 67839.4 | 0.1 | L | 58 | 1.4 | L | 66 | — | — | — |
| LYD326 | 67840.1 | 0.1 | 0.30 | 13 | 1.0 | 0.21 | 19 | 0.8 | 0.18 | 10 |
| LYD326 | 67842.2 | 0.1 | 0.18 | 18 | — | — | — | — | — | — |
| LYD304 | 67803.1 | 0.1 | 0.13 | 22 | 1.2 | 0.03 | 39 | — | — | — |
| LYD304 | 67805.1 | 0.1 | 0.06 | 28 | — | — | — | — | — | — |
| LYD304 | 67806.1 | 0.1 | L | 61 | 1.5 | L | 77 | — | — | — |
| LYD304 | 67806.2 | 0.1 | L | 75 | 1.7 | L | 101 | 0.8 | 0.10 | 13 |
| LYD304 | 67807.2 | 0.1 | 0.14 | 24 | 1.1 | 0.10 | 31 | — | — | — |
| CONT. | — | 0.1 | — | — | 0.9 | — | — | 0.7 | — | — |

Table 67.
"CONT."—Control;
"Ave."—Average;
"% Incr." = % increment;
"p-val"—p-value,
L—p < 0.01.
The transgenes were under the transcriptional regulation of the new At6669 promoter (SEQ ID NO: 14467).
"—" = results are still unavailable.

Results from T1 Plants

The genes presented in Tables 68-70 showed a significant improvement in plant biomass and root development since they produced a higher biomass (dry and fresh weight, Table 68), a larger leaf and root biomass (leaf area, root length and root coverage) (Table 69), and a higher relative growth rate of leaf area, root coverage and root length (Table 70) when grown under normal growth conditions, compared to control plants. Plants producing larger root biomass have better possibilities to absorb larger amount of nitrogen from soil. Plants producing larger leaf biomass has better ability to produce assimilates). The genes were cloned under the regulation of a constitutive promoter (At6669; SEQ ID NO:14467). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant.

Tables 68-70 summarize the observed phenotypes of transgenic plants expressing the gene constructs using the TC-T1 Assays.

TABLE 68

Genes showing improved plant performance at Normal growth conditions under regulation of A6669 promoter

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LYD467 | 11.2 | 0.15 | 20 | — | — | — |
| LYD427 | 11.0 | 0.17 | 18 | 176.4 | 0.12 | 24 |
| LYD407 | 11.2 | 0.23 | 20 | 192.3 | 0.15 | 36 |
| LYD300 | 10.35 | 0.37 | 11 | 163.7 | 0.27 | 15.5 |
| LYD353 | 10.1 | 0.53 | 8.6 | 163.2 | 0.33 | 15.1 |
| LYD378 | 9.95 | 0.57 | 6.9 | 179.4 | 0.69 | 5.3 |
| LYD380 | — | — | — | 147.6 | 0.76 | 4.1 |
| CONT. | 9.3 | — | — | 141.8 | — | — |

TABLE 68-continued

Genes showing improved plant performance at Normal growth conditions under regulation of A6669 promoter

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LYD383 | 11.9 | 0.02 | 35 | 200.5 | 0.06 | 29 |
| CONT. | 8.8 | — | — | 156.0 | — | — |

Table 68.
"CONT."—Control;
"Ave."—Average;
"% Incr." = % increment;
"p-val"—p-value,
L—p < 0.01.
The transgenes were under the transcriptional regulation of the new At6669 promoter (SEQ ID NO: 14467).
"—" = results are still unavailable.

TABLE 69

Genes showing improved plant performance at Normal growth conditions under regulation of At6669 promoter

| Gene Name | Leaf Area [cm²] | | | Roots Coverage [cm²] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LYD467 | 0.8 | L | 17 | — | — | — | 6.7 | 0.09 | 14 |
| LYD407 | 0.8 | 0.16 | 11 | 8.9 | 0.29 | 26 | 7.0 | 0.22 | 19 |
| LYD380 | — | — | — | — | — | — | 6.4 | 0.45 | 8.9 |
| CONT. | 0.7 | — | — | 7.1 | — | — | 5.9 | — | — |
| LYD413 | — | — | — | 8.0 | 0.28 | 21 | 6.6 | 0.14 | 16 |
| LYD383 | 0.9 | 0.04 | 35 | — | — | — | — | — | — |

TABLE 69-continued

Genes showing improved plant performance at Normal growth conditions under regulation of At6669 promoter

| Gene Name | Leaf Area [cm²] | | | Roots Coverage [cm²] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LYD500 | 0.7 | 0.93 | 8 | 6.7 | 0.9 | 1.8 | 6.1 | 0.55 | 6 |
| CONT. | 0.7 | — | — | 6.6 | — | — | 5.7 | — | — |

Table 69.
"CONT."—Control;
"Ave."—Average;
"% Incr." = % increment;
"p-val"—p-value,
L—p < 0.01.
The transgenes were under the transcriptional regulation of the new At6669 promoter (SEQ ID NO: 14467).
"—" = results are still unavailable.

TABLE 70

Genes showing improved plant performance at Normal growth conditions under regulation of At6669 promoter

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LYD467 | 0.1 | 0.03 | 20 | — | — | — | 0.7 | 0.10 | 18 |
| LYD407 | 0.1 | 0.29 | 10 | 1.1 | 0.10 | 26 | 0.8 | 0.03 | 26 |
| CONT. | 0.1 | — | — | 0.9 | — | — | 0.6 | — | — |
| LYD413 | — | — | — | 1.0 | 0.22 | 22 | 0.8 | 0.05 | 18 |
| LYD383 | 0.1 | L | 45 | — | — | — | — | — | — |
| CONT. | 0.1 | — | — | 0.8 | — | — | 0.7 | — | — |

Table 70.
"CONT."—Control;
"Ave."—Average;
"% Incr." = % increment;
"p-val"—p-value,
L—p < 0.01.
The transgenes were under the transcriptional regulation of the new At6669 promoter (SEQ ID NO: 14467).
"—" = results are still unavailable.

These results demonstrate that the polynucleotides of the invention are capable of improving yield and additional valuable important agricultural traits such as increase of biomass, abiotic stress tolerance, nitrogen use efficiency, yield, vigor, fiber yield and/or quality. Thus, transformed plants showing improved fresh and dry weight demonstrate the gene capacity to improve biomass a key trait of crops for forage and plant productivity; transformed plants showing improvement of seed yield demonstrate the genes capacity to improve plant productivity; transformed plants showing improvement of plot coverage and rosette diameter demonstrate the genes capacity to improve plant drought resistance as they reduce the loss of soil water by simple evaporation and reduce the competition with weeds; hence reduce the need to use herbicides to control weeds. Transformed plants showing improvement of relative growth rate of various organs (leaf and root) demonstrate the gene capacity to promote plant growth and hence shortening the needed growth period and/or alternatively improving the utilization of available nutrients and water leading to increase of land productivity; Transformed plants showing improvement of organ number as demonstrated by the leaf number parameter exhibit a potential to improve biomass yield important for forage crops and improve the plant productivity; Transformed plants showing increased root length and coverage demonstrate the gene capacity to improve drought resistance and better utilization of fertilizers as the roots can reach larger soil volume; Transformed plants showing improvement of leaf petiole relative area and leaf blade area demonstrate the genes capacity to cope with limited light intensities results from increasing the plant population densities and hence improve land productivity.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (15068 sequences)

SEQ ID NO: 1 - DNA, 1520 bp, Arabidopsis thaliana
cactcttcagcaccaaactctccccaagaaaaccctcaacccttcctttataatcctttgccatttgctgatattctgcatccaccatctttcttcccaatatctaattgagttttttccttctgcgcttgaaaagaaatgtcgaattctaggatgaatggtgttgagaagctaagcagcaaatccacaaggcgtgtcgcaaatgccggaaaggcaacactgcttgctcttggcaaagccttcccaagccaagtcgttcctcaggagaatctagtggaaggatttctacgagacaccaaatgtgatgacgcgtttatcaaagaaaagctggaacacttgtgcaaaacgacaaccgtgaagacgcgatacactgtgttgacgcgagagatactggctaaataccctgagctaacaacagagggttcaccaacaatcaagcaaagacttgaaattgcaaacgaggcggttgtggaaatggcattggaagccagtttaggttgcatcaaggaatggggaaggccagtggaagacatcactcacattgtctacgtttcctcaagcgagatccgtttacccggtggtgacctttacctctcagcaaagctaggcctgaggaatgacgtgaacagagtgatgctgtattttctgggatgctacggaggtgtgactggcctccgtgtggccaaagacattgctgagaacaaccccggaagccgtgttctgctcacaacctctgaaaccaccattctcggatttcggccaccaaacaaagcgcgtccgtacgacctagttggagctgctctgtttggagatggtgcagctgctgtgatcatcggagctgacccgagagagtgtgaagctcctttcatggagctgcactatgcggttcagcagttcttgccggggacacagaacgtgatcgaggggaggttgactgaggaaggcataaacttcaagcttggacgagacctcccgcagaagatagaggagaacatagaagagttctgcaagaagctgatgggaaaggctggcgatgagtcgatggagttcaatgacatgttctgggctgttcatccaggaggacctgcgattctgaaccgtctggagacaaaactgaagctggagaaagagaagctggagagcagcagaagggcgttggtggattacgggaacgtgagcagcaacacgatactgtatgtgatggagtatatgagagatgagctgaagaagaaaggtgacgcagcacaagagtggggacttggcttagctttcggacctggaatcaccttcgaaggccttctcatccgcagcctcacctcttcctaattgttataatttacatttgggttataaacatattgtaagcatgaaatgagagtattatttgttaaacaacatctatatagaatagatgcatgtgactaggaatgttggaaaaagtcaaaagttgcaccacgtgtcgttaaagcaagtgcttagctacttggaaccacatgaacaagaagacaccaaacccgtta

SEQ ID NO: 2 - DNA, 942 bp, Arabidopsis thaliana
tctctcaacaactacttgtttagagagagtcccaccaccaccactaccacaatcccaatggcttcaccaactcttactctcctcctcctcctcaccaccgtctccttcttcatctcctcctccgcagatcctgacatgcttcaagatctctgcgtcgctgatcttccctctggaatcaaaatcaatggcttcccttgcaaagacgcagctacagtcacatcagccgatttcttctcacaaggattagctaaaccaggtcttaccaacaacacattcggtgccttagtcacaggagctaacgttatgacaatcccaggactcaacacacttggtgtctccctctctcgtatcgactacgcaccaggaggcttaaacccacctcacacccacccacgtgccactgaggtcgttttcgtcctcgaaggaacacttgacgttgggtttctcactactgccaataagctaatctctcaatctctcaagaaaggagatgtctttgctttccccaaaggacttgtccatttccagaagaacaatggtgatgtccctgcttctgttattgcagctttcaatagtcagcttcctggaactcaatctcttggtgctactttgtttggttctactcctcctgttcctgacaacatcttggctcaagcctttcagacttctccaggaactgttaaacacatcaaatccaagttccaacccaagaaatgatcatcacccttcctttatattcattactacagttctgtttttttctaaagggaagatctttttatcttctttgatttgtcttctgtaataaaaaaggaacaataactgatgatcttcagtgtgcatttgagctccatagtctcatgtattcgtcttcttgtataatccatattattttttgttcaaagttgactaaagacaggtaagaagtcgaggttgatctaa

SEQ ID NO: 3 - DNA, 1547 bp, Arabidopsis thaliana
ctctgtttagttatgcgtcagtctctcatcagtgttcaactgccacggagcgaaccgattcctaattgcaacgtcccgagtccatagaatgtcgacactctttcactctttctccaagttgcctcctttgagtcctttctcatattttatagactcactttctgtttcttgatcccgaggaagaagaagaataaactcttgttcccatgatcttcgtcgatgttctttggaaattgtttcctctatactcgtttggatcaggaagagactctctctcagagtccattttgcagatcattcccgagacaatggcttcttctaccactaaaatcctctgtgatgctggcgaatcagacctctgtagagacgattctgctgcatttctccttaagtttgtagccattgcctccattctactagctggagctgctggtgtagccatacctctcattggcaggaaccgccggtttcttcaaaccgagggaaatctctttgtagctgctaaagcctttgcagctggtgtcatactcgccaccggctttgtccatatgcttgcaggtggcacagaagctctgagtaatccgtgtttaccggattttccgtggtctaagtttccctttcccgggttctttgcaatggttgctgctttagctactctgcttgttgatttcatggggacacagtactatgagaggaagcaagagaggaatcaggctgctactgaagccgctgctggtagtgaagagattgctgttgttcctgtggttggggaaagagtgaccgataataaagtgtttggtgaagaagacggtggcgggattcacattgtcggcattcgtgcacatgctgctcaccataggcatagtcactctaatagtcatggtacatgtgatggacatgctcatggacattcacacggacatatgcacgggaattcagatgttgaaaatggagctaggcatgttgttgtttctcagatattggagctcgggattgtgtcgcactcaatcatcatcggtttatccctgggggtatcacagtctccatgcacgatcaggcctcttattgcagctctgtcatttcaccagttctttgaaggatttgcgctcggaggctgcatctctcaggcacagttcaggaacaaatcagcgaccataatggcttgcttctttgcgctaaccacaccattagggatcgggattggaactgcagtggcctcatctttcaactcgcatagccctggagctttggtcactgaggggatactggactcgctgtcagctggaatactggtgtacatggctctggtggacctcatcgcagctgattttctgagtaagaggatgagttgtaatttgaggcttcaagttgtgtcttatgtaatgttgttccttggagctggacttatgtctgctctcgccatttgggcttagctcttagattacatattatctactgtagaatcaaataatatactgctctcgcaacttcatatttttgccttgattcatatgaatataatagacaagggagcctattagaaataa

SEQ ID NO: 4 - DNA, 1679 bp, Arabidopsis thaliana
ccggccacgtgtcgttcaggcagctctctcggcggccacttgcctcctctcagtcaaggcctgtctctctttctttctttctttcttcttctctctcttttcctctaatgtccaaaagggtcttcttctttgtctctgctcttcactttcaattataacctcttcgtcttcttcgccgtctctggtattaactccggcgagttttttttttttttttactttgatatgaatttgcgagatttactgtttaattcatgatgacaattttggatttttgatcggatgtgaaattcagagtttttcattcttcttcatcatcttataacaaagaagaaacaaaacaaaaaactttttttttctttctttctattgtttcggaatctatgggtgaagcaagcagacaacaaagggcatggaacagagaaatgacggttacgacaaatctttctctagacatagataaatacccgagagatctgttacgaggtttcatgtctgaaaacggcggtggaagagtctttcacggcggagaaacaaactgcgatgatgagagtacgattgagctcaatcttggtttgtctttaggtggtagattcggagtagacaagactccgaggaagctgaaacgatcttcttctgttttggacactgtaccattcaacgattcaactgtggctgagcctgagaattacacggtgggtttagagagaacgacgtcgttaccggcggagatggaagaggaatggaggaaaaggaaagagatgcaatcgcttaggagaatggaagctaagagaaggagatgtgagaaacagagtttcagagttgggaattctgatgaccaaacggtgtcgtttgagaatgagagatgggttactgcgagtaaaagtggcttcttgcagagacatttggtttcttctaatagacaagtctgtggtgttgattccgatggaggaggagcaacgggaggaggtagttcatcgagcttgtcggagctagacaacaaaaatcagcaaggatcatcaaacagctgcaatgatgaaagaagcccgaaaatcgtggcaggatgttcatcgaacagcggaagccagggaacagagagaccgagtgtgactagagccaacaaagtgaatgagaatgagaatgaaaaaagagtgagaagtgaagactcggtggataggaaaggaaaagggatggctacgtctactggtttggttgatatgccttgtgtgtttactaaaggggacgggccaaacggaagacgggttgatgggattctgtacaagtatggaaaaggagaggaagtgaggataatgtgcatttgccatggtagtttcttgacaccagctgagtttgttaaacatggtggtggtggagatgtggatcgtcctcttcggcatatcgttgtcaacacctcttcttcgaccttttaaatcgaagaatcggtgaagaaaccggaagggtcttgtgttctctgtttcattttttttcttgttgttttatcttttggatctctctggtttttggctataaaaatgaatgccaaaacctcaaatcttgatgaagatcaagattctcatgttgtcttaggtctaatacttgtgaacatgaaagtatcatcatcgaatgattctttctcgagctctcgcgtttaatataagtcctctctgcaaagtgcgtat

SEQ ID NO: 5 - DNA, 1004 bp, Arabidopsis thaliana
ttttacctgaaaggggatttggaaaaaccctctcactctcaggctcaagcgccggcgttcactctctaaccaaactcgatttcgtttctgggttgtgagattgagaaatgccgagatcatctttgcggctactagctaagcctctcttggagagcaggcgagggttttgcacgagctctgataagatcgtagcttcggtgcttttcgagagattgcgcgttgtgatacccaaaccggatcctgccgtttacgctttccaggagttcaaattcaattggcaacagcagtttcgtcgtagatatcccgatgagttcttagacattgctaagaacagagccaagggtgaataccaaatggactatgtacctgctcctagaattacagaggctgacaagaataacgataggaagtcattatatagagccctagacaaaaagttgtatcttctcatattcggcaagccatttggagctactagtgacaaacctgtttggcacttcccagagaaagtctatgattctgagccaactcttcgcaagtgcgcggaatctgctttgaagtcagtcgtaggagacctcactcacacatactttgttggaaatgctccaatggctcacatggccatacaacctacagaagaaatgcctgatttgccatcttacaagaggttcttcttcaaatgcagtgtagtagcagcatcgaaatacgacataagcaactgcgaggattttgtgtgggtaaccaaagacgagctcttggaattcttccctgagcaagctgaattcttcaacaagatgatcattagctgagccactcacaccacaaaaactcctattttcatcccttcttctccatcaatgtcatctctctggtattagacagtgtgagaaggtcaatgtaataaccaaacaaaaccatgtctctggttgtgacgtgaaggaaatttttgttgacagttgatctgaagtacgtagttgaatgtagttgtggcttctttctcaacc

SEQ ID NO: 6 - DNA, 991 bp, Arabidopsis thaliana
atgtcaaattgctcaaaaatggtagaggtgccgtgccgtcaatagatgtcacgtgtcctgacttgccttctcaatacaaacaaaaatactctctacctaaaaaaacacaataaacaacaaacgcatctttggagcggcggtgagattagagaagaagggtttgtgaaatggagtccagtgaggatgtggagaatctgagtagagctattgagaagcttcttcatgagaagaggaagagagaagcttctggtgacgccttcattgaagacgctgatgatcagcttttcctctctagccttatctctcagttggaatcaccaaaccccaaggggaaagaagatgtcataaccggagaagaagaagaaaaagaagaagaatctgcagattcttcaccatccaaaggaaaaagcgagggccagagacaattggaagaaagtatagaagaaatagctaaagacatcaagaaggtgaagaagcagaacaaaataacccatgtacttctctcggctacgatcatcctgacattggtttggcagctctctgagtactccatgattttcatgttgaaagatagaataagccacccagtcagatccatcggaggtatgcttaatggaatgttcaaaggtaagttacgtccaatcaagaaccaacttgcggggacttccaactccaatgaccaaaacaaccatgggaatggatcacacactggacctcaacttcaagtgcccgagctgttgcgagaattcggtttcgacgatgaagaatgatagcttccctttgtgactcaataataccagttgttatttaggaacaggggtcaccctcattgtttctttgcttttagtataagtagtttacttttatatgatcaaaatgcgaaagaatagttgctttctcaaacttttccacatgaaaaagggttccaaaagagaaccgtatttcaaaaaatcttttgttttacccttactgaatcatggttcagtgcccg

SEQ ID NO: 7 - DNA, 2554 bp, Arabidopsis thaliana
aacggaaaaggtttaggaaaaatgtgttgttgatttgagatttctcgaagtgttggtgagcgattagggttctgtattgtgaatctatcgcgtcgttcgtcggagaatgaatttcgttgtacagagattttagactgaacctaagcagaacttgcaggttacagtttcctttcgtcgatcgattgctgaacttgataggttctttgagtgtttctctgcgatatggcgaaccttccgatccttcaatttgaagagaagatcgtggaaacagtggagaagaattcagtggtagttataattggagaaaccggttctgggaagagtactcagctctctcagatacttcatcgacatggttacacaaagtccggcgtcatcgccatcactcagccccgacgtgttgctgccgtttccgttgccaggcgagtcgcacaggagcttgatgtacctcttggagaagatgttggttatgcgatacgtttcgaggatagaactacgagtaaaacacggattaagtacctcacagatggagttctacttcgtgagagtctgtccaatccaatgcttgatgattattctgttatcatattggatgaggctcacgagaggagtttaaacacggatattctgttgggtctagtgaaacggttggttagaatccgtgcatccaactttaaagttcttataacctctgcaacacttgacggcgaaaaggtttctgaattcttttcgggctgccctgtgctgaatgtacctggaaaattataccccgtggaaatattatacagcaaagagcgtcctgtcagctatattgagtcatctctgaaagtagctattgatatacatgttcgtgagccagaaggtgatattttaatcttcatgaccggacaggatgatattgaaaaattagtatcaaggctagaggaaaaagtacgaagcttagcagaaggatcctgtatggatgctattatttatcctcttcacggttctttgccccctgaaatgcaggttcgtgtctttagtcctcctcctccaaactgccgcagatttattgtttctaccaatattgctgaaacttcccttactgtggacggggttgtgtatgtaattgattccgggtatgtgaagcaaagacaatataacccatcaagtggaatgttttctcttgatgttattcaaattagcaaagtgcaagctaaccaacgtgctggacgtgctggccgaacaagaccggggaaatgttatcgtttatacccattggcagtctaccgagatgacttccttgatgcaactattcctgaaatccaacgaacttctcttgccgggagtgttctatacttgaaatcattggatcttcctgatattgacattctcaagttcgattttcttgatgctccttcatctgagtcattagaagatgcgttgaagcaattgtatttcattgatgcaattgatgagaatggagcaataacaaggattggacggacaatgtctgatcttccactagaaccatcattgtcaagaacattgatagaagcgaatgaaaccggttgcttatctcaagctctaacagttgttgctatgctgtcagcagagacaactcttcttcctgctaggagtaaacccagtgaaaagaagaggaaacatgatgaagattctaatcttcctaatggatccggatatggtgatcacattcaactgctacagattttcgaatcttgggaccgtactaattatgatcctgtatggtgcaaagagaacggcatgcaggtgcgagggatggtgtttgtcaaagatgttagaagacagttatgtcagattatgcagaaaatatccaaagatcgattggaagttggggcagatggtaggaagagttcaagccgagacgactacaggaagttgaggaaagctctatgcgttggtaatgcaaaccaaattgctgagagaatgcttcgtcacaatggataccggactcttagtttccagtcccagctagtccaggtgcatccatcatctgtattgagtgccgacaatgacggaatgatgcctaactacgtagtgtaccatgagctgatttccaccacacgtccgttcatgcggaatgtttgtgcagtagatatggcatgggtggctcccatcaaaagaaagatcgagaaattaaatgtcagaaaattgagcggtggaccggctccctctttcaaagtacctgaggagaagacggagttgtctaaaaacaatgcagaaacacctgcagtttctgaaaatgttgagagtcggattgaagcagccagagaacgctttcttgctcgtaaaggacagaaataaatttgatgtctcaaacataaatacaagattcaactagccctataaagaatagaaaagagaagctttctgtagaagatttgttattagagacaattttcaaattttgtatgttctgttttttttttttttggctcaacttaaacttttctttattctcattcgacatgagttttaaatttttaacccaatttggtatgttcttagtattatgtttaaaagatgataatgt

SEQ ID NO: 8 - DNA, 2482 bp, Arabidopsis thaliana
ggggttttgagagaggcgcttctctgctgcaaattgcctttactgtgtttctctcttcccctttataaaaccgcttccgtcgtcaatggcgtgagcctaaacaagaaagaaaaaccattcttctctcttttcgtttttttcattctctctctctctactccatcgttttcacacttttctcgccgccctttatccttatccgataaacccacaaataaagacagactcttttgttctttaaacagagattgtaaatccagagccgccggaaaatacaaccgccggtttactctcaggattagttgatattattcgattttaaaaatcagtaggaagaagatgaagtacgtgcttgtaacaggaggtgttgtgagtggattagggaaaggagtaacagcaagtagtattggtgttctccttaaagcttgtggtcttcgagttacttctatcaaaatcgatccttatctgaacactgatgctggaactatgtctccatttgaacacggtgaagtttttgtcttggacgatggtggtgaggtggatcttgatcttggaaactacgaaaggtttctagatatcaaattaacaagagacaataacatcactactgggaaaatttatcagcatgttattgctaaagagaggaaaggagattatttgggaaagactgttcaggttgttcctcatgtcactgatgcaattcaagattggatcgagagagttgcggttattcctgttgatggagaagaggatcctgctgatgtttgcgttattgaattaggtggaacaataggtgatattgaatccgcgccttttatcgaggcgcttggtcaattctcttaccgtgtaggcccagggaatttctgtctggtccatgtcagcctcgtgcctgtgcttaatgttgttggtgaacagaaaactaagccgacacagcatagtgtcaaggggctacgaggattgggcttgacgccggatatcttagcttgtaggagcacaaagccacttgaagataatgtgaaagaaaaactagctcagttttgccatgtcccgcttgagtatatcttcactctctatgatgttcccaacatttggcgtattcctttgttgctaaaggatcagaaagctcatctggcaatctcaaaagtgctcaatcttgctagtattcttaatgagccttctctaggggaatggacttccagagctgaattatgtgacaatttacatgtgccggtgagaatcgctgttgtggggaaatatacaggcctctctgatgcttatctctctgtcttaaaggctctcttacatgcttctgtggcttgtcgcaaaaagctcgtagttgattgggttccagcttgtgatctcgaaaaagaaactgagaaagagaatccagatgcgtataaagctgcttggaagttgctaaagggtgtagatggaattcttgtacctggaggttttggtgatagaggagtggaagggaagattcttgctgcaaagtatgcacgtgaaaacaaaatcccgttcctcggtatttgtcttggaatgcagattgctgtcatcgagtttgcacgatcagttctaagcttgcaagacgcaaacagcacagaatttaaccctgaaaccaaacatccttgcatcattttcatgcccgagggttctaaaactcatatgggaggcactatgcgcttaggatcaagaaaatccatcttcaatgtcaaagacagcaaatctgcaaaactatacgagaacaaaagctttgtagatgagaggcatcgtcacagatacgaggtgaatccggacatggttgaacgccttgagaaggccggtctttctttcgctgcgaaagatgaaactggcaaacgcatggagatcattgaacttccaaaccatcctttctttatcggtgctcaattccaccccgagttcaaatccagacccgggaaagcttctcctctgtttttagggctcattgcagcatcgtgtggcgagttagacacagtcctgaatccagcttctgctcatcaacattcgattagtaacggtccaacaaacattttcatcaatggaacttccaagaaatctcccaatggcttggctgatgtaagatataataacggctactgcaatggcctctacactagatagctgcatttgctgaattctccctctccattagaattattgctttgtgttcgatttagtttggattttggtttgctttcttcttaataatcttaggatttttcctctgtacatatgatccaagcttttgctcagttttttttagactcttttaacagacttatgatctggaaagactctagaaacgtttgaaaatggcggtttgattcccctggttcgttttttttttccaccaaaagggatttcatatgatcttatgtaccgttggaacattttacatctctcgatttggtctgaatgtgtaagaagcatttgataaataaaactttaaacaagtctttat

SEQ ID NO: 9 - DNA, 1707 bp, Arabidopsis thaliana
ctctacacaaaaaaaaaaaacaaaaaaaaaaatataactctcaaacaacccaatctaaatggcttctctatctttaccaataactctcaagaacccaagattcttctcttcttctcctcaaaacatctttaaaacccaaccccaaaccctagttttgacaacaaagttcaagacttgttccatcatttgctcatcttcatgcacaagcataagctcttcaacgactcaacagaagcagtcaaataaacaaacccatgtgtcagacaacaaacgagaagaaaaagcggaagaagaagaagaagagaaagaagttagtcttcgagaaatttggagagaagtacaaggttgcaataattgggaaggacaactagatccaatgaacaatcatcttcgaagagagatcatacgttatggcgaatttgctcaagcttgctatgactcattcgacttcgatcctcactctaaatactgtggctcttgcaaataccatccttctgatttcttcttaaaccttgacctacatctccacaaaggctacaccataacacgttacctctacgctacatccaacataaacctcccaaacttcttccagaaatcaaaactcagctcgatttggagccaacacgcgaactggatgggttttgttgctgtagctacggacgaagaagaggtgagtcggctcgggagacgtgacatagtcattgcttggagaggcacagtcacttatctcgaatggatctatgacttaaaagacattctttgttcagctaacttcggtgacgacccatctatcaagattgaattagggtttcatgacttatacaccaagaaagaagattcttgcaaattctcttccttctcggctcgggaacaggttttggctgaagtcaaacggcttattgagtactacggtaccgaagaagaaggtcacaagacaagcatcaccgtgacagggcacagcctcggcgcctctctggctttggtcagtgcttatgatatcgcagagctaaacttgaatcacgtaccggagaacaactataaaattccaattactgttttctccttctcgggacctcgagtaggtaacttgaggttcaaggaacgatgtgacgaactaggggttaaagttctgagagtcgttaatgtacacgacaaggtaccttctgttccagggatattcacaaacgagaagtttcagtttcagaagtatgtggaagaaaaaacatcattcccgtggagctacgcgcacgtcggcgtggagcttgccttggaccacaagaaaagcccatttctgaaaccgactaaggatttgggttgtgcacataacctagaagctttgcttcatttggtggatggttatcatggaaaagacgaagaagcagagaagagattttgtttggtgacaaagcgagacatagctttagtgaataagagttgtgatttcttgagaggtgagtaccatgtgccgccttgttggagacaagatgagaacaaaggtatggtcaagaacggcgatggacagtgggttcttccggaccgaccactgcttgaacctcacggaccggaggatatcgctcatcatcttcaacaagttcttgggaaggttaacgatgataattttaaacccacaacgacttaagtcgaaaattaaatataaatagttataaaaatattttcgtaattaatgtgtggatcacgtttgat

SEQ ID NO: 10 - DNA, 1203 bp, Arabidopsis thaliana
gaatttcagacacacaaacccactgaacattcaaatgtctcgttctcttgtcttcttcttcctctttcttgtcttggtcgtcccttgtctctcccatggaaccggaggagaccacgacgacgatgaggcttcgcacgttaagagttccgatctcaaatccaaatccttaatctccgtcaagatcgcatgtcttgtcatcatctttgtcctcacgttcataagcggtgtatctccttatttcttgaaatggagccaagggtttttggttcttggtacacaattcgccggaggcgtgtttcttgcaaccgccttgatgcatttcttgtcggacgctgatgagacgtttcgtggtttgttgacggcggaaggagagtcggagccatctccggcttacccatttgcttatatgttggcttgtgctggttttatgttgaccatgcttgctgattctgtcatcgctcatatctactcaaagacccaaaacgatttggagcttcaaggagaagacaaatcgaatcagaggtcagcaacaactgaaacttcgattggagatagcattctattgatcgtagctctctgttttcactctgtcttcgaaggcatagctattggtatttcagagactaaatcagatgcttggagagctctctggacaataacactccataagatatttgcagcgattgcaatggggatagctcttctccgtatgatccctgaccgtcctttattctcctcaatcacttattctttcgcattcgccatctcgagcccaattggtgttgccatcgggatagtcatcgatgcaacgactcaagggtccatcgcggattggatattcgcattgtcgatgagcttggcgtgtggggtatttgtgtatgtatctgtgaaccatttgttggcaaaagggtatcgaccaaacaagaaagttcatgttgatgagcctcgttataagtttttggctgtgttgtttggagttgttgtcattgccattgttatgatatgggacacttgaaaaacactacaattgtcccaaaatactgattagatttttctggtttgcaaagaaagcttgttgatttttgtatgtttatagcatgtagcaatcctcgttttgtaatgtactttgtacttttgtagcatcaaagataacacaccaataagagaggtttctttcttgttcgatttggacaagcacggttt

SEQ ID NO: 11 - DNA, 1546 bp, Arabidopsis thaliana
ctgttatagctttatctttttatctttactttcataaaatcaaagttaaagacttggcaatcagcaaacactaaaattacataactttaccctccactatcaaaagttacattgagccacccaactactttataatctcgtcgtttacacccctacaattgttaaaattcattaataaaatccctcagattgatactaaaacttcatcataactcactaattcccttaaagcttcaagaacgaaaaaatgtacgtgacgagaacattgtcgcagttcagaaaatatcagaagacgctctcggaagagtcaccggaaggtccgttctccggcgttttggttatcacagatgaagaagctgaaacagaggatacgttctgtttcgggatgtgtacgaggacaaaaatagagaagcttccgttacctcaggacaagatcttatcagttgttcacttagacagttctggtaacagagagacttcggttaagaaggtcttgttcataccggctctcgatcaacctttgtcttccaatcggtattacgttgttcacgctagaggcagacacaaagggaaagtttccgtgtgttctagagagatagagaaaggggtatgttgttttccagatatcttgcatgacaagaaacctaaacctctggatccaagaaacatatatcagacggttaagatcaaccggcatcacgaccggacattctatgcaaaatctgtggcgccagacggtacaccgccaacatttctcaagaagaaaggatgggagctacgaacctcgaggagcctacatccgaggagacctagagaagctcttggcctagacgaggaactaagagctcgtctcccagcatttggatttccagtttctacaattcggtcaggaagtgtgatagttggagaatggtattgcccttttatgtttgtgaaggagaattgtagtgtaagtcaacaaatgaggaagtcaatgttctataggatcacactatcccaatactgggaacgaatttaccattgcggaaacaatgatcttgatgaaaacaatgatgaaaacgaagaagaagttgtgagagtagaggctaacgtcgtgagagaggccaactatgtgaagggtatggaggcggttaagggagagaaagaagggcatggagggttttattggtataggcaggttcaaggtccacggggaccgggggagaggaggaggaagacgggtttaaggtctccggtggggctgagttttgtggtggtagaaaggatgagaagggtaatggaggaaggagggtgggtgggaggaggaaggaaagtggtgagggtggagagagatgaaccaatcagggtttgtagaagagatggtaggaatatgaatggtaacaatgatagaaattggaggagatttgggtgttatgtgttggtggagagttttgggctgagaagagcagatggagttttgttggttaaatgtgtatttagacatactaatagattgagatgtaactgggagtgacacttcatcttatgttataaaatttattacttc

SEQ ID NO: 12 - DNA, 1280 bp, Arabidopsis thaliana
ggtaaacggcaaatacccttttccttcactttcttcgtcttctcgaatctgagagaacgagagatcaacaacaatggcgctcaaatcaaaactcgtctctcttctcttcctcatagcaacactatcatccacattcgcagcttcgttttccgattcggattccgattcagatcttctcaacgaacttgtatctctcagatcaacaagcgaatcaggcgtaatccatctcgatgaccatggaatctcaaaattcctaacctccgcttccacgcctcgtccttactcgttactcgtcttcttcgacgctactcaactccacagcaaaaacgagcttcgtcttcaagagctccgtcgcgaattcggcatcgtctccgcttcattcctcgctaacaacaatggatctgaaggaactaagcttttcttctgtgagatcgagttttcgaagtctcaatcttcgttccagctctttggcgttaacgctttacctcacattcgtcttgtaagtccttcgatatcgaatctacgtgatgaatctggtcaaatggatcaatcggattactctagattagctgaatcaatggctgagtttgttgagcaacgaactaaactcaaggtcggtcctattcaacgtccaccgctactttcgaaaccacagatcggtattatcgttgcgttgatcgttatcgctactccgtttatcatcaaaagagttttgaaaggagaaactattcttcatgatactagactttggttatctggtgctatcttcatttacttctttagtgttgctggtacaatgcacaacattatcaggaaaatgccgatgtttcttcaagatcgtaacgatccgaataagcttgtgtttttctaccaaggatctggaatgcagcttggagctgaaggatttgctgttggattcttgtatactgttgttggattgcttttggcgtttgttaccaatgtgcttgttcgagtgaagaatattactgcacaaaggttgattatgcttttggctttgttcatatcgttctgggctgtgaagaaagttgtttacttggataactggaagactggatatggaattcatccgtattggccatcgagttggcgttgattacatcacacttgaggatctctgtttcacaaggtaatggctttagttttggaaaaacagttatgggaattgagtaatgatgtttctggatgttttgtgtttcgatttgaaatacttttgaatcggtgtagtactactatttcagatggtttaaaactccttactg

SEQ ID NO: 13 - DNA, 2458 bp, Arabidopsis thaliana
aattttattatttgattttcagtcctatctctcttctcttgtcttgtcctgagatcagatgtataaaaaagagacttcttttcttcttctctcttgattctctcttccactgtcattatcttcaagatttgtctcttgcgagactcgatgaagcttcatcaatttcttgtgttccttttcttgttcctctcatgttttgctctttcttcatgggctcttcctctctgttccgattcaagagctccctcggaggtgaattcgacattgagcttttgtccttacaaaggaaaaacatgctgcaatacaatgaaagataccagtttgatgaagcaatttcaagctatgaacatttccgacaagggttgtgcttctgttgtaaaatcaatcctttgtgctaattgcgatcctttttcatcagacttattcagagataactcagatcagcagtctgttccaatcctctgcaactcgaccagttcagcaaattccacagagaatttttgctctgagacatgggagacatgtcaaaacgtctccatatcgggttctcttttcgctgcctcattacaaggccgagctggagcgccgtcaaataaaaatgcctccaagcttgctgatctatggcagtccaaaaccgatttctgcagtgcctttggtggagctagctccaatgaaactgtttgcttcagcggtgagccagttgctcttaatgacaatgatactactcctgacaagccgccttctggtatatgccttgagaaaattggaaacggttcttacctcaacatggttcctcaccctgatggctccaaccgtgcattcttctctacgcaacctggaatagtattcttggctggtataccggatcaagattctggcggggttttggatgtggatccatctagcccatttgtggatatgactgatgagattcattttgatactgagtttgggatgatgggaatggcttttcatccaaagtttgctcaaaatgggcgttttttcgcttctttcaactgcgataagtccaagtggccaggctgtactggaaggtgctcatgtaactccgatgtgaactgtgatccttccaaactaactcctgacagtggatctcaaccatgccaataccaaaccgtaatagctgagtatacagccaattctacctcgtcagacccttctaaggcaaagaacgctaagccaacagaagtcaggaggattttcacaatgggacttcccttcacatcacaccatgctggacagattctctttggtccagatgggtacctatactttatgatgggagatggaggtggaggagcagacccgtataatttcgcacagaacaagaaatctttgctaggaaagatcatgaggcttgatgtagataacattcctagtgcttctgagatctccaaaatgggtctatggggaaactactctataccaaaagacaacccttttcgtgaagacaaagagcttgaacctgaaatatgggctgttggattgagaaacccttggagatgcagctttgattcttctaggccttcttacttcatgtgtgctgatgttggacaggacacatatgaagaggtggatctcataagcaaaggaggaaactatggttggcgtgtttacgaaggcccggatcttttccatcctgagtcatcccctggaggaaacacatctgttaaatcactaaacccgatatttcctgtgatgggttacaaccactcagaagttgactcaagcggaaaatcagcttcaatcactggaggttacttttatagatctgaaactgatccttgcatagctggaaggtacgtatatgctgatctatatggaaatggcgtgtgggcggggattgaaacgcctgctaatagcgggagctttgtgaccaaaagaacaaccttcagctgtgccagtgactcacccatgaaatgtagtgattccccgggaacttcagggctctccctagggtatgtcttctcctttggtgaggataacaacaaagacatctacttgctcacaagcaatggtgtctatagagtagtaaggccgagccgttgcaacttgacttgctccaaggaaaactccacagctagaagaaaccccggtacctcaagttctccttcttcttcatcgtcttcttgttataagcatataaatggtttccatggaagcttggtggttttgtttgtgtctctgtctttgattctgctaggtttattaaactaatttgcaaaagttgtttcttgtttgtgttgaagaattattatgagattgtatgttcaggatcttttgagagaacacaatacatgtatgatgaatgagaccaacgatacacaaatccttagattatagtacttaagggtgatgataacgacacagacaattcataagcagatagaggctttcctttgccatcgtctgatctggctgttgttgtaatattccctca

SEQ ID NO: 14 - DNA, 1204 bp, Arabidopsis thaliana
gtgtgggtcagagtctaactcgattagagagaagaaaaaacttgttcgaggcttcgaagaatgtcgatgttaatggctgtcaaaacaacttcactctgttgtagcagcttaaaccttacagcttcaccaacattccgacggaacccacgcgcggcgagattggtgaatccgacagcgagaatccaaacacgttttcatcgcctgattgaagaacaaggcattgtgcttatgcctggatgctacgatgccttatccgcggctattgtgcagcaaaccggattctccgctggttttatatccggttacgccttatccgcttctctcctgggaaaacccgatttcggtttgctaacaccaccggagatggctgcgacggcaaggtcggtgtgtgcgtcagctcctaatatacccatcattgcagatgctgataccggtggaggaaatgcgctaaacattcaaagaaccgtaaaggatttgattgcagctggtgctgctggttgcttccttgaggaccaagcatggccaaagaagtgtggtcatatgcgtggtaaacaggtgataccagcagaagaacatgccgcaaaaatagcatcagctcgagatgctattggagactctgacttcttccttgtcgcaagaacagacgtgcgtgctacttctgcaaaatcagggcttgaagacgccattgcacgtgttaatctatacatggaggcaggagctgatgcttcctttgtagaggcaccaagagacgacgatgagctcaaggaaattggaaaacgcacaaaaggttatagagtttgcaacatgattgaaggaggagtcacaccattacacacgcctgatgagcttaaagaaatgggattccacttgatagttcacccccttaccgcactctatgcatcgactcgagctctggtcgatgttctcaagactcttaaagaaaacggtagcactcgagatcacttgcaaaagatggctacttttgaggaattcaatagtttggtggatttagattcgtggtttgagcttgaagctcgctattcaaacctcagaaacgctcttgggacaaccaaatcatgaagatagggacatttttttttttttttggaactctctcaagcaatggtctcatcaataatgtaactattgccgttgttagaaaaacgtatttaagtatattaatgggccttaatggtgttaagta

SEQ ID NO: 15 - DNA, 1268 bp, Arabidopsis thaliana
gaccatttttacacacagccaatcagagccttgtttcatcgtctcttgtcgaggcgataatatttagatctgctcaccatttctccgccatcgccgacggaagaagaaagatgggagacaacaaccctaaccgatcagaagcagaacgtcttctcggaatcgcggagaagcttctcgagtcacgagatctaaacggttcaaaagagtttgcaatcttagctcaagagacagagccactcctcgaaggcaccgatcaaatcctcgccgtcgtcgatgtcttactctcatcagcaccagagaatcgtatcaaaaaccaaccaaactggtacaaaatccttcagatcgaagatctaactgaatcatcaacagacaacgatctaatcaagaaacaataccgtcgtcttgctcttcttctccaccctgacaaaaaccgtttccctttcgccgatcaagctttcagattcgtgcttgatgcatgggaagttctatcaacacctacgaagaaatctcaattcgatggagatttgaatctcatcttcactaaagtaaatctcaacactcagaaatcgaagaagaaaacaacaacgaatgagaagatgtctacgttttggacggcgtgtccgtactgttacagtcttcatgagtatcctagggtttatcaagagtattgtattagatgtcaaaactgtcaaagagcgtttcacgctgcgagtattcctcagttgcctccgttgatacctggtaaagatgagtattattgttgttggggtttttttccgatggggtttgttggtggtaaaggaggagaagctgccattgctaatggagtagatgcagctaagttccctaattggatgcctccggttttctcatccggcggcgttgcagctcctccaagtggtaatggtgttagttttgatggatggtcaggtggtgcggcgaagagagataatgaggctgtgaggagtaataatggtgttggagttaattcagatggaacaccgaagaagagaggaagaggaaggccgaagaagaatccggtttagtgatctcttttcaaactccggtcatgattgttaaaattatggagacaaaattttaaaggcaagttttttttaaggcaaggaagtttaggatcagcgtttgttgtcttagtgtaaactttattatgcatttgttgttattaccgttgtgtaattgtgttatcttgatttactttgaaacattttcctcattacataatttggcaattcgctcttttccacttc

SEQ ID NO: 16 - DNA, 1887 bp, Arabidopsis thaliana
atttattgcagagatagtgattttttaaattgacctttgaacatcccttttacatgttttcgagatttgtttttcttattaaacagccaaaaagtatctggcttttttctcctctctcaaagttttgatttttaagtgatttagggttttttcatcccctggaggaagaagtttgagtctttgtatctactttgatcaaattgttggtcgcgactggtgcttgaagatatagctttggttctttatgcaaggtttactctcttagaagaatgagagcagataatgatcacgcgcttggtaactcgatagagatttgtaaagatgaatctaagccgcatcaatgtcttgatgagaattgggaagatgcagagctaaaggtcccggaaaatgggaagaacaacaacaatgtgtgtgagttgttctatgatacaagaagtggtgaagaatgggagaatgaggccggaaagaaagttcgagatactagtcatgattgtgatgctaatgtggattctcctgagaaaaaggatccggttttctatatggacaagaatgttacggcctgtgatttacctgagattgttgtttgttacaaggagaatacttaccatatcgtcaaagatatatgtgtcgatgaaggtgtgcctgttcaggagaagttcttatttggtgagaaggattctgtcaagtctagctcaacagaggatttgatgaaagcagacaaaacaaatgtgaatccatcagaaactaagtctgcggaagacagcatcagtaaggttgatgattctgagttttgtaacgatcataagacagacagagatgttgaagaatcttcaggagaagattttgctgatgctgaaggtacttctagcaattacaatcaagagcatttgattgtgacagaggaagtcaaggcttcaccaacacatgggctaagtccctctgaaattgaacctgatgagaattcaaaggacgaagtggctatatcacaggataatgactcaaaggaatgtttaacattgggagatattctatcaagggaagatgaacaaaaatctctcaaccaagacaacattagcagcgatagtcatgaagaacaatctccttctcagcttcaggataaggaaaaaagaagcttagaaaccacagctatcgaaacagagcttgagaaaacagaggagccaaaacaaggagaggagaagctttcctctgtttctacaacgacctctcaagaaccaaacaaaacttgcaacgaacctgaaaagcctgaaactgagaatcatcatcagcaaaactgtttagtggaaaactcttacgaagacgataaattttcttcaagcagatttggagagacgagtttctctgcagcagattcagtttcaatatcaggtcatataacatactcaggaccaattgcatactctggaagcctctctgttcgatcagatgcaagcacaacgagtggaagatcctttgctttcccaatattgcaatcagaatggaacagtagtcctgtaagaatggcgaaagctgataaaagaagacaaaaaggaggatggagacacactcttctctgctgtagattctcttgatgtctctcctccacaatttagtcctaaagctattcactttgaagcacagaagaagaagaagaagaagaggaaagatttatgaaattttataatattttcttaaaatgagagtgctttttttttttattactgaaggtaaatatttttttctctcttttgggtgatgagtggtttatagttatgccttggtgtgtaataggcattttggtagttttacagtttaggtcttttgagtttggaaccgatgagttatattataaattttttaatgaagggctctttggatttagcattggtt

SEQ ID NO: 17 - DNA, 695 bp, Arabidopsis thaliana
tttctctacttctctccgcctctctcgcatctcctccaaatcgaaatcgctctctgcctctcttcgtctccgtctccgtctccgtctccatctctgtctccggtaagtaactgaaagatggggcgtgttagaaccaagaccgtgaagaaatcttctcgtcaagtcattgagaagtactactctcgcatgactcttgactttcacactaacaagaagatccttgaagaggttgccatcatcccatcaaagagactccgcaacaagattgctggattctccacccacttgatgaaacgtatccagaagggaccagtccgtggaatctcactcaagcttcaagaagaagagcgtgaacgccgtatggactttgttcccgatgagtctgctatcaagactgatgagatcaaggtcgacaaagagactcttgagatgcttgcttctctaggaatgtctgacacatccggcatctctgcagtcgagccacaacaagctatggcaccaatcgctgctttcggcggcagggcacccagaagatactaagatggcctcagctaatcatcagctacgattggctctcttttttctcagttagggacaagaaagacttgtgtggttgtttattgtttcttctgattatgtcttaaactcaatgtgagactctttcgtattaatggtttttaagttatgtggaacca

SEQ ID NO: 18 - DNA, 401 bp, Arabidopsis thaliana
aacaaagtgggctgtaatgatgtcagaatttgcaccaatttctatctatttagtgattagtctgctagtttctttgatcctactcggtgttccttttccatttgcttccaatagttctacctacccagaaaaattgtcggcctacgaatgtggtttcgatccttccggtgatgccagaagtcgtttcgatatacgattttatcttgtttcaattttatttttaatccctgatctggaagtaacctttttctttccttgggcagtacctcccaacaagattgatctgtttggattttggtccatgatggcctttttatttattttgacgattggatttctatatgaatggaaaaggggtgcttcggatcgggagtaaagtgatagggcacaaaatgggggga

SEQ ID NO: 19 - DNA, 1425 bp, Arabidopsis thaliana
aagcaaaaaatcaaaagaaaaaaaaaaagtaaaggagcaacaaaagcaaagcaggtggtccgttcccatttctctgtaatttgtcttcgtctctaccttccatctctctcacccactctcctcggaaaccacagcgacggacggacggacggacgataaaacttttgcctctaatttgctcctacaaatctggaatcagccggagcgaatctcgaagcttatgatctcgacttgctgaagaggctgggaatggctggtaaagaggagactgatgtatctgcacaagggtctttaaccagggaggccactgagatatggaggagtgagttggaatctcgccggtttcaggtagatagtttagaagctgaacttgtggatgtcaaggcttaccttgagtttggctcagaagaagatgccagaaaggagttaggagttctttcgggtagggtcagatcgactgcaactatgttgcgttatttgagatcaaaagctagagtcttggccattcctgatgatctagcaaatgtgtcatgcggtgtggaacagattgaagaactgaaaggattgaaccttgttgagaaagatggtggttcatcttcttctgacggggctaggaacactaatcctgaaactagaaggtacagtggttccttgggtgtagaggatggagcctatactaatgagatgctccagtccatagagatggttactgatgtgctggactctcttgtgaggagggttacagtagcagaatctgagtctgctgttcaaaaggagagggcacttttgggagaggaagaaatcagtaggaagactatccaaatcgaaaatttgtccgtgaagttagaagagatggaacgatttgcttatgggactaatagtgttctaaacgaaatgcgggaaaggattgaggaattagttgaagagacgatgaggcagagggaaaaagctgtggaaaacgaagaggagttgtgtcgtgtgaagagagagttcgagtcgcttaaaagctacgtcagtacttttaccaatgttcgagaaacacttctttcgtccgagagacaattcaaaaccattgaggagctctttgaacggttggtcactaagacgacacaattagaaggggagaaggcacaaaaggaggttgaagtacagaaactgatggaggagaatgtgaaattgacagcacttctcgacaagaaagaggctcagcttctagctttgaatgaacaatgcaaagttatggctttgagtgcatcaaacatatgaaatttgctttatctttgcattgttgttggctcatctcttatttttttcttgagacaatgctttcgcagaagtagatgaatgcaatcttcttccttcattgttctttgcttcaaatgtgacattgtaattttttatctgtagattattatggtttatgca

SEQ ID NO: 20 - DNA, 1461 bp, Arabidopsis thaliana
attattcatttcttcttcgtcttcttcttctttctcaaattagcttttctttatcgtcttcctcaagcgtgagattcgttgtggatatagtttttctccttgattctctggttctttccatgatccaattttaagggtttcacggcttcgtttttttgggtatatctagctctatcgttcgtggtggttttctttctggatcaaagttttctgagatctctgcgatttctgggattcgaaaattggagaattagggcttttttacggtaacagggtttcgaagagcataagataagaatgccttcggtgccctctaagcttcttcctctcctgtctttgattccttcgttgactccttatcattctggtttgagttctaatcgtttgaaacctcttgaaaagtgtgattggcgtggtaatcttagttaacatttcctttccttcttctctcctttttaccctttcttctctcgccctcgtttacttcttgagattttcttagctcgatttgatctttggtgctttaacttctggcggtgtttgatttgcagcacaaaaagttactactactactgtgattaccttgtactgttagttggatatgagctctgtttgtggtaagttggatttcaaagatgcagactttgacatctctacttcgagtcccacacaatgttctaaaggctcggagcatacctcgtttactggctctgaagattctcaggagtctgatggagatgaaactggttatatagacccaactgtgaatgatgaaaccgctgttcaggatttcggcaaatctgttttaagtcctaactcttctgatgatgaagacaaggatgagaaccttatgactcagacaccaattgttcttatcccagccataaaaggcagtcgagagaagtatggcttgtcactgaggaagtcgagtgtttcatggggggctgatgtgtatgatcctcctccctcgatagcctcccacacagtcacaagaagcaagaaacagcagcagaaatccaagagcaaagacaaccacaggaagactggaaagaaaggacagaagtctaaagacaactcttcctcacgtggtggcagcagcaaagacaagaagcaagcttctcgcaaacacagtcgagacaaatttgattgggtaactcagatgcctatagttgcagcatcttcatgaatgagtggctgctagtaaccaagcacattttcagtttggcttcctcttgtatgataaataatcaaatctctgtgtgtgattcatgttgagtttcgtaacttttcagtttttttttttatgggtaatggatgatccttgacactattgtgaagattttgttgaagtttgttacttttttctttttggttccagttttcacttttgagaataagtcaatggaactttattgttgaaacgttgtccgcttatttgaaccaaattcagtttataatttg

SEQ ID NO: 21 - DNA, 1112 bp, Arabidopsis thaliana
gaagcatttttgggagacgaggaggcgatccacggcttattcttaagaaaccttccacagtcgccgccgattttatcttctccgccggaattgtgagggatcaacaaatggctcccagaggaagaagaaagaaggctggattgatgcgagaggatgcagcacgagatcgcatgagaggatttgggtttcatgagcatgttatcagtgagagtattaaggaactgttagaggtctacgaagaccaatggtttttgattgaagatgatagctatggtcccctccttgctatctgccttgaaaagcaagaggaaaaagagaaacaattggctgaagtacaagccaaccaattgcctgagaatcacaatgaagagatggctgaggaagaacaacccaatcaattggctgtggaaatacacgaagaagagaaggagcaggagcaggacatgcatattgagtatggaagagaccaagctgatgagttatcaatcaatagcgaagcagtcaatgacccatcaccagcagctattcatttgggagaagcatcatcagattatgcacaaagttctgttcgaggtgtggagaatcttcattgtggatggctaattgatgaggaggagacggatcctgaggaggaaacggatccagaggagaaggagaccgagccagaggatccaaaggagaaggagacggagccagaggaggatagtgatggtgatgatgatgagatcattcagcttactccagaacctctttgtgaagaacttcaagagcttctcagggaagtacgtggacagaagaggaggaagaaagagatgaggtgggacaagtaaaggagctatggagctcctgtaagtagcaaattgatatatatgttaggaagccaaatagtagtagtaagctatagtattgtggtgaaaaaaggtaaaacgacccatcttaacatctcttgagatattggtttttaataatttgtgatggagtagagaaagcagatagtctttatcagtagttgtatgagtcatacaatagtacccgaacccacttatccaaagatcaatgtcgaaagtggaaaccaaatccctctaaagtaaattgaatagccagtctaaaag

SEQ ID NO: 22 - DNA, 1054 bp, Arabidopsis thaliana
attcgtcttctccaattttctcgcgaagaaaactttcctactttgtttcaatccaaacgagtcaaaatgcttatcaagactgtttcttcatcttcttcttcagctctctcgctggtgaatttccatggcgtgaagaaggatgtgtctcctttgttaccttccatttcatcgaatcttcgagtttcttctggaaaatctggaaacttaactttctcttttcgcgcatctaaaagctcaaccaccgacgcgctaagcggcgttgtcttcgagccgtttaaggaagtaaaaaaggagctcgatctcgtccctaccagctctcatctctcactcgctcgacaaaagtactcagacgagtgcgaagccgccattaacgagcagatcaatgtggaatacaatgtctcgtatgtgtatcacgctatgtatgcttactttgatcgggataacatcgcgctcaaaggtcttgccaagttctttaaggaatcaagtttggaagaaagagagcatgctgagaagttaatggagtatcagaacaaacgtggtgggagggttaagttacagtccattgtaatgcctctttcagagtttgaacatgttgacaaaggagatgctctttatggcatggagcttgctctgtcactggagaaactagttaatgagaagctcttaaaccttcacagtgttgcttcgaagaacaatgatgtccacttggcagattttattgagagcgagtttctgacagagcaggtggaagcaatcaagttgatctcagaatatgtggctcaactgcgacgagttggcaaaggacacggaacatggcatttcaatcagatgcttctggaagggtaagcagcttcgagggactcttgtgtctactgtgtttctatatgtgtctactttatgtttagttctttagcttttacgattttgtgaggtagtagacttctttttctgtaagagacaaaagacatgatcacataactttatattctggtataaggttcatcaaacccacctggtgatcgattctacatcggttcggtcagaatgtttttgg

SEQ ID NO: 23 - DNA, 740 bp, Arabidopsis thaliana
ttagacgaatgagatcggcaacaagagcgtaaaccctagcagcagacacaacacgagttcatcgagaagcaagatgactttcaagcgaaggaacggtgggaggaacaagcacaacagaggacacgtcaacccaatcagatgctccaactgtggcaaatgttgccccaaggacaaggccattaagaggttcattgtgaggaacattgtggagcaggctgctattagagatgttcaggaagctagcgtctatgagggatacacattgccgaagctatatgcaaagacgcaatactgtgtctcctgtgctatccactctcatgtcgttagagtccgttcccgcaccaaccgcagggttcgtactcctccacctcgtttcgccagacgcaaggaggatactcccaagcctgggcaaccaggacaggcacctcgtcctgctggacctggagctgcagctgcagctgcaccgcgtgtctgaagccttcaagcagagctttctgtcttgttttcctatgttcttgttacgtctttaaggatgtttgtctctgtttaacatagttttgccatgtggatcttgaattctgtcaaactatttcaatagttgattcaacttgttttttttttgttcctctatccagttttgcagtctgatgtcttagttaactaaatgcttcattcaacatcttaaaactagcagatgctgaatttaaatattcgtggtgaaagctgaatgttcattgttc

SEQ ID NO: 24 - DNA, 1128 bp, Arabidopsis thaliana
aaatggacaggactcatttgcgatttttaagatttaggcaaaactcttctctgtttcgacgcaaaaggaagcatttttaatggacgcattgggtggttgcggcggcgctggtggtttctggggatggaatggcttcgatcaacggagaaagaagaagtcttccggtgatagaggtaagaaacgtaattctggatcgtcggattccgtcgatgtgagcagagacgccggcggttatcggtttcctttgaagcaagctgtgacggccggagcactcactttcaccggtgacacgattgctcagctatcagggagatggaaaaagagaaccgctcttaaacaatcatcttctgagcttgacgagggggaattgtggaacattttctcagaacatgactggattcgtgcgctgcggatgagttcttacgggtttctcttgtatggtcctggttcttatgcgtggtaccaattccttgatcattctttgcctaaaccaactgcgacaaatctagtgcttaaggttctgcttaaccaagtaatccttggtccatctgtgattgctgttatatttgcttggaacaacttgtggctgggaaagctctctgagcttggaaacaagtatcagaaagatgctcttcctacgcttctttatggatttcgcttctgggttcccgttagcatacttaacttttgggtagtcccgcttcaagctcgagtagcgttcatgtccatgggttctgtgttttggaacttctacttatcttcaactatgagcaagtagttacatttatatttgtattcttcagcctcgctgagtgataatatatcattctgaaaggtttcaaatacaaaattactgtttaccaagagactatggaaggctcttctcatcctcactccttcctttctttgagtatcgcacaactaatgtgttactctgatcaaactcatggaaaactatctcctctaaaaactttagtttgagtgtttttcttgagttcaactacttgtgggtgttgggattattagtttcgagaagttactgtataatttttgaatttttatcattttaactctcagtaacaaattactttaaacttttgaatcttatgacttaaccttttaatttta

SEQ ID NO: 25 - DNA, 759 bp, Arabidopsis thaliana
ctaattccccgagagtaaccaacaacccaaagcgatcaaagaacttttcccgctagagagagagagagaagaagaagaagaagaaaagttacgcagagagactgaaagaagagtgatcgatcggagaaagatggcgatggaagtagcaacaccggctccggcaccaatcccatcggagaggaacatcgttctcgcgcctgcaacaacaacaacaaccgccactgttgagactcacaagaagaacaggatccaagtttccaacaccaagaagccattgttcttctacgttaatctcgccaagaggtacattcagcaacacaacgaggtcgagctttctgcacttggaatggcaatcacaactgtggtaacaatctctgagatcttgaagaacaatggacttgcaacagagaagaaggtgctaacatcgactgtgggaatgaaagatgagacaaaagggaagatggtccagaaggcaaagattgagatagtgttgggcaagtcagacaagtttgactctttggtgccacctgtgaccaacggcaagactccggaggaggaagccagtgcagagacggaagcttccgtggaagcacaagaagaagttgccgctgccaccgaggtctaggttggagccggttgagagatttactgcagaaggactgatttctcttttactatgttttgttggcttttgtttcgtttgtgacatatcgaacataatactctagatatgatagtaattgtttgtttagcaacaaa

SEQ ID NO: 26 - DNA, 1740 bp, Arabidopsis thaliana
taactttgaggttgaaaaaacaaactcatgaatctcttctacttttcctcgagacaccagagacgaaaggtttccatcaaaacatcaaggagcatctcttcttaattcttatctgaaccaataactgaaagatttggtcaagaagaggaaatgggaagaacatgtttgccgagatggcgattaggaagactaatggcaggattacaagtcatcttaggattactggtgatcactgtgagcctctcatgtctctaccgattccattccgtgggttacttcttgcaaaacgaagacacttgcaacaatatctacacaatcaaagaagtcagcagcgaaggattcgacctaaaggcgctgcacgatcgtgttgatgaagtactagaaaagatggacaacttgtacgagaagctagagaagacggtaaaagatatggagaagagcaaagacggaagcaaaaaggagatgaagaagtttcttgaagatgaagtgatgaagccattttattatgctcatatcggattaaggcaaatccggttgccaaaacccgaaggaatcagaaactcaacggaaaaggaagagcctttgatcaataagtttctcattgaagagataaggcagtacattacaccaaaggagaatcgtgttgggaagataaacatgtttggaacagagagagtttacaacactattggtcatgcttgtgcgttgatgaagatggagctagagaagtatatggattatgacgttggagcgtattgcgatgatgattggaacttagcacagaagctgatgcttaacgggtgtgatccgttacctagaagacgatgcttgacaagagcatcaatgacttaccaaaaaccttatccgatcaatgagtcactgtggaagcttcctgatgatagaaatgtaagatggggaaattatcaatgcaggaacttcgcgtgcttatcaagcaagaacccgaaaaggggttacacgaaatgcagcggatgttttgaaatggagaaagagaaagataaatgggtcaagaacagtagtttgttagttgattttatgattgaagatgttctgagagtgaagccaagtgagatcaggattggattggattatggtgttgggacaggaacatttgcagcaagaatgagagagaagaatgtgactattgtcacaacagctttgaatttgggagctcctttcaatgagatgattgctttgagaggtttgatcccattgtacatatctttgaaccagaggctaccgttcttcgataatacaatggatatgattcacactaccgggttaatggatggttggatcgatcttcttctgatggatttcgtgttatatgattgggaccgagtgctgagaccgggagggttactgtggattgatagattcttctgtaaaaagaaggatcttgatgattacatgtacatgttcctgcagtttaggtacaagaaacacaagtgggctatttcacctaaatccaaggatgaggtttatctctctgcattgcttgagaaacctcctcgtgcaatttaaggattacaatatgaagtttaagcttcaatgtttgtaattgacattcttactcatttggttgtctaatccttgttctagtttgaatacaacagaggttttcagctctgtttcacttgataacttaatcgagactatttgtatcaattcgaaacattgaaagtggccaaaaaggcattttagcgattgctgaacgacatt

SEQ ID NO: 27 - DNA, 1810 bp, Arabidopsis thaliana
gctgataattatcctatagagattagcacaggcccatataagttgacaagtcatcagttacaattacgtttcttcttcacacagcccaattagcaaaaactcggttcaagctgaaatcgaaactcgaaccggactgtgatggtggtttccgatggcggcaaacgagtgaagctcaacgtcggcggcgagatcttcgaaaccaacgcgtcgaccattcaatcatcttgcccagactctctcctcgcagctctatcgacttcaacctcccatggatcgaatccggttttcatcgatcgtgacccggagattttcgccgtcattctcaatctcctccgtactggtcgactcccagctaattcctccggcgttttttccaagcaagagctactagatgaggctatgtattacggcgtcgaatcactcctcagattggcgatgttaccgccgccgctgctaggtttcgatgcgtctcttgtctccacaatcgtaccggctgctgatggagtcccgtctgctttaaccgctactgctggagacgcctctctgtggatcgctcacggtggtcagatctccgtctacgattggagtctttcccatgctggaaccgtccgtacacatctcaacgatatcacatcgatctgccgtgtctggggcgaagctgctgcaattggatctggatccgcgtcgggacttcatttctacgatctctctggaggtcgatacatcggatctacgcactggacggatccggaagatccgaggatccataaggcacgcgtcgccgccgttgctgattcggaaggtggagtattcgcatcctttgattgcctgcacagagagaacagtgttctccagatcgacaaatccactcttcaagtcgccgccgtgatcggtcagcaatctggaaactcggctaaaaccacagtaccggagaaactccggtggctgccagcgaaaggtcttttggtgggatcagccgttcaacgtggagtgtttggttgctctggctacatccggatttgggacccaaggtccaggaacatcgtatgggaaacgaacgagccaggatcgggacgaagcactaggtttggagacgccttagctgatatggacgtggacgttgaagactcgatccttttcaaggtatgttccaagtcaggagacctcggaatggcagacattcgtaaattaggtgaagatccatgggtatatatgtcagacgagaatcccggtgcctggaaagccggcgacggaggtggttacagcgtggtacattgttacagaaagcaagtgttggccgccagaggtggtgcattagaggtatggtcaagtgttaaggagaagacaagtggtgatccaattcgcaggagaaactttgtagacaaggaagatgattccaagagagggatgatttcgaaaattgaagcaggaggtgaccggctctttgtttctcgggaatgtatggaaggtgtggaggtctgggaaacttctagtttctccggtgtggtatccgtcgagtaatggtttcccgaagaacggtgatcgatcaccctctgttttcccgggaaaatcttgttaatttcgcaggaaagtaacaaatcttcaaactttccagggtctagtagaagactagtagtactgattgtctctacccaggtccacacttgaacagaatgaagaacatcatcaagattcacactttaccattatataaagtactagagaacactctcttatgttgtaaattgatccatagatattgtctttgtaaagttttggttctagtggataaataattatagtcacaagt

SEQ ID NO: 28 - DNA, 1645 bp, Arabidopsis thaliana
gtacgtctccgatgtttcaatcgtgaaatcgaaacaaacaaaataattaaaaaaagaaataagaggaggcgatggcgatcaaagacctgacggcgacgaccggtgattcatctcttcctttaataaaatctccgccgtctgaaacaaccggcggtgacagaacctctgctcttcaaacgctcggtaacattatcgtctccatcgtcggtacaggcgtccttggtcttccttacgcattccgcatcgccggttggttagccggatctctcggtgtcattatcgtcggattcgccacctattactgcatgctcctcctcattcagtgcagagataagctagaatcggaagaaggagaagaagaatcgaaaacttatggtgatttaggtttcaaatgtatgggaacaaaaggtcgatacttaaccgaattcctcattttcactgctcaatgtggtggatcagtagcgtatttagtgttcataggtcgaaacttgtcatccatatttagttcgtatgggttaagtatggtttctttcatattgattctggttccaatcgaagttggattgtcgtggatcacttctttatcagctctctcgcctttcagtatctttgctgatatatgcaacatcatagcaatgtgttttgttgtcaaagaaaatgtggaaatggtgattgaaggagacttctcgtttagtgatagaactgctatttcgtctaccattggtggtttaccttttgctggaggagttgcggtgttctgttttgagggttttgcaatgacgttggctttggagagttctatgagggaaagagaagctttccctaaattgttagctaaagtgcttgccgggattacgtttgtctatgtgttgttcgggttttgtggttatatggcttatggtgatcaaacaaaggatatcatcactcttaacctcccaaataattggtctgccattgctgttcagattgggttatgtgtgggattgacgtttacatttccgatcatggtacatccgcttaacgagatcatagagcagaaactgaagaggatagactggcttcaaaagcatcataatgggtacagcaacgaaacaggttcagtctcaaaatttgcaatctttacaacgaggacacttttggtggtaggacttgcagcaatcgcgagtttagtcccagggtttggtacatttgcatctcttgttggaagtactttgtgcgcactcatctcctttgtgttgccggcttcttatcacctcacgctgctcggtccatcactaaatgtatggaacaaatccatcgacgtattcattgtgatttgcgggttgatctttgctgtttatggtacgtacaacacaatcgtcggagtgtgaaaagggatagcatgtgatctgtgtaaagcaacgaatataactacaagaagtttggtaagacagacaagaaaaaatgtatagatcttttacatgaatctgaaatagaaagatggtgagaaagttgagattgttgtatgatcatttaatggtgtcaggatgcagagtcttaaacaattaacacaccgattttcttttttagtcttcctaattcaattttccagattttgtttttatttttctttaatttttaaacttaagtatgaaattggtaatcc

SEQ ID NO: 29 - DNA, 1962 bp, Arabidopsis thaliana
tgcttgcttggtaatataaagttttgaataatgagcgcggttagttttctttacagctcgaaaacccccaaatttcgaggggttttcaatgggatttgtgctctggttctgttttgcttcttctttgatcggagcgaattactcagaaaccctttgttaaggaacgcgtctttcgtcaatggtggtagtggctcaacctccggaggtatcacccagtttatggtaattcgtagaaatgcgaggcaaattgaaacgaatggttctggtaataatagcagcttgagtagcagtagtactgttttatgctcagggttacacaaacacatgggttatgctgatcaatgcgagttcttaaaagcaaacccaatttgttcccctgatggattctttgattacctcagcttcttttactgctcctgtagagatttcagtatcttgggttacatgatgttaggtgtttggcttgttgctttgttttatctgttgggtaatactgctgctgattacttttgttgttcactggagaagctttcaaagcttttgaggctgcctccaactgttgctggtgttactttacttcctcttgggaatggagcaccagatgtgtttgctagtatagctgcttttgttggtacagataaaggagaagttggtcttaacagcgtcttgggtggtgctgtgtttgttacttctgttgttgtagggattgtttcgctttgtgttgcggataaggaagtcaagatcgataagaattgcttcatcagagacttgagtttcttccttttctcgcttgtgtctttgctggtgattttgatggttggtagagtgacagtccggattgccatcgcgtttgtctcaatatatgtggtttatgctttccttgtggcagcgaatgtgattctgagaaaacatgctaagaggtttaaactagaggctcttactcctttgctacctatgcaaggaagtgtgttttccccgagtgttggagaggatatgccaatgaatacccccttgatagaaactgagactgaggatggtccacctcggctacagagtcttcctcagtggatgtgggcgtcaaatgtggccatctattcaaaccatttcgcaaaagttagtgtacatgatgaagacaggccaccttggggatggattgatgacactgcagaagtagagagctcctcatgtactaaattcacttccttgttggaaattccgctgaccattccaaggagattaacaattccatcggtcgaagaagatacatggtcaaagacatatgctgtggccagcgtctcattagcgcctgtccttttggcgtctctctggagtagccaagacgatgtgagtctccaagcttgtggtgtcgcatactttttcagcgttgttataggctccactcttggctttctggcttacaaaaacacagaacctgatcacccacctcgaagattcttgatcccttgggttcttggtgggtttataatgagcatcgtatggttctacatgatagcaaacgaactcgttgctcttctggtgacatttggtgagatttacggaatcaacccgtcgatacttgcgctaacagtacttgcttggggaaactcaatgggtgacttagtatcgaatatcgcattgacaatgaacggtggggatggtgtacaaatcgctctatcgggatgctacgccggtccaatgttcaacacactcgtcgggctaggtatgtcgatgctttttggcgcatggtccaagagtcctgacacatacatgctaccagaagacaaaagcctattctacacacttgggtttctagtactcggtttggtttgggctatggtgatactcccgcgcaacgacatgcaacctagcagaaccttaggtgttggactcattgcaatatatctgatattcgtcactttcaggctgagctgcgccatgggattcataccatgggctgcttaa

SEQ ID NO: 30 - DNA, 1059 bp, Arabidopsis thaliana
aaaggaaggaagagaagagtgtccatatcatagattaaaaatcattcgttaatcaaaccacaaaatctaacttccacacacaaaacacacatacacaagaaaataaaaataaaaatggaattagttgaagagaccattccaaaagaagggaaaaagatgggagaaagaattgtggtcgacaaagcttatctttaccaagaagacaaaccactcaccgtctgcaagacttctctcttctacaccggcgatggcttcgccgcctatgactgccgtggtgatatcatcttcagggttgattcttatggacctgacacaagagataacgatgagattgtcctcatggacgcgaccgggaagtgtctccttaccgttaaacgaaagagaccaactctacaccaaagatgggaaggttttctcggcgagagatcggaaggtcagaaaccgatattcagcgtccgtagatcgtcgataatcggacggtgtacgatggaagtagaagtttacgacggaacaggagaagagtacattatcgatggagacttctcgcaacgaagctgtctcatatacgacacgaagaaatgtactgtggctgagatcaaacgcaaagtagacgcgtcaacgaacgtgatgcttggtcgagatgtgttcactctagagattaaaccgggttttgatggcgctttcgcgatgggtttggtcgttgtgcttgaccagatcaacggtgatgatccagttgagattggtgatgaacaggtacacccttttgtagaggattagtgtcggtctctctctcacctctctcagcggtcttcacgttaacatatcgaatctaatctttagtttttcaatctttggatttggaccatatgggattatggagatctgtttgtatcattctgtgttaagtcatttaagttgctacgttacataatatttatagactatagtctgtctcgggaaattcgttgactatacgtttgatgttacaaaattatttgtgcgttctaaatttatcgatacatgttagaaattttttaaaattatgacgatccaaaatct

SEQ ID NO: 31 - DNA, 2084 bp, Arabidopsis thaliana
gctgcatcttcttcttcatccatcgatttctctcaattagggttctgatttttcttcccattgttgttctccttctccgtttcgtctcaattacagaacaaagcttcgtttctccagtaatcgaaggttaaaaagtttcacaaaaaattggatttagagttgaattagcgtgtttaagaaagaatggaaggtacagatgatgcttctgcacttcaagagcctcctgaccccgaagtgctcgaagttgatccaacttttcgatatatacggtataaagaggtcattggaaaaggggcattcaagactgtttataaggcatttgatgaagtagatggaattgaagtcgcatggaaccaagtacggatagatgatgttttgcagtcaccgaattgcctggagaggctctattctgaagtgcgtctgttgaaatcattgaagcacaataatattattaggttctataattcatggatcgatgataagaacaagactgttaacataataactgagctattcacttcagggagcctccggcactaccgcaagaaacacaggaaggtgaacatgaaggccgtcaagaattgggcgaggcagattttaatgggtttgagatatcttcacggtcaagagccaccaattatacatcgggatctcaaatgcgacaacatttttatcaatggaaaccatggagaagtgaaaataggagatcttggtctagccactgtcatggagcaagctaatgccaaaagtgtgattggaaccccggagtttatggcacccgagctttacgacgagaactacaacgaattggctgatatttattcatttgggatgtgtatgttggagatggtgacatttgattatccctactgtgaatgcaaaaactctgctcagatatacaagaaggtttcatcgggaataaaacctgcttcactctccagggttaaagacccagaagtaaaacagtttattgagaaatgcttacttcctgcatccgaaaggctgtcagcaaaagagcttttattggacccttttctgcaactaaatggtttaacaatgaacaatcctttgccgcttcctgacattgtaatgcccaaagaaggcgcatttggagaccgttgccttatgtctgaaggtcctcctacaacacggcctagtaaaaccttgtcgatagatcttgatgaagacagtaacctgcctattgttacttttagcgacaattcaggatccaggtgtattgaggttagacgcgcaaagagagggaatttctttgtcctcaagggtgaagaaaacgatgagcagtctgtgtccttaattcttcgtatagtagatgagaatgggcgtgtgaggaacattcatttcctgttctatcaagaaggggacactgcttctaaggtgtcgagtgagatggttgagcaactcgagttaactgaccagaacgtcacgtttatagccgagctgattgatatactacttgtcaacatgatacccacctggaaaaccgatgtcacagtcgatcatctcatccattcgcaactgaatcagaactcaagaagtcatcataacgaagcaaagccacagaaacaagaggagactgtttttcatgatacttgtgagttggttagtcactcgtgtaactcagattgcccacgatcagatgaggaagataagcaatgcgtcgatgccaccaaaggagaagacaagagctccattcaagaagtagaagaagcaaccgaaccagtaagtttggaggaagaagaaaggttaagacaagagctggaggagatagaagctaagtatcaggaagatatgaaagagatagcaacgaaaagagaagaggccattatggagacgaagaaaaagttgtctctgatgaagttaaagtaatagccaaaaaagctcaaagaaaacgttgatactgatgaagagcttttgtgtttttaatctcttttgtttaatttgttggttggaggagaagtgtagaaagatgaagggtttctatttgattaattgagatttaatttggttggttgttacaagttagaacataaaaaatggttcctgttaaaatgttctaagagatt

SEQ ID NO: 32 - DNA, 1700 bp, Arabidopsis thaliana
agcttgtctctatctgccccacaaacacctctctttgttggactctctttttctttcttcttcccttagtctattttaactcagaaacctctgtttttttttgttagagagaaaggtaagaaatgggtgttgatttgaggcaagtagttgctggtattctcaccattaccatgtttgtgatgcttggacagatgcttcatagagattactttgattctcttcaggagaaagctcagggagatgcacaagatattgaatttgaaggatctaaagtctctgtgaaagatggtcttgtcggaaccgttgaaggcagtaaaggactttggatggaagataacactgatcttactccttgttggccaacattactatctgatgacgctgtatcatcgaaagggtatgttacattctcacttaccaatggtcctgagtaccatatctctcagatcactgatgctgtaatggtggctaagcatcttggagcaactctagtacttcctgatataagaggaagcaaacctggtgatgaaaggaattttgaagatatctatgatgcggataagctgattaaaagcttggaaaatgtcgttaaagttgtgaaaaaattgcctgaagaagtttctctaaggaacatggccattgtgaaggtccctaccagagttacagaagattacattaaagagcacattgatcccatctttaaatctaaaggaaacattcgagttgcatcatacttcccttctgtaaacttgagaaaatcctcacaagatggcgaaactgatcctgtagcctgtttagcaatgtttgggtctttggagttgcaacctgaagtgaatgcagtggctgaatcaatggttgagcggttgaggactcatagccgtaaatccggtggccgtttcatagcagtagaccttagaatcgacatacttgagaagaaaaattgccatacaactggtgtagtagggtccaagacatgttacaacgctcaagagattgctttattcttgagaaagcttggatttgccagcgacacaactatctatctgactcagccaagatgggacagtagcctcaatatccttaaggatatcttcccaaaaacattcactaaggaggcaataatgccggcaagtaagagatcaaagtaccttgaatcagtgagttccgagtacgaaaatgttatcgacttctacataagctcaagaagcgatgtctttgttccagccatctccggtctgttttatgcaaacaccgttggcaaaaggatagctttaggtaagcctcaagtgttagttccagcagaaatctcagagacatctggccttgctacagatttcatctctccatacatctcaaagaagaaccatttggcttattcatgcttttgctgaccttctcgcatttctaaagtaatctccacgcatacttccatggaagggccttctcagttttcatcaagtgtaagcaatttaattatttttcttgtttttaatttgtaagtttgtttcaatataagttggtttttttgggcagtgaggtttacagtttgaatctgttggctcatagcttttgcattctataaattttgctctatagtaagaaacacatatattgtttgtaagattgattttagtgttgagggtttctattgaaggaagaaccatgtgaactatgacaagatgtgatcattcttttctcta

SEQ ID NO: 33 - DNA, 766 bp, Arabidopsis thaliana
attagttctgtttcttttttgtaaagaaaagattttgcgcaattcatcatcaatcaaataaaaacctcagcttttggatttctctactaacacaaaaactctcatttctctgtttctgattgcgaattcgatctcaaaattcgatttttgaaagatctcgttcaatttcaccattcacggaacctaacggaggaagaggtcgatcatgaagtttcgttcttcctctggtcaaattcgatttgtgttttaaaaactgaagtaaacattaaacaatgtcgaaaccggtcctgctcgtgtgtctactagttatacttatagttacctctcagtttgaatggaggcaaccacttgttgagttagatacagccactagctcgtctcagaaacagcagcaaatttcagatagggaagaagctgtcaaagagaagatcattatatcacaagagagacatatccagaggctaaatgagctagtcaggagtcttcaattgcagttgctgcaatgcaagggagagaatgagacccaaaatgccaccaaaagctatcatataaataaacaattcatcgaggtcgaaaggaaacaaatcctggaaggctaaactctgcagcgacaaaacattattttaataactgttttggtaatgtacaagttgtgaaagaaatcactcttttaacttttgtgttgagatgttgtattgtacaagaacaagacgtcggtttttttttatgtcgttcgctaaatcaatgtccaatgttaaatgctcaa

SEQ ID NO: 34 - DNA, 1221 bp, Arabidopsis thaliana
agacataaaagtctgtggcgaccaaaagaagtgagagagaaagagagagatatgatattattaagtagtagtataagcctctcaagaccagtttcttctcaaagcttctctccacctgctgccacttcaacaaggagatctcattcctctgtcacagtcaagtgctgctgttcttccagaaggttgttgaaaaatcctgagttaaaatgttccttggagaatctctttgaaatccaggctttgaggaagtgttttgtttcagggtttgcagctattttgcttctctctcaggcaggccagggtatagcgttggatctctcatctggttatcagaacatttgccaactagggagtgctgctgctgtgggagaaaacaagctgactcttccatctgatggtgactcggaatcaatgatgatgatgatgatgagaggcatgactgctaagaactttgaccctgttaggtactctggaagatggtttgaagtagcttctcttaagcgtggatttgcaggtcaaggccaagaagactgtcattgcactcagggagtatacacgtttgatatgaaggaatcagccattagagtagatacattttgtgttcatggcagccctgatggatatataacaggaatcagagggaaagttcaatgcgtgggagcggaagacctcgagaaaagcgagactgacttagaaaagcaagagatgattaaagagaagtgtttcctacgatttcccaccattccttttatccccaagttgccttatgatgtcatagccacagactacgacaactacgcacttgtttctggagccaaagacaagggctttgttcaggtatactcaaggacgccaaatccaggacctgagttcatcgcaaagtacaagaactacttggcacaatttggctatgacccggaaaaaataaaggatacaccacaggactgtgaagtgactgatgctgagctagcagccatgatgtccatgccaggtatggagcaaacactgaccaaccagtttccagatcttggattaagaaagtcagtccagtttgatcccttcacaagtgtgtttgaaaccttgaagaaacttgtaccgctctatttcaaatagagcaagcttctttgctcaaattcttatgtagactataatcactgtccatatatacatatcttccagaatcaaaacactcttctgatcataacaccattgattagagaa

SEQ ID NO: 35 - DNA, 1694 bp, Arabidopsis thaliana
gtgttccttctattctaatcatccccttgaattttccaagttttctccttttgtcttctctaactattttcccttaaaataaaaatccaatttttctttgtttcagtcctctcttctgctcattgatcttttaattaactttgattctctccgtttatggattaaccatttgatcgagataactctccaagaaatcgactgagttcgtaacttgttgttgtctgatcttttaaagattcaaccttttttggtccgatcatggctgttgctgagaatgctggtgtcaaagtggactcttctggtcagaatttagacaacaacaacactgctgcttcagctaccgagacgacaaagccgccatgtcctgatgatgatcaaagccctaaatctgactcatccactcctcttaccatcgattcgactcctgaaactgacgatcggatcaatgagactgctcaaaaggttcagactttaaatgggtttagtggaaatggtgagagagataacaatggagagatcaaagatttggctgatgcgttttctaagcttaatccgatggctcaggagtttgttcctccttctcttgctcgaagtcaatctggggttttgagaaatggattagggtttactaacaattttgcagccccacctaaacttgctgatgggaatgatcattttcctagaaggagaaggagttttggccaagggaagcgaagaatgaacaaaaggacaagcttggctcagaaggatgatgtaatcaggagaactgtatatgtctctgacatcgaccaacaggttacagaggagaacctcgcaggtgtctttattaactgtggacaggttgttgattgtcgtgtatgcggtgatccaaattctgtccttcgtttcgctttcattgaatttaccaatgaagagggagctagagctgctttgagcatgtcgggtactgtgctaggtttttaccctcttaaggttcttccttccaaaacagctattgctcctgttaacccgacttttcttccacgatctgaggatgagcgtgagatgtgcgttaggactgtttactgtaccaacattgacaagcggatcactcaaattgacttgaaaggcttctttgaaatgctttgcggggaggttcatcgtctgaggcttggagactatcaccaccaaacccgtattgcttttgttgagtttgcgatggcggaaagcgcaattgctgcgcttcactgcagcggtattgtcttgggggcactcccaataagggtaagtccatcgaagacaccagtaaggccgcattttccccgcgctgagttcaagtgaaactctagccggagatcttaaaattatatagcaaacgagagagagagagagaaagcagaagaagaagtctaaagaagaaggtacttgaggcgttttgtgtttatatataaaactctttctagatttattttaagttaatgcttcgcggtcgcagagcctgcccggtatctttgaacaactcaacaactttggtctaaacctttctcctttctttagtctccaaacacacaaaaatttgattatttttgttgttgttgaaataccctttggatatttttatgacttatttaagacatttggagaaattttatatctctaggaaaaaaaaaggatttcactgttcttatttcttaatttcagttagctcttttctg

SEQ ID NO: 36 - DNA, 3095 bp, Arabidopsis thaliana
caacaacactttttccttcaccagtctcttcctcgttttggtgagaaaacgatgaccgatggatttcgctataatggtttctctggaatagcgtacccgttttggctctcatctccaccaccgcctacacctccacatcatccagcttctgcgccgccgtttcaacaaagcaatccggttgaatcctatgatccagccaaagaagtgtttgatccgatgatgttgtatcatgactcttatcaacgatcgccggctaattggtcaaataacccatcgtatcgtgaaaattctcgctctcagactccttcttcatcgttttatgctgacaacactcaacatggaaatagtggtcttcgaggtgaagattcttcttataaagatatgttatcaccgagtggattttactcttcaagggaatcatcatctgattttgtgtcacttcctcccactgagaatttctcagagaggcaacgtttgaactttgagcctacctacagctcagctaccttagctcctgtgtcttcttatgcagatatgctaatcagaaattctcaggactcattctttactcctatcgcgtcatctggtgtttactcttctagcaatgctgttgatgagaaacgtcctggatattactttcttggctcagatagatctgaaactatgaatgttgtctctgcttctcgtgtggagccttacatgtgtgatacagattgtaatccttcttttccaatgccgaattttataacacaagctctctttgatggaagtcagactgggcttcgtgtaggagatgggagatcattcccgagcaacagtgatgtttgtagtcatgcgcctcagaattttttaggagctcaatccagcttgcagagttcctctgttgaaccagttaacttcgatgtgttactgggatatggtgaagctactggtcatatcaagcctttgcccgagaatccaaatcttccctatccggtagttggctcgcaaggttcgagaagtccgcgatcttcctaccccttaccatctattattaattcctctgtgtcactgattaaagatgaagtagaaggtagtggtgtctcctccctttatcagaggccttatactttggttgctgacagtgagaatggtgtttctgagagctccttaaagaatgcaactgaggatttaaattgtcacgagcctcgatcttggagccacttcatggtaacctctgagggaccttcagctcccacgatgttttctatgggaagtgagtcaggtggaccttcagctcctacgatgaaagcggataatgagaatgctcagtcagctggcaactacaaaccccctttcgaaggtagtactactcaacctagtgaagatgttccaaccaaccaagagtcttgtaatctccagaaacaaacatttgatataatggatagagataagaagatcagatcgttgacagatgtggggctcgatttgagtagtagatcaaatgcagatgatgtctcaactggccgatcacctgaaaggcacttctgtgatcaaggagatttcccatctccaacttcttatccaagagtttcttctgttgttaacgccatgcataatttgtcagaagtgcttgtttatgaatgctttaacaatggaagctggctgaagctggagcaacttgagaaccttgataaagtagtagataatctcacaaagtgtttgaagaaaattactgataataagacaacagcaggggaagcaacacttccaacgcaatctatgcatgtcacctgtccaaacgtggttgaccttcatgaggccgcaacgggagttgctaaagactttcaaaggtttagtgtcaagccactagacagctttggtgtcaaagaaccggtggataagaatgaaatgacccagagtattaagaacatacttgcttccaactttcctgatggtgaagaaaaccacccacaaactctcttgtacaagaatctctggctcgaaactgaagctgccttatgttccacaacttgcatggctcggtatcatcggatcaagaacgagattggtaatctcaaattgaacaataaagagatctctgcggatgcagtaagctttatgcaggaaccttctcttaacacacagaaatcggttcccatcatgaatgcaaatgcagacaaggatacacctgaatctatcatcaaacatggaagcaattgtgggaaaaatgcagcaacaatgagtcatgatgcatccgaaagctctagaatcaactcagatcctgtggatgcagtattatcggttatgtccagaagctttactggtggtttagagcagaccattcgtggaaacttaaggcctgatgatgcaacctttgcaaagataccggatgcgatatggcaggaaacctctgcatccactacagagaacaaacatagagaggttatagaccggtttcagatattgaaggagcaggaaacagagcgcaagctcaagtctcagaagctccctgattcagacattgatgttatagaccggtttcagattctcaagcagcaggaaacaaatcgcaaactcaaggctcaaaaatgtccagaaacaaaaaagggtgaccaggaggacaaactagaaggttcagtgatggctaatatgggcagaagcagcgatgtgagtgatgttatggatagattccagatactgaaacgccgggaagctgaacaagtgaagaaatctctcaacagcatggatgtagattcggattcagaaaatgaccagccacaaaagcgtgatcatctctggtcagattcgttattcccaatacgtggacattctcagagagaaacatgcgccgcggacactgaacaatctgcatctggcaaaggatacgagagcccgacctcggactgggaacatgtcatcaaggatgattgagtagtgaaatttccttggacaagaagtttcgatcctataatgaaatcttgttattataaataaaaggtatttgtagaataacatgaacggccattatgaaaacgtttgttatgtatgataaaaggataaaactgcttggatgctgattttcataatatgatagttttaagttactgattttc

SEQ ID NO: 37 - DNA, 2278 bp, Arabidopsis thaliana
tcattcctcacttccaaccgccaaagaaaaaaatcaaaaactccaacaaaaaaaacctcccaaaccctacccgagcagtcgccagatgggcacggaggactacacattccctcaaggagcggaggagcttcaccgccgccaccacacggtggaggctccacaacctcaaccgttcttgaagtcacttcagtactcagtgaaggaaactctgtttccagacgacccttttagacaatttaagaaccaaaatgcatcaagaaaatttgtgttaggcctcaaatacttcctcccgattttcgaatgggcaccacgctacaatctcaagttcttcaaatcagatctcatcgccggaatcaccatcgctagtctcgccatccctcagggcatcagttacgccaaacttgctaacttgcccccaattcttggcctttattcgagttttgtaccgccattggtatacgcggtgctagggagttcaagggacttagcggtgggaacggttgcggttgcgtctctgttgacaggtgcgatgctgagcaaagaagttgatgctgagaaagatcctaagctttaccttcaccttgctttcaccgccacttttttcgccggcgttctcgaagcctctcttggaattttcaggttagggttcatagtggactttctatcgcatgcaacgatagtaggattcatgggaggagcagcgacggtggtgagtctgcaacagcttaagggtattttcggacttaaacatttcacagactctaccgatgttatctctgtcatgcgttccgttttctcccaaactcacgagtggagatgggaaagtggcgttcttggatgtggttttctattctttcttctctccaccagatatttcagcatcaagaaaccaaaattcttttgggtggcggcgatggctcctttgacctcagtgattcttggaagtctcttggtttacttcactcacgctgagagacatggtgttcaagtgataggggacctgaagaaagggttgaatccactctccggttctgatctcatctttacttccccttacatgtccacagctgtcaaaactggcctcatcactggcatcattgctctcgctgaaggagtagcagtggggaggagttttgcgatgttcaagaactacaacatagacgggaacaaagagatgatagcgtttggaatgatgaacatcgttggttccttcacatcttgttacctcacaaccggaccattttcaaggtcggcagtgaactacaacgcgggttgcaagaccgcaatgtccaacatagtgatggcgattgcggttatgttcacactcctcttcctcacaccgctttttcactacacaccactcgtcgtcctctctgccatcatcatatccgcaatgctcggactcattgactatcaagctgccatccatctctggaaagttgacaagttcgacttcctcgtctgcatgagcgcctacgttggggtcgtattcggcagtgtagagattggactcgtcgtagcggtggcgatatctatagcgaggttgttgctgtttgtgtcgaggccaaaaactgcggtgaagggaaacataccaaacagcatgatctataggaacactgagcagtacccatcatcaagaaccgttcctggtattctcatcttggagattgatgctcccatctactttgctaatgccagttacttgcgtgaaagaatcataaggtggattgatgaagaggaagagagagttaaacaatcaggagagagcagcttacaatatattatactcgatatgtcagctgttggtaatatcgacacaagcggtattagcatgatggtggaaattaagaaagtcattgacaggagagcgttaaagttggtattgtcaaatccaaaaggagaggtcgtgaagaaattaaccagatccaaattcatcggtgatcatttgggcaaagagtggatgttcttaacggtaggagaagcagtggaggcttgtagctacatgcttcacacgtttaaaaccgaaccggcctccaaaaacgagccttggaacaacgtatagttcctttattttttgctgtcgttctgtgactactcgttattaactaatccgatgtaaacttaaattaaaaactgaaactcattttgtaatattgatgatgagccatatgcaatatatatgcactcttattgtagtgttatggaagaaattggcggttcggaattagaccaaataccggttaatgaacaatgaagcaaatttggtttccttcggttt

SEQ ID NO: 38 - DNA, 2049 bp, Arabidopsis thaliana
acttttcgtccagaagttgctttgcataaaaaattataattctccttttcaagtctatgaaccctcaccgtttgtttgaagctgtagggtgattttaatgggctctgcttttacactcaacacaagtaagttttataattctgctttagaccttgtgttcctataagatctgataattgttttgtggttcttgttttttctttcctcgagaaccgaagcttatgattccgattgtgtgaaggattagaccttgatgataccggtttggagtttagagaaccctgtattttgtatcttgacttcagcttctgaaatcttcttgttggatgtgttgtttagatttatagaggctgatctgtctcaaagaaaccatggatgattgttccaaagatataatcaattgtttaccagacaatcttctttgccaaatcttgtccaacttgtccacgaaagaagctgctttgacatcacttctctcaaaaagatggcggtatttgtttgctcttgtaccaaatcttgattttgatgtccttccctctctgcatcccgaggttgcgatgcaggaccaggatcagacgagttttatagattttgtggatagagtattgaaattgcgagggaaagatcatattaacaagttctctctgaaatgtggagatggtattgaggatgaagatgtcttcccttggatattaaataccttgagacatggtgtatcagatctttctctacatgtctctccctctttggtttattggttgccttcaaaggtttttgcaagtaagacactggttaggctgaaaataggacctaaagatggtcctagagttaaactgagaaatgtctgtctaccaaagcttaagactctaaatcttgattcagttgtgtttgaagagggtaagattggttttgcaaagcttctttctggttgtcccgtgctcgaggaattatctttgcttaatcttgcgtgggatcgttgggattcttgctctgtgtcttccaaaatcctcaagagactaacgctatattgtgcacacagtagcagaaatccaaagagtgtatcatttgatactccaaatgttgtctactttgaatattctgataatattgcaaacaagtatccgaaagtgaattttgattcgctggttgaagctagtatcggtattcggatgacgaaggttcagaaagcaaatgcgagatatgtgtcagatgttgatgaggaaacagagatggttggcaatgcaacggatcttcttatgggaatatgcaatgtgaagaccctttacttatcttatgacactcttgagacacttaatctttgctgtcaagtgataccggtattcaacaatttgactcatctaactattgagagtcatccggaactaggatgggaatcattgccaaatcttctcaagagttgtccaaatcttggaactcttgtcttccaaggactccttcacaaagcaacagatagatgtggggatgtgtgcatgtgccaaggtttggagaatagtcattcttgcttatcatcaagtccggtgaagtgtctaaagatattgaaatttggagaaaccaatgatgatgacgatatggagatagagatggagcagatcaagaattttttggagaaaatgcctaatcttgaacaactcataatatactacgaatcatcaatcgataatgatttagttagagtatcaagccaacttcaggaggttcctacagtagcttcactcaagtgcaagattcaagtaatctctgataaccttagcttgtcatccactttgcccatttccttgtcgatggaaaatggatttcacctgtagaagaaccttactggtttcgtggaattagtaatgcggtcatgcctcgattaccacttggaagctatatatggatgtgctcatggctacaagtatttgtagttactaaaattatcttaaaaactcaaatcaagattctcttgtttctgttgtttgtactttgttactaattgaaaaactctttatgctttggaagctatatttggatgtgtctcctggctacaag

SEQ ID NO: 39 - DNA, 2771 bp, Arabidopsis thaliana
actcttcgtcactttcttgtcatccaaacaatacacagtcccctttttctccattattacttctcaaaaaaaatcatgtaaatttgttccatgaatcattcccaatcttcttcaacgagattcattgttattacgagctccttaatatttggttttttgcttttagctcttattgtctggatttttgtgcatttttcttctatcccctaaacttgtagtattgagaatgttctctaatatgggtttcaagtagtctccttttcgtgtctccctcatatcgggtttaaactcatcttctaactcttcttcgcgagtgtctaaccaaagaagctctccaagtgttcgacgatttgtctgatagaaaacgaaaaacagagtaacttaaaaacagagtaatttacagagagaagccaccatggaagagacttttgttccgtttgaaggtatcaagaatgatcttaaaggaaggttaatgtgctacaaacaagattggaccggaggaatcaaagctgggtttaggattctggctcctaccacatacatattcttcgcgtctgcgattcctgttatttcattcggcgaacagttggaacgaagcactgatggagttcttaccgctgttcagacactggcctctacagccatttgtggaatcattcactcgatcatcggaggccagcctctgcttatactcggagttgcagagccaactgttattatgtacacattcatgtttaactttgctaaagggagacctgaactgggacgcaatttattcttggcttggtctggatgggtttgtgtctggacttcgttgatactgtttgtgttggctatatgtggagcttgttcatttatcaacagattcaccagagtagctggagaattgtttggccttcttatagctatgctcttcatgcaacaagccatcaaaggattagtcgatgaatttcgcgctcctgcgagagaggatctgaaacttgtggagtttttaccttcctggagatttgcaaatgggatgtttgctttggttctttcctttggtcttctgataactgcacttagaagcagaaaagcaagatcatggagatatggaacaggctggcttagaagtttagtagctgactatggtgtgccactcatggttctggtgtggaccggtgtctcctacatcccaacaggagatgttccaaaaggaattcctcggcgactttttagcccaaatccttggtcccctggtgcttatgagaattggactgttgtaaaggagatgcttcaagttccaattgtctacataattggagcattcattccagcaacaatgattgcagttctttactacttcgatcatagtgtagcatcacagcttgcgcagcagaaagaattcaatttgagaaaaccatcttcttaccactatgatctgcttcttcttggatttctgaccttaatgtgtggtctacttggaattcctccatcaaatggagtcatccctcaatcaccaatgcatactaagagcttagcaacactaaaatatcagctgcttcggaacagactagttgcaactgctcgcaaaagcatcaagcagaatgcgagtctaggacagttgtatggaaacatgcaagatgtttataatcaaatgcagactccattagtctaccaacagcctcagggtctgaaagagctaagagaatcaacaatccaagcaacaacattcacaggaaatctcgatgctccagttgatgagactctgtttgatatcgagaaagagattgatgatttattgccaattgaagtcaaagaacagagagtaagcaacttgcttcaagcagtaatggttggagggtgtgttgcagctatgcctctccttaaaatgatccctacatcagtcctttggggctactttgccttcatggcaatcgaaagcttacccggaaaccaattctgggaaagaatcttacttctcttcacagctcctagtcgtcgattcaaggtccttgaagataaccacgcgacattcgtggaaaccgttccattcaaaacgatcgcaatgttcacaattttccaaacaacttatctcttaacttgctttggtctcacgtggataccaatcgctggagttatgttccctctactgatcatgtttctgatacccgtaaggcaatatatcctcccaagattcttcaaaagtgctcatcttcaggacttagacgcagcagagtacgaagaagcacccgctttaccgttccatctcgcagtaccggaagctgagatgggatcaactgcttcgtatccatgtgattctgagattcttgatgagtttattacaagaagcagaggagagtttagacacacatgtagtcctaaagttactagttcgacttcaacaccggtttataatcggaatctctctcaagtgtttagtcctagagtgattgatttaagaggtgagatgagtccaaggctctccgggaaaggccaaaatagtccaaagccgagtcctttaaacccatcatcatcgtcgaaatgagtttaccgatgatggaggcttgataaaaccggaggagattatgtttaaaattagttaattaattgatgttgtatcttatgcattcttgagttttttttttctttttacctatgtttaaaattatgtttgcatttctgttcttgatttagaatcattgtaaaatctctctaaataccatgtcaaatgtcggtaaaacattatactatgtaataataaagccatgaaacatcagcttataatatag

SEQ ID NO: 40 - DNA, 1778 bp, Arabidopsis thaliana
gctttatgtcgccttctcctcgtcactatatgtgagttcgccgacgccgtgaattcttggttttccgatttaccattcgtctccgacaacgcatcatttctctccttctcctctgttgaaattttcgtggatcgcttgtttctcagttatattcaatctggtgaaaaaaaaacaaaaagcttcaagctcagagacgaagatcctctgtttctgaggacttgcttatcagattcttgtttcctaaaccaaccgatttgaaccaaacggtctattccggttattgcctcttgaagtcaatcacagaatgtcatgttagctttaggttatgccaaggaaatcgctcaaagatttctcagaaatccaaaatggacctctagattcttcttgcttcactatcaatcctctaattactccagttatgtaaagtcaagaccttttctacaagttcaatgtaaatcagcttcttttgatgtttcacaagctcagagatggaatctatttgcgtatgatggtttgtttagtagacgttacttgagtaattccacaatagagctaagaacagatgataatgtggttaggtttgctttcaacaatgtctctagtagtggtaacaatgttgtacctacaagaaaagagaagaaatggaaacgggctaaattgtcaagaaaagctaaagtgaatgagttaaggttttatcgtctgaaggctaaaaagaagatgaattctccaaaccctgaagttagaattcgttacaagcttgaaaaggctaagaggaaagaagaatggttgattgagaaactgaggaaatacgatgttccgaaatcaccagcggagccttatgatccagagagtttgacagaggaagagcagcattacttaaaacgtacaggtgagaagagaaagaactttgtacttgtcggaagacgaggagtgtttggaggtgtggttttgaatttgcaccttcattggaaaaagcatgagactgttaaagttatttgcaagccctgcaacaaacccgggcaggttcatgagtatgcagaagagcttgctcggttaagtaagggcattgtgattgatgtcaaacctaacaacaccattgtgttgtaccgtgggaaaaactatgtgagaccagaagtgatgtctcctgttgatactctctctaaagataaggctttggagaaatatcggtatgagcaatcgcttgaacatacgagtgagttcatagagaagctggagaaggagcttgaggagtaccataagtacgttgctcggcacaagaagaagaaagatgaagaagcagagaagaagaaagaggcggtttcgaagagcaaagtagtgtaaggtctctcgtttcagagtttttgtagcatcaagattccaattctcaaaaggattctgaaagcaacggtgaacattgcattatgtctaagtaaatgggttcagtttggctaaaccaagttataccaaccggttagagaattagaatagagaagtctatatacaacttttactagtttagtcgtttgtcaataaatatcaccattcagtatttgtagtggagaaccaccaatgtatggtcttatggtctctttaaattggtagagaatttggacatctgtagattggttttatatatgtgaaaattgagttctcacatatatagacaaatcttcactgttttaactcttttttgtagattagtatgcaatagtttctctaattaaatgtttaagacaaaaaaaatctaacattattatgcaatagtttttctaattaaa

SEQ ID NO: 41 - DNA, 1123 bp, Arabidopsis thaliana
ttttgaaatcataaaccaataacaccccatgaataaaaacataattagaaacttacgcatgcatcagcttccgtaaatctcctacatctctctctctcctctctgctttttaccttctagggtttttgatcatctctcaggtgaatacgttttggtataatctcataccaatgtctgcgaattccaagtcggagaggtctgcttctcaatcggcggagacggtggctgtttctaaccgtgtcgtggcgtcacggtcaagtcgtcagccgcgtctctctttctcctcctttgctccctcatcagagcacgataacctgaagaagctgaaatccgatgagatttctcccgcgagagaggaagtgccggtgtcggtgaaggagagagaagaaacggaggaggaggaagcgaagaggacgtggaatcttcgtccgaggaaggcttatggtggttcgaagaaaggaaacggcgtgttcacggcggaggtttgcggtggcggcggaggaggaggttcggaggtgaagaatcagaaatcaggcgcaggaattgagccgaaatcgaacaggcagagaggaatcccggcggaatcacccggattaggcggtggtgaggttgcaaacgagaatcataggctttgggttgctctagctcgagacgagatcgaagaagatttgttcagcatgagtgggaacaggtcatctcgccggccaaggaagagggcaaaagctatgcagaaacatctcgatgtcattttccctggattgggtctcgttgggatgaatgctgattgcttcagagtagccacttctccggctaagtgatgatcgatgcaaaggagtcttttggtgaaggaaaaagataggtatgctggtgatcgagaatccagatacatcacagtagaagctaggaagaagatatctcaagagacatgttcttgtctcatatcaaacttagtagtaactaaactataagtaaatatcggtaaggtcatataattatagatatatataaagagagagagcgagaggggtttgtttttgagttagtaattaagatgcgtctaagtttaatggcagaggaaaacaacataatctatgtttaaaaagggttttttgaaaccatttat

SEQ ID NO: 42 - DNA, 1645 bp, Arabidopsis thaliana
gtatctctctatacctatacattttatgatttgattggttttgtggggatcaatttcactattactcgtaagaaatttctttatggatatgttttggtgaatctctctctgcttctcacaatctccctctttactttttttctttcatcatataaagggttggtgaaatatgaatggaatccaatttcgttgggaggttgttgtatattataagtttttagtgtctaatctttttgaactatttgttgaaattaaggtgtaaagttgttccattcatcaaaaagctatggatttcaatagaaaagctcatccagattgcgtatatgcggataatcctttccatgaatgtgcttcagcttgtttagagaaaattgctcaaggccatgtcaagaagaacactaagaagcaaagttcaaggcttcttagcttctcagggagtttcggtaggaaaaagaaggagtcgaattcacaaccgcctacaccgctatccgcaaggccttatcaaaacggcagaggcggttttgcaaatggtaattccccaaaggttcatcattctgtagctccacctgcttccgtgaagaagaagattgtttctgaaacgaaaaattctttcacttcttcatcatccggtgatccggatgatttcttcaaccataaaccagagaagaaaccttctcaaaccattcccctttcatcaaacaatttggttgatcaaagcaaagtggtatcacctaaaccgggaatacaagaacacaatgggaagattggagaaggcggcgaaactagactctttagtttcctaagccttccaagatcgcctggaaaagagagcaatgatgatttttctgatgatgatgacgaaaacaacaatgagattggtgtagagctcgatctcgaatcagtaatgtctgacacttttgtctctgtcgggaaataccgagtcagatcgggttcatccactatactaagtgctgtcatcgaaaagcacggagacattgctcaaaactgtaagctggaatcggattcaatgcgatcacgttacctcgagtgtttatgctcactgatgcaggaacttaggtcaaccccggtagggcagttgagcaaagtcaaggtcaaagagatgcttgcggttctcaaagacttggagtctgtgaacattgaagtagcttggctacgttctgttcttgaagagtttgcgcagtctcaagaagatgtagaaaatgagaaagagaggcatgatggtttagtgaaggctaagagagaagagcttgaggctcaagaaacggatttggttaggatggagaaggaagtggtggaagtgaagcggcggattgaggagacgcgggctcagatggttgagatcgaagcagaacggttgaggatggagaaaatgggattcaaaatggagaaatttaaagggaaatcgtttatagatgagcttctgtgagtttgagttgtgtgtgatgttgttagtagtaagccaagggtagtaggtaatagcacaaaatcaaaaatgctctaataaatgagtttttaaggttagggtttttaagtattatgggaaagctggtatttattggtaacttataaaaaatattaagatatttggttgttgctaataaatacgttttgatttgtgtgatgc

SEQ ID NO: 43 - DNA, 1335 bp, Arabidopsis thaliana
gagacagagagagagagagagaaagatgggttgtgtttcttcgaaactaggcaagaagaaactcataagagagattagagtcaacaatggcggcgatcacattgtctctcttacttcaactacttatggtcatctcgatctcgatgaacgagcagagacctctcctaagtcactggaagttactaaaggcgaagtctttgaatctgaaatcataccgagaagatctattaagagagatgatccggagattatcaatacttgggagcttatggaagatcttgaagattcaatgcacgtttctaatccacagaagattagtcccaaatctcgtggtattttcggtaaatcatggaagactccggtgaaatcggttgttgaatctccgaagagaggaagtagtaagagatttggagggaaagagaataattcgagaggtgtgagtccgaatcagattctgaagccgaagaacattcttgaaacaccgaagagaggtgtaatgcgtttgagttttcctcttaaatctgaagaatcttcggtgacggttacgcagaggaggaagagttatagtccaatgtttgatccagatcttgtggcttcttacgaaagagagttgtctcaagagaaagaacagatcaagatggtgatttctccggtggtgcacgagagcagaaaaacagagaaaacagagagaattcttgagaagttcccagagaaatgtccaccgggaggagagcactctgtggtgatctacataacaactcttagagggatacggaagacgtttgaggattgtaatgtggtaagatcgatattagattcacacgaagttcgattctcagagcgagatgtgtcgatgcactcggtttttaaggaagagatcaggggcattatgggaacgaaacatgtgaagatacctgcggtattcgttaaagggaggatggtaggaagtgttgaggaagtgatgaggttagaagaggagggcaaattgggaatattacttgaaggtattccggcggcgaggcttggaggcagttgctgccgtggatgtggaggaatgagatttatgatgtgtgttgtttgcaacggaagctgcaaggttagggaggaagagaagaagagtatggttaagtgtttgaagtgtaatgagaatggtttggttctatgtccaatttgttcttaaaaaagagaatcagttttgccctaattctggaggctgacttttgaagggttgattttggtttgtaatgatttggtgagagagagtttctaaagccgtgtttagtgctcttggtgtgtactactactagtttaatggaatttgtttctaatgtttgt

SEQ ID NO: 44 - DNA, 5265 bp, Arabidopsis thaliana
gaaacagagaaaaagaaagagagagagagagagaagaagaagctctcatcactcatctgttatcttcctcttcttcttcttcttcctcttcttttttccttccacatttatctttattttattttttagtgtacatttatcttattttacacacacgcctctcattttttttcatttcaatggcgatgcaatctctttcccctgttcctaagcttctctccacaacaccaagctctgttctttcttctgacaagaacttcttcttcgtcgatttcgttggattatactgtaagtccaagaggaccagacgcagacttcgtggagactcttcctcttcctcacgctcttcttcttctctctctcgtctttcctctgttcgtgccgttatcgaccttgaacgtgttcatggcgtctctgaaaaggatctctcctctccttcagctttaagacctcaggttgctaatttggaggatatattgtctgaaagaggagcttgtggagttgggtttatagcaaacttagataacataccttcacatggagttgtcaaagatgctcttattgctcttgggtgtatggaacatcgtggaggttgtggagcagacaatgattctggtgatggctctggtcttatgtcttccattccttgggatttctttaacgtctgggccaaggaacaaagtcttgctccttttgataagttgcatactggtgttggcatgatctttcttccacaagatgatacctttatgcaagaagccaagcaagttattgaaaacatatttgagaaagaaggattacaagttcttgggtggagggaagttcctgttaatgttcctatagttggtaaaaatgctagggagacaatgcctaacattcaacaagtgtttgtgaaaatcgcaaaggaagatagtactgatgatattgaaagggaactttacatctgccggaaactaatcgaaagggccgtagctactgagagttggggaacagagctttacttctgttcactgtccaatcaaaccatagtgtacaagggcatgcttcgatctgaagctcttggattgttttatctagatcttcagaatgagctttatgagtctccttttgctatttatcatcgaaggtacagtacaaacactagtcctaggtggcctcttgctcaaccaatgaggtttcttggacataacggggagatcaataccattcaggggaacttaaattggatgcagtctcgagaagcttcattgaaggctgctgtttggaatggccgtgaaaatgaaattcgtccatttggtaatcccaggggttcagactctgctaatcttgatagtgctgcagaaatcatgattagaagtggaagaacaccagaggaagctctaatgattcttgtccctgaggcatacaagaatcatccaaccttatctgtcaaatatcctgaggttgtagatttctatgactactacaaaggacaaatggaggcttgggatggtcctgccttacttttgttcagtgatggaaaaacagttggggcttgtcttgaccgtaatggccttcgtcctgctcgatattggcggactagtgacaatttcgtctatgttgcatctgaggtcggagttgtaccagttgatgaggcaaaagtcacaatgaaaggccgtctaggacctggaatgatgattgctgttgaccttgtgaatggccaggtatatgagaatacagaggtcaagaagagaatatcttcatttaatccatatggaaaatggattaaagaaaactcccggttcttgaagcctgtgaatttcaaatcctcaactgtcatggaaaatgaagaaatcctaagaagccaacaagcatttggttattcaagtgaggatgtgcaaatggttattgagtctatggcttctcaaggaaaggaaccaaccttctgcatgggcgacgatattccgctggcaggattgtctcaaagaccgcatatgctttatgattatttcaaacaaagatttgcacaggttacaaaccctgccattgacccccttagggaaggtttggttatgtctcttgaagtaaatattggaaaacgtggaaatatattggagcttggacctgagaatgcctcgcaggttattctgtctaaccctgtgttaaatgaaggagcgttagaggagttaatgaaggatcaatacttaaaaccaaaggttctgtccacatatttcgatataagaaaaggcgttgaaggttccttgcaaaaggctctatattatctttgtgaagcagctgatgatgctgtccgaagtggctctcagcttctcgttctttcagaccgatccgatagactggaaccaaccaggccttcaattccaataatgttagctgttggcgctgtccatcaacatcttattcagaacggcttgcgtatgtcagcttctattgttgctgataccgcccaatgcttcagcacacatcattttgcttgtttggttggatatggtgcaagtgctgtatgcccatacttggcactggagacatgtaggcaatggcgcttaagtaacaaaactgtggccttcatgcgtaacgggaaaattcctactgtaaccattgagcaagctcagaagaactacactaaggcggttaatgcagggcttcttaaaattctttctaagatgggaatctcattgctttcaagttattgtggtgctcagatatttgagatatatggtttgggacaggatgttgttgatcttgcattcactggaagtgtgtcaaaaatcagtggactcacctttgatgagttggcaagagagacattgtctttctgggtgaaggccttttctgaggatacaactaagcgattagaaaattttgggtttattcaattcaggcctggaggtgagtatcattcaaacaacccagagatgtcaaagttgcttcacaaggctgtccgtgaaaagagtgaaactgcatatgcagtctatcaacagcatctctctaacagacctgttaatgtcctccgtgacctgcttgagttcaagagtgatcgtgcaccgatcccagtagggaaagtagaaccggccgttgctattgttcagagattttgtactggtggaatgtcacttggtgctatttcaagagagactcatgaagctattgctattgcaatgaataggattggtgggaaatcaaactctggagaaggtggagaggatcctatccgttggaagccacttacagatgtggttgatggatattcaccaacactaccacatctcaaaggtcttcaaaacggcgatattgcaacaagtgctatcaagcaggttgcttcagggcgttttggagtcacaccaacgttcttggtcaatgcagatcaattggaaatcaaagttgcacaaggtgccaagcctggggaaggtggtcagcttcctggaaagaaagttagtgcgtatatcgctaggctaagaagctctaaacctggtgttccgcttatatctccgcctcctcaccacgacatttactctattgaggatcttgctcagttgatctttgatctacatcagattaatccaaatgcaaaagtatcagtcaagctagttgcagaagctggaatcggaactgttgcttcaggagttgcaaagggtaacgctgatatcatccagatatcaggccatgatggtggaaccggggctagtccaataagctccataaaacatgctggtggaccatgggaacttggactaacagaaactcaccaaacacttatcgcaaatggactaagagaaagagtcattttaagagtcgatggaggcttaaagagtggtgttgatgttctaatggctgcagctatgggtgctgatgaatacggattcggttccttggcaatgattgctactggttgtgttatggctcgtatttgccacactaataattgcccagtgggtgtagcaagtcagagagaagaattacgtgcaagattccctggtgtacctggtgatcttgtcaactacttcttatacgtagcagaagaggtgagaggtatcttagcacagttgggatacaacagtttagatgacatcattggacgaacagagttactgagaccacgagacatttcgctagttaaaactcaacatctcgatctgagttatcttctttcgtctgttggaacaccttcattgagcagtactgaaatcagaaagcaggaagttcatacaaatggacctgttctcgacgacgatattcttgcagatccattggtgattgatgcaatagagaacgaaaaagtggttgagaaaaccgtcaaaatatgcaacgtagaccgtgcggcttgtggtcgtgttgctggtgttattgcaaagaagtatggagacactggttttgcaggacaagtgaacctaactttcttagggagcgcgggacagtcgtttgggtgctttttgattcccggtatgaacatccggctcataggagagtcaaatgactacgttggaaagggaatggctggtggtgaaatagtagtaactcctgtggaaaaaatcgggtttgtgcctgaggaagcaacgatagtcgggaacacttgcttgtatggtgcaacaggtggtcagatattcgctagaggcaaagctggagagagatttgcagtgagaaactcactcgctgaagcagtagttgaaggcactggagaccattgctgtgagtacatgactggtggctgtgtagtcgtgcttggaaaggtgggaagaaacgttgctgctggtatgacaggagggttagcttaccttcttgatgaagacgacactcttcttcctaagattaacagagagatagtgaagatccaaagagtaactgcgcctgcaggggaattgcagctgaagagcttaattgaagcacatgtggaaaaaaccggaagcagcaaaggcgcaacgattctgaatgagtgggaaaagtatctacctctcttctggcaactggttccaccgagtgaggaagacactcctgaagcttctgctgcttacgtaagaacatccaccggggaagtcacatttcaatcggcttagagatcattcaagagcaggttgtggcagttgaaacacaaggattgatatacatcaatggtggaggactatggagagcagattaatggaaaatcattatcattcacatgtagatcaaatgtgtgggacaatattcttattgtcttgtgatctttacaacaataccatggttgctataactgtacagtaaattcagtaaaataactgctttcaactgtca

SEQ ID NO: 45 - DNA, 600 bp, Arabidopsis thaliana
agaaaacccttaagctaagcaaatttcaaagcatttcaaaaaccctagcctatctctctttatctctcacaacaaaatctttgaaatggcgatctctaaggcttccattgttgttctcatgatggtgattatctccgtcgttgcatcggcacaatctgaggcaccagcaccaagtcctacttctggatctagtgcgatctcagcgtctttcgtgtcagctggagttgcagcagtcgcggctcttgtttttggctcagctcttcggatctaagttactgtgatggtgatttcgtacagagattgtttttgcggtataggccattcatcattattcgtcgtctcgtgtgtattccgaagcagcttatagatctcattttctatttgtccctcttcttcttcgttttctatcttaatcttcatatctgtatgaggatattactatttctttttagagtatttgtggttttgtgattttctagacgatttcttagttatgcgatatggtttttgatatgatatgaatcttattctatttatttatatggatttctcttgagatttctcttttttccttatgctaaatcatttctcaagcatctg

SEQ ID NO: 46 - DNA, 1328 bp, Arabidopsis thaliana
aactccgcaaaaacctctctttctctctctctccgacgatggcttccggtgaccagagcaagaagagaaaacagcattatcgccctcaaaacagaccagtgaagaagaagggatcttaccctttgaagccaggtgttcaaggttttttcatctcttgcgatggcggacgcgaattccaagctgctcaggaagctattaacgtcattgattcctttttcgaggagctaatacaagggactgactcgaaagtgaatcctggtttgtttggtaatccaataaacaaaaaagttacattttcgtatagcgaggatgaggatgaggaggaagatgagagtaataatggcgaggaagaggaaaacaaaggagatggggataaggcagtagtgagtgaaggcggtaatgatctagtgaatgagaaagaaatagctagtgaaggagttaatgatcaagtgaatgagaaagaaatagcaagtgaagggtcatgtgaagtcaaacaattggcagaaaatgagactgtaaaagaggaagaagataaagggaatcagaagaatggtggagatgaacctcctagaaagaagacgtgtacggaagaagcaaatcctttagcaaaagtaaacgaaaatgcagagaagtctattgataagttgattgaagctgaactaaaagaacttggagacaagagtaagagacggttcatgaagttagatccgggttgcaacggtctggtcttcatccaaatgaaaaagagagatggtgacccaagtcccaaagaaattgtacagcatgctatgacttctgctgctgcaacaaaaaagcatatgtcaaggttcatcctaagacttctaccaattgaagtgtcgtgttacccttcagaggaagaaatttcaagagccatcaagccgcttgtagaacagtacttccccattgagaccgaaaatccccggaaatttgctgtgttgtatggagcgcgtgctaacacagggcttgataggatgaaaataataaacacgatcgccaaatctattcctgcccctcacaaagttgatttgagcaatccggagatgacgatcgtggtggaaattattaagacagtgtgcttaattggagtggtagagaagtacaaggagctagcaaagtacaacctcaggcagctcacgtcgaccaattgacacatcttcttttatctttaactatgtttcgtttcttaagactgaagatgcttttgtgtttagtgttacagagtttctggcttaacttattaaaatggctgaagttgccctttatactctctttggtctgatcaataaagttttttctttgataaagtt

SEQ ID NO: 47 - DNA, 3118 bp, Arabidopsis thaliana
aaaccgagtaaaaaaaaactttgatggacggtggccgagttctctcatttcagtaattagtcgtctctaaaattggttttcgttccccgaggaggtttcttccctagtagaccataagatcgctgagaatatgtcgtggctgcgaacggccgtgaataaggctgtggaggtcggaaaccgcaaaaacatcacacgaaccgtcaaaaactatgccgactccgtcgtccagcacgctggccaagccgtcgctgaaggagccaaattgttccaagaccgcattggtgttggggcttataagagtgttcatcagacaattcagagattggaagaagctgcagtctcatatagaggtcaagaaagggcattgctgattactagatggctaagtgtgcttaaggagattgatagagctactgacagttctctaaaggataaacaattgagttcagaggaacaacttgcttctgatgaagcaaagaaacgtgaatgggttttgtattacgatccagatataggcggtgagccacttaacttccgtgatgtttttctgcaaagtcaagctctggaggggatcgttctgtccatgattattgaaccaccacatgacgaagaaatcacgctactcctggagatgtttggcctttgtttgaatggaggaaaggaagttcatgatgccatagttagcagtatgcaggatcttgctacagtcttttcaagttacaaggatgaagttttggttaagcaggacgaattgcttcagtttgcccaaaatgccatcacagggttgaagattaatgctgaaatgctgagaattgatgctgaagcttctgatttgagaaagaaactcgaaaagatgaatgcctctcaaattccacaggagagtgaagacaaggaacataaagagactcctttaacaatagaggctttcaaagaaacacttgcaaagattcgtctttgctccagattagaaggtcttctaattagaaagagacaactaagcaatggtgactcaccagatatacatgctcagaaagtcgacaagctcagggtgttattagaatctttagcaaattcaacttccaaagccgagaaacgaatatcagagaacagacttcagaaagaggaagcactaaaagctcgtgtggtgaaagcaaatgaaaccggtgaaaaggaaaaggagttgggtgccgaaattgcacagcttgagaaacaaagagatgagctggaagccgatctgaagagggtaaatctatcgttagctgctgctcaagctcggtttcgtaatgcgacagaggagagggatcaatttggtgaagccaacaatcagataatcgctcacctgaaaacgaaggatgatgacctgtccaaatcagttgtagcttgtaagaaagaagcagaagttatcaagacgtggattaattttcttgaggatacatggcttcttcagtgctcacatatcgaaacgaaggataagcagactttggacgaattggagaagcatgaagattacttctcggatgtggccttgaatatactctctgtgtacaagaaggaggtggcacctttaataagtcgtatagaaaattatgtggaaaatctgaagaatctgggtcctgggtcggagaagccaccaaatgcagatcagggagacaatcaggtatcaaacccgaggaaaattctggaggaggagtatatagactatgagaccaagatcattaccacattcagcattgtggacaacgtgaaagagcaattccaggttctccaaagcaaactggataaaaaggacgaccggcgtgtgaaagagctgtttgatgacatggagaaaatgaggcagcaatttgaatccatagcgaggccaacgttagagatagagattccatcacctagaagcagtgttacgtcccctaaaagcagtgctacatcacccaaatctcccaagcctagcagtagtagcatgaatgcttcaactgaatctactcagacccaaaagccagagctgagcaattctcctcaggcacccaatcctgcagctggttccagtcaagagtttaaccctgaagccgaactagccgagctggaatctgaatttggtaaggtggctcgtgattactctgcagatgaggttgatggatgggaattcgatgaactggagaaagaactgcagtagtatgatccatcacacgcctgcctcacatacactgatatgtttttcatttactttctttgtttgaccataactccgaagttcctttgttaatctgtttggtaatttatggtaactgcctgttgacttttgtatgtctacttttttttttttttgctcataagtgttgtctcttatttaaaccaaagattgtaaagattacaaaagagtggaaacctccgctttcagtctccagacaaaaacaaaataaagataaaagtccaactaaattaaagcccagttgaagcaagaaacccttttaggaagtaattgatgtagtccaccgccgatttggttagtcattgcagggaactccaaaaccaccaggaaccaccaagacttcaagcttgtccgatggagcaacacaaaattcagagaatcccatcaatcttcttcatcttcgaattcgcaaaggaaaatctcccctgggtagtcatatcatcatcttcaaacgacatcagcgtagaacttaagccaatgaaacttccatgaacacctaaaagtaaaataaaaacactcgtttccaaaaaccaatatgacaattgactcaattgcataaaacccaactcaaaggcattagagaaaaccccaatccacaactctaatttgttcttatataattgaaatcgataagcttgaaaaacaaattgagccctttaaacaaaggaggttcaaggaattgagccctctaagagttagaacacaaaggagcaaaatcaaactggatctatagaaaacgagaacataaaacaaaaccgaaaaagaaatccggccaaaagctagcctaaaccgccggagacggacgacggagaagctagacaagagccaaccaccgttggtagaggaaccaaccgatggaggacggcgacaccggacaattctgctaaaggagccagaagattccgggaaagt

SEQ ID NO: 48 - DNA, 1977 bp, Arabidopsis thaliana
cggcacgtatccggttaataaagacaccggcaaatttaaattcatcttccgtcgccttcgtaaagtcgccgcagctcaaaattcaataacaatgttcctttcccgcgtgaaccccacgcgcttccctccattcgtagcttctcgtcgtctcttctccgcctccgcctccgccgcttctcttcagcaatactgcacggagaagccaccgatcaaaccgtggccgcagaggctattcccgaagcgattagtctccatgatcacccaacagcagaacatcgatctcgctctccaaatatttctctacgccggtaaatctcatcccggtttcactcataattacgatacttaccactcaattctcttcaaactatcccgtgctcgtgctttcgatcccgtggagtctctcatggcggatcttcggaactcataccctccgatcaaatgcggcgagaatctcttcatcgacttgcttcgaaactacggtctcgcaggtcgttacgaatcttcaatgaggatctttcttcgaatccctgatttcggtgttaaacgctccgttagatcgttaaacacactcttaaacgttttaatccagaatcagagatttgatttggttcatgccatgtttaagaacagtaaggagtcttttggaattacgccgaacatcttcacttgtaatctactagtcaaagctctctgcaagaaaaatgatattgaaagtgcatataaagtgctcgacgaaattccttcgatgggattagtgccaaatttggtgacttacactacgattctaggtgggtatgttgctagaggtgatatggaatcggctaagagggttttggaagagatgttggatcgtgggtggtatccggatgcgacgacttacactgttctcatggatggttactgtaagttagggagattctctgaggcagctacggtgatggatgatatggaaaagaatgagattgagcctaatgaagtaacttatggtgttatgatcagagctttatgtaaggagaagaaatctggggaagcacgtaacatgttcgatgaaatgcttgagagaagttttatgccagattcttctctttgttgtaaagttattgatgcgttgtgtgaagaccataaggtagatgaagcatgtggtctgtggagaaaaatgttgaagaacaattgtatgcctgataatgcccttctgagcactctcatccattggctttgtaaagaagggagagttactgaagcgaggaaattgtttgatgagtttgagaaaggctcgatccctagtctcttgacgtataacacgttgattgctggaatgtgcgagaagggagagttgacagaggcgggtagattatgggacgatatgtatgagaggaaatgtaagccgaatgctttcacgtataacgttttgattgaagggttgtccaagaatgggaatgttaaagaaggagtcagggtacttgaagagatgctggagattggttgctttcctaacaaaacaacgttcctgatattgtttgaggggttgcagaagttagggaaagaagaggatgcgatgaagattgtttccatggctgttatgaatgggaaagttgataaagagtcttgggaacttttcttgaagaaatttgctggtgaactagataaaggggtcttgcctcttaaagaattgttgcatgaaatttctgtctcttgaagaaccaggactatgatcaatactcaaaaggctttatctatgtcctggaggctcttgtggcagatgaacgtataagggaagagaagcagccactccaggccgcttaagattcggcatccatgttccgcttcaagctatatagataatcaagcagctgacattgatggaggaagatggaggcttgcaaagaatgaagagatctccaaattgataacttatgatatgaatgttgattgtaacatagatgctaattaaagagtgaaaatcatgatttctgg

SEQ ID NO: 49 - DNA, 1504 bp, Arabidopsis thaliana
attttttctttaaaaaaaaaaaataccaaaagaagcggaaacagagaaaaagagagaaaaatgctgagtagatcagttgcttctgctgttacaccggtctcatcttcttctctcttaccaaactcaaagcctatcttctgtctgaaaaccctctccggttatcgttcttcttctttctgtggcggctgtattcgtaaaatcaaccataagcctcttcgaatgacgagttccaatattacaccaagagctatggccacacaacagcttgagaacgctgatcagctcattgattctgtcgaaacttttatcttcgattgtgatggtgtgatttggaagggagataaattgatagagggagttcctgaaactcttgatatgcttcgtgccaagggaaagagattggtttttgtgacaaacaactcaacaaaatctaggaaacagtatggaaaaaagttcgagactcttggcctgaatgttaacgaggaggagatatttgcttcatcttttgctgctgctgcatacttgcagtctattaatttcccaaaagataagaaggtctatgtgattggtgaggaaggtatcttgaaagagctagagcttgctggttttcaataccttggaggtccggatgatggtaaaagacagattgaattgaagccaggttttctaatggagcatgatcatgatgttggagctgttgtggttggatttgatcgctatttcaactactacaaaattcagtatggaacactctgtatccgtgaaaacccggggtgtcttttcatcgctacaaaccgagatgctgtcactcaccttactgatgctcaagaatgggcaggtggtggctctatggttggtgctcttgttggatccactcaacgtgagcctcttgttgttggaaaaccctcaacttttatgatggactatttagcagacaaatttggaatccaaaagtcacagatatgcatggttggtgatagattggacactgacattttattcgggcagaatggcggttgtaagactctactcgtcctctcgggtgttacttcaatctctatgttggaaagccctgagaacaagatacaaccagatttctacaccagcaagatctccgattttctgtctccgaaagccgcaactgtataatctagtaagccccgcgtcaatcactctgtagaactcagggtactgaatctatttatgggtatacaactacagtctattcatttttctttgtgactatgtgtataataataagaactttcttgcttgtttttggcaagcttattttatttgcagtgcctttgtgtgcatagcaaattagggagccaatgtgtttttttttaggaagagtttacagaattgaaccaagctctaatctgtaagggtttctctcttcattgcctttaaattatttgtttgtggtcatgtatacataaaaagaccttgcataacacattaaataacggtaacataatttataaacattctttcgcaatcg

SEQ ID NO: 50 - DNA, 1441 bp, Arabidopsis thaliana
acaatacatcatcctcttttcccacatataaaaaccctttgagagatctcaactttgtttcatctcatttatcatcatccttcaagaacacaaagctagacagaaaaaaaaaaatgtgttcctcaaaattaaaaaatctgacccaagaaaacatttctcagatcaacggccgtccggttcttcaaccgaagtcgaaccaagttccgacattagaccgacgtaactcactaaaaaaatcgcctcctaagcctttgaatccaattgcatcaaagataccctcaccaagaccaatttctctaatctctcctcctttgtctcccaacacaaaatccttaagaaaaccggccggttcttgcaaggaacttcttaggtctagctctacaaaatcgaaaccagtgatatcaccagagaacagtgatggtggctacaaagaggttatgcctatggtgattgttcaaaagcagcctggaagtatagcagctgccagaagagaagaggttgcaatgaaacaagaagagagaaagaagaaaatttctcattacggtagaatcaaatccgtaaaatcgaatgaaaagaacttaaatgttgagcatgagaagaagaagagatgcagtttcatcactacaagttcagatccaatatatgtcgcttaccatgacaaagaatggggagttccagttcatgatgacaatctactatttgagcttctggtgttaaccggagctcaggtcggatcagattggacttcggttttaaagagaagaaacacttttagagaggctttctctggtttcgaagcagagttggtcgcagacttcaacgagaagaagatacaatcaatagtcaacgactatggcattaaccttagccaagtccttgcagttgttgacaacgctaaacaaattctcaaggtgaaaagagatttggggtcattcaacaaatacatttgggggtttatgaaacacaaaccggtcaccacaaaatacacatcatgccaaaagataccggttaagacatcgaaatcggagactataagcaaagacatggttcgtcgtgggtttagattcgttggtccgacggttatacattcgttaatgcaagccgccggtttaaccaacgaccacttgatcacatgtccgaggcatctcgagtgtacggccatggcggctttataggcaaaaggatcatgttgtaattgttgttgtagtcacattggctttaatttatatgtaaataaataatattttgtgttattattttagtactatagcttttctttttgtcaacattgtagtactatatctaccatgtgatatttaggtttgaggtcctaactttaggtattgatatttgtacaaaagctttttgtgtctgtgtttgtgattctgctttaaatttaatatatgtgtgtgtgtttatttatttttgtttaatgtgtttt

SEQ ID NO: 51 - DNA, 1736 bp, Arabidopsis thaliana
caactttttcatgttcatatacttttaattttactgaagagagattaatttacaaattcaaaaaaaaatcttagatcaggtggaatctaccagagagcacgcgattctagatcgatccaccggtgagagacgccggagtttttatccccgcggcggagtaaaccatttcttcttcccgatgtatcagtgaagttaagtagtcgagagaggggataatgatggaagtggaaggatcgatgaatcgtgctcctgatcaatcatccttcttacgatcaagacgatccaaagctctgtatcagtttaagcagcagaaactcccagcttgtaagccagtcttaacaccaatatcggttataacagtgtttatgttaatgggttttgttttcattcccattggtctcattactcttcgtgcttctcgtgatgctattgaaattatagaccggtatgatgttgagtgcattcctgaagaatatagaaccaacaaactgttgtatataactgattcatctatcccaaagaattgtacgcgctacttgaaggtacaaaagtatatgaaagctcccatttttatctactaccagcttgataactactatcaaaaccatcgccggtatgtaaagagtagaagtgatcagcaactattacatggactggagtatagccacacaagttcttgtgaacccgaggagtcatctaatggtctcccaattgttccttgtgggttaattgcttggagtatgttcaatgatacatttacgttttctcgcgaaagaacaaaactgaatgtgagccggaataacattgcgtggaagagtgaccgcgagcacaagtttggaaagaatgtgtatcctatcaatttccagaacggaactttgattggtggagcaaagttggatccaaaaattccactaagtgaccaagaggactttatagtgtggatgcgagcagctgctttactaagcttccggaaattatatggaagaatcgaagaggacttggaaccaggaaaagttgttgaagtaaatttgatgaacaattacaacacttatagctttagtgggcagaagaagcttattctctccacatcaaattggttaggaggaagaaatgatttcctgggtatcacctatcttgtcgttggttcctcttccatagtcatatccatcatcttcatgttgctccatttgaaaaatccaaggccatacggtgacaattcttggaacaagaaaagcctttcaagttgagaagctgttacattctttctctaacagattcatattccagaaaactgggtgtaagaaaaaaaaatgaccaaggaaatgaggtttgttcaaacatggggagaggtagcaccaaggcttattgcatctcaccagaaacaacaacagcaattctcagacttgccaaagcttgagacgatttttgaagaaggatgctgcgtcgatagtcttactgttagggcgccgaagcggattgtaatctttcttcctcttgcactctcaatgattttgtacatggtgttgcacaagagtatcataggttattattgatttgactttgtctattgatttttgagactttttaaatttgtgatgatgagaagaagagaatgttcaagacgataaaagagaggagggattggaaatgttgttaatggtgggaagttgatgacaaaatctctctatatgaatttaggtcaagagagatttgaaattgaaaagtctgttttatta

SEQ ID NO: 52 - DNA, 2429 bp, Arabidopsis thaliana
gagagaaactcttatcaaagcttttgatttctctctcgagggtttcttactctgctgcttcttcttcttcttcagtagagcgagattctctcgcgctctctatcgctacatataaccatgggtttatcaacgaatctccatagcctcgacctccgttcaactttcttcaccggtctacgtacatctccaatcccttccaatttcatcaaaatctcttccatttccaaccctagacgcgatatctccaccatcagagcccaagtctccaccatcagcctcgagacctccgttaaacagcgtcaagacgaaatcgaatctcttttctcgaagcaaccctctcagcaagactccgatcggaaacgaaacgggaagagttccaaaaacggagcttctgggatatcttcaggtgtgaagctagagaacataaggaaaagctacaaaggcgtgactgtgcttaaagatgtgacatgggaagtgaagagaggtgagaaagtagggttagttggtgtgaacggagctgggaagacgactcagctcaggattatcactggtcaagaagagcctgattctggtaacgtaatcaaggccaaacccaatatgaaagtagctttcttgagccaggaatttgaggtttcgatgagtaagactgtgagggaagagttcatgactgctttcaaggaagagatggagattactgagaagcttgagaaagttcagaaggctattgagggatctgttgatgatttggatcttatgggaaggttattagatgaatttgatttgttgcagagacgagctcaggctgtgaatttagattccgttgatgctaagattagtaagttgatgccggaattagggtttgctcctgaggatgctgataggcttgtggcttcgtttagtggtggatggcaaatgagaatgtcacttggaaagattttgcttcaggatccagatttgctgctacttgatgagccgacaaatcatttggatcttgatactattgagtggcttgaaggttatttgcaaaagcaagatgtgcctatggttattatttcacatgacagagcctttcttgatcagttatgtactaaaattgtggaaactgagatgggtgtgtccaggacatttgagggtaattattctcagtatgtgatctcaaaggctgagtggatcgaaactcagaatgcagcgtgggaaaagcaacagaaagatatcgactcaactaaggacttgatcgccaggcttggtgctggtgccaattctggtcgtgcttccactgcagaaaagaaactagagaagcttcaagaacaggagctaatagagaagccatttcagcggaagcagatgaagattaggtttccagagcgtgggacaagtggaagatcggtagtcaatgttaaaaacattgattttggtttcgaggataagatgctatttaagaaggctaatctatcaatagaaagaggggagaaaatcgccatccttgggccaaacggttgtgggaaaagtacgttattgaagctaattatgggtttagagaagcctgtgaaaggtgaagttattcttggagagcacaatgtactgccaaactactttgaacagaatcaggctgaggtccttgatttggataaaacagtgcttgaaactgtttgtgaagctgcagaagactggagaagtgatgatataaaaggtcttcttggacgctgcaacttcaaagcagacatgcttgatcgaaaggtctctcttttaagtggtggggagaaagcgcgtcttgctttctgcaaattcatggtgacgccatctactttactcgttttggacgaaccaaccaatcacttagacattccttcaaaagaaatgctcgaggaagcgataaacgagtaccaaggtacagtcattgcggtatcccacgatcgatacttcatcaaacaaatcgttaacagagtgatagaagtagaagatggttgtttagaagattatgcaggcgactacaattattacttggagaagaatctggatgctagaacaaaggagctagagagagaagcagagctagaagagaaagcaccaaaagtgaaggcaaagtcaaagatgtcaaaagcagagaaagaagcgaggaagaagcagaagatgcaagcatttcaacaagctaaacagaagtcaaaggctagcaagaactccaagagatggaactgaacaaacattgaaaactgaaaggagtcaagatttataaaaaaggcttcttcacagtctcacaaaatcgtcattgtggaatgtatatagatattacttttagaaatgcagagagagtattaatgtttctacaacacttgagccccattgggtaaaaattaagaaactttattctcaaacatggaaccgaaccgaaccaaaccattgaatttcagtgcaaaacctaatattggctc

SEQ ID NO: 53 - DNA, 1283 bp, Brassica juncea
ggggacaacatcacattcacaccagcactcaactcagccatggcttctattaactcttctcttcttcttgtcctagccgtcgcttgtttcatctcaccggcgatttcacagacgtgctctacgcagaacgtctccaccagcttcgacagttgcatggacctccccgtactcgattcctacctccactacacttacgacgcagccaactcatccctctccgtcgcattcgtcgctactccgcctcgttccggcgactgggtcgcttggggtatcaaccccacagggactagaatgatcggttctcaggccttcctcgcttacagtcctcgagccggcgcgcgtcccatggtggacacgtacaacatcagcagctacaacctcaccccagggagacttaccttcgacttctggaacgtacgcgccgaatccatgcccggtaatctgatcgtgatttacgcctcggttaaggttccgatgggagccaacagcgtgaaccaagtgtggcagatcggcgggaatgtgactaacggtcgtccgggagtgcatcctatgactccggcgaacatggcctctacacgggtgttgagattgaccggttctgatgctccgagctctgctccgggctctgctccgggctctgctccaggctctgttccagggtctgctcaagggccgaccactcctggtgcctcgaccactccaggacaggcgggaggtccagagaacgcgggttcgatgtcgaccagcgtaaatttcggggttaattttggaattttggttatgttggctactattttcatcttttgagtatgatttcatcatctttacattacttttttttttgctcaataatggagacatatactgttgtttatctttttagtctttagagtcatttactcttttttgttttccacctatctcccctctcacccacattattattctgagttattattggatttgtatggaccattactatattatcatcttgtctgcttaaaataactgcgttcgcatcccccttcagtagtggactattgccattagattcacatagatatttattttgtccttcagcttttattttcaaaatggaatttaaaaaaagctttaggataaacaaagcaatattcacatagatatttgttttgtccaacattgtttttttgtgtgttctccatttcatttgaaaagttatcaattgttttgttttgttgttgtcaatctggtgcttaaataatgatttaaagaataaaccaataaaccgtcttaccaacgtt

SEQ ID NO: 54 - DNA, 1320 bp, Brassica juncea
ataaaaatatcgacaggaagtagcgaatctcttttaactctttaagatctgaggtgatggcgatgcgacgagtcgccggagcagctatcagagcctgcgtttcctcttcatcttcaggttccttggcacgccaatttcatgcttcttctggcgatagcaaaaagattgttggagttttctacaaggccaacgaatacgcttcaaagaatcctaacttccttggctgcgtcgagaatgctttaggaatccgcagctggcttgaatcacaaggtcatcagtacgttgtcactgacgacaaagaaggtccagactgcgagcttgagaagcatatccctgaccttcatgtcctaatatccacccccttccacccggcttacgtgactgccgaaagaatcaagaaagccaagaaccttcagcttctcctcacagccggtattggatccgaccacattgatctgcaggctgccgcagctgctggactgaccgtggctgaagtcacgggaagcaacgttgtctccgtggcagaagacgagctcatgaggatcctgatcctcatgcgcaacttcgtaccggggtacaaccaagtcgtcaacggggagtggaacgtcgctggcattgcctatagagcgtacgatctggaaggcaagacggtgggaactgtaggagctggtagaatcggaaagcttttgctgcagaggttgaagccgttcgggtgcaacttgttgtaccatgacaggctccagatgggaccggagatggagaaagaaactggtgctaagtatgttgagagtcttgatgagatgctccctaaatgcgacgttgtagtagtcaacacccctctcacggagaagacaagaggaatgttcaatagcgagatgatagggaaaatgaagaaaggtgttttgattgtcaacaacgcaagaggagccatcatggataggcaagcggtggtggaggcggtggagagcggacacatcggagggtacagcggagacgtgtgggatccgcagccagctcctaaggaccatccatggcgttacatgccgaaccaagcgatgactcctcacatctctggcaccaccattgatgcacagctacgatatgcggcggggacgaaagacatgttggagaagtattttaagggagaagacttccctgctcagaactacatcgttaaggatggtgagcttgctcctcagtacaggtaagcttgtttacaactctatctagtcttgttgtatccgaagggcaaaagctaacggtttaataaataaactatcccctcctctgttcatttgaaaacattgtaataaaaccaac

SEQ ID NO: 55 - DNA, 1442 bp, Brassica juncea
atcatatttatcatcttctctgattcagcgagaaaaaaaaaaaaaggccaaaatgggtgcagacgcaatacaaacgaacggccaagaccccgccaagttaaccgtcgtagaagggatcgaacggttgagatgcgccgtgaagaactacgaatggggcaaactcggacatgactcactggttgcgagactccacgaggccaattcagggaaccgtgttgacccggcggttcctcacgccgagttgtggatgggtactcacgagtcaggaccgagtcacgttgtcaaggaagaagaactcgggtcgggtcatgatgggtccgaatgcatgattacgttgaagtcgtgggtttcggataatccggatgtactcgggtctagagtcgtggacaaatggggatgtgatcttcctttcctcttcaaggttttgtcagtgacaaaagcattgtcgattcaagcacatccaaacaaggcattagcagagaaattgcatagagaagagcctcttctttacagagatgttaaccataagcctgagattgctctcggctattactcctttcaagcgctttgtggtttcatatctcttaaggaactaaaggaagtgatcgccaatgtaccagggatcacagagctcgtcggaagtaaagctgcagatcaaatcttcaccgtcaacgaaaaagacggagacgagagtattaaatccattgtccgtttgatcttcacacagttaatgtctgcgagtaacaatgagacgaagcgagtcatatatgagatgaagatgcgtctaatcacggagacaaaccaccgtgaactaacggagaaggagaagttagttttggagctagagaaacagtatccaggtgacgtaggcgtgatctcagctttctttttcaactacgtcaagctaaatcccggagaagctttgtatttggacgcggacgagccacacgcttacatctccggcgactgtgtagagtgtatggcggcttcggacaacgttgttagagctggactcactcctaaacaccgcgatgttcagacgctttgctctatgcttacctataaactgggctatccggagattttaaaaggatttcctctgactccatacattacgagatatcttcctccatttgatgagtttgaagtggaccattgtgatcttcctacagggaaatcgacgatttttccggccataccgggaccttcggtttatctggttatagaaggaacagggaaactgcagactggttcatctcaattgttggttaaccgaggagatgttttgtttgttccggctcataacgagattcacttaactggagaaagtgatgtgatgaagctttacagagctggagtcagcagcaggttcttccagacactgtagacaaaagtataaacacatttaacattggatttttactctaaatataacaatatgg

SEQ ID NO: 56 - DNA, 1618 bp, Brassica juncea
aaagagagagagagagagaaatggataggagagaagtgtatgtgcttacaattttcgtggctctctctgttagatgcgtcggctgtgttgctaattacaacaggaacgatttccctactgacttcgcttttggatctggcacttctgcttatcagtgggaaggagcttatgatgaagatggaaaaaagcctagcgtctgggacacttacgttcactctcgtaacatggagaacggagacatagcttgtgatgggtatcacaagtacaaggaagatgttcagctaatggttgaaactggcttagaggcattcagattctccatctcttggtctaggcttatacccaatggaagaggtcctgtcaacccaaagggtttagagttctacaaaaacttcatccttgaacttgtaacccatggaattgaaccacatgttacactttaccactacgatcatccccagtatctcgaggatgaatatagaggatggctcaaccgcagaatcataaaagactttacagcttacgcagatgtttgcttcagagagtttgggaagcatgtaaaattctggaccacaataaacgaggctaatatattcactgttggaggttacgacggtgggaatacaccgcctggtcgttgttctacctgcatgtcaggtaactcttccactgaaccatatatcgtagcccataacttgcttcttgcccacgcctctgcttcaaggctatacaaacaaaagtacaaggatacacaaggaggttctgttggcttcagcatatttactataggatttagaccttcaacaaactccaaggatgatgaaatggcaattcaaagattcaaagatttcttctacggatggatgctagggcctctaacatatggagactatccggaaggaatgaaaagaaaactaggaacaagactgcctgttttcacaaaggaggaagcggaacaagttaaaggctcatctgactttgtaggagtcattcactatcttgctgctactatctcaaacgctgaacccaaacctttgcttccaggagactctgctttttttgcagagattggcgcaactttgacatactctgggaacttctcaggtttcgagtatgaagttgctccatgggctatggaagtagtcttggagtatataaagcagagctttggcaatcctcctgtctacattcttgaggatgctgaaccgatgaagcaagatttgcagctgcaagagaaggacacgcctaggattgagttcttagatgcttatattggtgctgtcctcaaagccgttaggaatggatcagacacgagaggctacttcgtgtggtcctttatggatttgtacgagatgctaagcggatacaattttagttttggtttgtactctgtgaatttcagcgatcctcatcgcaaaagatcacccaaactctctgctcattggtactctgctttcctcaagaagggcaacaccaactttcctggcttccaaggtacctcgcatttgcagaccaacttgtcatcttcttcgttagctgcttcctcctagtaatcttgctttttcctttttataaaaaaaaaataaaataaaggttatgtttatgatgaatccagtta

SEQ ID NO: 57 - DNA, 2241 bp, Brassica juncea
aaaaaaagcgacacgtcacttctctcaccatcttcttcctcctccttctctccgcttcactttttcttcaaaattttgaattgctttcatgctctgtaactgaggcttctccagccaaattcggtttcatggctatggcgtttcctctttcatatacgcccgtttctgttaaaccagtaacgtactctcggagatcgaaactcgtggttttctcttcttcttctaatggaagagatccctcaccctctgaggagaactcagtacctaatggagtgaaaagcatcgagaagcttcaagaggagaagcgtcgtgctgagttgtctgctcggattgcttctggagccttcactgtacgcaaatccagcttcccatcaacagtaaagaatggtttatctaagcttggagttcccagcaatgttctggatttcatgtttgattggaccggagctaacgaagattacctcaaggttccagaggctaaagggtctattcaggctgtccgtaacgaagctttcttcatccctctctatgagcttttccttacttacggtggtatcttcaggttgacctttggtccaaagtctttcttgatcgtgtcggatccttctattgctaagcatatattaaaagacaacgccaaagcttactccaaggggattttagctgaaattctagattttgtgatggggaaaggactcatacctgctgatggagagatatggcgtaggagaaggcgtgccatcgtccctgccttgcatatgaagtatgtagcagctatgatcagtttgtttggagaagcttcagataggctttgtcagaagcttgattccgctgcatctacaggggaagaagcagagatggaatcactcttctctcgtttgacgcttgatattattggcaaggcggtttttaattacgactttgactccttaaccaatgataccggtgtgatcgaggcagtttacactgttctaagagaagctgaagatagaagtgtttcacctattcccgtttgggacataccaatctggaaagatatttccccacgtcagaggaaagttgctacttctctcaagttgatcaatgacaccctcaatgatttgatcgcaacatgcaagagaatggtagaggaagaggagcttcagtttcacgaggagtacatgaacgaaagagatccaagcatccttcactttctcttggcttcaggagacgatgtatctagcaagcagctacgtgacgacttgatgacaatgcttatagctggacatgaaacatcagctgcggttttaacatggaccttttatctcctaacaacgaatcccaaagtagtggccaaacttcaagaagaggttgattctgttattggagatagattcccaaccctagaagatatgaagaagctgaaatacacaacccgagtcatgaatgagtcattgagattatatccacaaccaccagtactgatccgtcgttccctagagaacgataagcttggaccatatcccataaaaagaggagaggatatcttcatttctgtttggaatctacatcgaagtccccttcattgggatgacacggaagagttcaatccagagagatggcctcttgatggaccaaacccaaatgagacaaaccaaaacttcagttacttgccgtttggtggaggaccgcggaaatgcataggcgacatgtttgcttcatttgagaatgtggtagcaatcgcaatgcttattcgaagatttaactttcagactgcaccaggagctcctccggtgaaaatgactacaggagctacaatacacactacagaaggactgaaattgactgtaacaaagagaacaccacctctctctgttcctatccttccaatggaagctcctcgagatgaagtttcctctgctctgtcttgagtcttcttcatctttgcagaactgaagaaataaacaagctcaaagaagactaagaagaagaacaacaacaaatgcttctaattgtttctctgcgttatattatgcagacaagtagaatgtaaagaaaattattattctttgaaaaaagatatacaagtttcaaatattttctaggacatacacacgaagctcgaagttgtctatgatctaggaaagatctctgctcgtgtttggtatgcgcaacatcgagtactataaaacaaatctttcatcggtctgaaaccctcgggttgttaatgttccatgtctatggattctggagggtaacatc

SEQ ID NO: 58 - DNA, 2025 bp, Brassica juncea
aacacagactcaaaaaatccaattctgaatcgtctcaaacggatatatggctttcaaggttacactcgtctcaacatcccctatcgatggccagaaacctggtacctctggtctccgtaagaaggtgaaagtgttcaagcaacccaattaccttgagaactttgtgcaagcaacttttaatgctcttactcctgagaaagtcaaaggtgccacgctcgtagtctctggtgatggtcgttattactcaaaggatgctgttcagatcataattaagatggcagcagctaatggtgtacgacgtgtgtgggttggtaaaaacactctgatgtcaactcctgctgtatcagctgtgattcgtgagagatcaggggctgatggatcgaaagcaactggagcgtttatcttaacagcgagtcacaaccctggtggccctactgaggattttggaatcaaatacaatatggaaaacggagggcctgctcctgaatcaaccactgataagatttacgagaacactaagacaatcaaggagtacccaatagcagaagatctacccaatgttgatatttctgccattggtgtaaccagttttgaaggtcctgaaggaaaatttgatgttgaagtttttgattccgcagatgactacgttaaactaatgaagtcaatcttcgactttgaatccatccggaagttgctttcatctccaaaatttacgttctgctatgatgccttgcacggcgttgctggggcctatgcacatcgcatctttgtggaagaactcggtgcgcaagaaagtgccttgttgaactgcgtacccaaggaggactttggaggaggccatccggatcccaatctggcctatgcaaaggaacttgtggcacgaatggggctaggtaaatccgacaccggagatgaacctccagagtttggtgctgctgctgatggtgatgcagaccgtaacatgatcctgggtaaaaggttctttgtaactccttctgattcagttgccataattgctgcaaatgccattggagccattccgtacttcagctctggtttgaaaggtgtagcaaggagcgtgccgacctcagctgctctagatgtcgttgcaaaaagcttgaatttgaagttctttgaggttccaacaggctggaagttttttggtaatctgatggacgccggaatgtgttccgtctgtggggaagaaagttttggaactggctccgatcatatccgtgagaaagatgggatatgggcagttcttgcgtggatgtccatacttgctcacaagaacaaggaaaccattaacggtgacactaaactggtgacggttgaagacattgtccgccagcactgggctacctatggccgtcactactacactcgttacgactatgagaatgtagacgcaggtaaagctaaggaactgatggagcatttggtcaaactgcaatcttcaattcctgaagtcaacaagattgtgaaaggaatccgttccgacgtggcgaatgtctccagtgcggatgagttcgagtacaaagatccagttgatggatctatctcaaagcaccagggaatccgttacttgattgaagatggatctcgacttgttttccgtctgtctggaactggctcggaaggagcaaccatccgactctacattgaacagtacgagaaggatgcttctaaaaccggacgagagtcccaggaagctctgtctcctctggtggacatagctctgaagctgtccaagatggaggagttcaccggccgatcagctcccaccgtcataacataagaagacgggtcaaatgcaaccatctataaatcagacccttttccttgtctgcgtctttgggatgctttgtttcttctcatttaaatgaaactatgaataattaagagtctcggggaggctttcatatttcatgagttatcgtgaagcttatacttggatttgtctttctcggttttgttattttacatgtattacgtacatgattaagatttgttattgcagttcaa

SEQ ID NO: 59 - DNA, 1548 bp, Brassica juncea
acttcgaatattgtgagggagaagaagagagcaaaaatgagctttaatagagttttgttgagtatcataataatcctttgtgtatgtcttaactgggattgtagcgagggagctcaagaaaaacagaggagggcgattgattctcatactatccaactcagctctctcttcccttcatcatcatcaccttgtgttctttctacaagagcttccaaaacaaagtcttcccttcacgtgacgcacagacacggcacgtgctcgcgtataaccagtgccaaagccacgagtccagaccatgccgagatcctcagactagaccaagcgcgcgttgactcgatccactcgaaactgtcgaacaagctcacagatcgtgtcaggcaaagtaagtcaacggatctaccagctaaagacggaagcacctacggatcaggaaactttgtcgtgactatcggaatcggaacacctaagcatgatctgtctctaattttcgacacaggaagtgatctgacgtggattcagtgcgagccatgtgttcgaacttgctattcccaaaaggaaccaatcttcaacccctcttcctcttcctcataccacaacgtctcttgctcatcggcggagtgtagctctctctcctctgctacaggtaattctggaacatgctcggcttcgaactgcgtctacggtattcaatacggcgaccaatcgttctccgttggatttctcgccaaggagaaattcacactaacggcttctaacgtcttcgacggcgttaacttcggctgcggcgagaacaaccaaggacttttcaccggagtcgccggacttctcggactcggccgtgacaagctctccttcccgtcgcagacggcaacaacatacaacaagatcttctcctactgcctcccttcttccgccagctacaccggtcacctcaccttcggatccgccggagtctccagatccgttaaattcactccgatctccacgatcacagacggcacatccttctacggtctcgacatcgtcggaatctccgtcggcggtcagaaactggcgattcctccgacggtgttctctactccgggagctctgatcgattccggaaccgtcatctcccgcctcccgccgaaagcctacgcggcgatgcgaagcgcgttcaaggcgaggatgtcgcagtacaagaatgcgtcggccgtctcgatcctggacacgtgttttgatctcaccgggtttaagacggtgacgatcccgacggtgtcgttttacttcagcggtggcgccgtcgtggagcttggctcgaaagggattctgtacgcgtttaagatgtcgcaggtttgtttggcgtttgcggggaatagcgatgataacaacgctgccatcttcgggaacgttcagcagcaaacgctagaagttgtgtacgacggagcgggcgggcgggtcgggtttgctccgaatgggtgtagttaatgaaaaccatatgggtaaattttatttacggatttggcgccaaattagcttcatccttaatcaagtgtgtaatttgtgtga

SEQ ID NO: 60 - DNA, 2364 bp, Brassica juncea
acctgcaaattttgtgtctctcccatggtggttcctctatttcaatcatgccctctcacaccaacttcctcttcaggtggattggactgttttccgggaaactccgccgagaaaatactggattctcggaaaacagcatcgtccaaaacaacggtggagaatcgagcagcagtaatagcgacgagacgccggtgctgagctccggcgagtgttacgcatgcactcaggtaggcgtaccggccttccactccaccagctgcgatcaagccaacgcgccggagtggcgcgcctcggccgggtcctccctggtcccgatccaggaaggatccgcgcccaccgacccggctcgaacccgggtcaggcgtctcaagggcccgttcggcgaggtcctcgatcccaggagcaagcgcgtgcagagatggaaccgcgcgttgctcctggctcgcgggatggccttggccgtggatcccctcttcttctacgcgctctccatcgggagaaccaccggaccggcgtgtctctacatggacggcgcgttcgcggctgttgtcacggtggtccgcacgtgcctcgacgctcttcacttatggcacgtgtggcttcagtttaggctggcgtacgtctcgagagagtcactcgtcgttggttgcgggaagctcgtttgggatccacgcgccatcgcttcgcactacgcgcgccccctcactggcttctggtttgatgttatagtcatcctcccggttcctcaggctgtgttttggttggtggtgccaaaactgataagagaagagaaggttaagctgataatgacgatccttctgctaatcttcttgttccagttcctccccaagatttatcactgcatctgcttgatgggaaggatgcagaaggtcactggttacatttttgggactatttggtggggttttgctcttaatctcatcgcatatttcatcgcttctcatgtagctgggggatgctggtatgttcttgcaatacagcgtgttgcttcttgcattaggcagcaatgcatgagaaccgcgaactgtaatctgagtctgtcttgccaagaagaggtctgttaccagttcgtgtcacccactagcacaattggatttccgtgcttatctggaaacctcaccagtgtggttaagaagcctacgtgcttagactctgacggaccgttccgatatggtatctatggttgggcacttccggtcatctccagcaactctcttgcggttaagatactctaccctatcttctgggggctaatgactctcagcacgttcgggaacgatcttgagcccacaagcaactggcttgaggttattttcagcatagttatggtccttagtgggttattactattcacgctgttgatcggaaatatccaggtgtttttgcacgctgtaatggcaaagaagaggaaaatgcagatacggtgtagggatatggaatggtggatgaaacgtaggcagttgccttcccggttaagacagagagttaggagatttgagaggcagagatggacagccttgggtggagaagacgagctggagcttatacaagatctgcctccgggtcttcgaagagatatcaagcgatatctttgcgttgatctcattaacaaggtaccattgttcaggggtatggacgatttgatccttgacaacatttgcgatcgtgctaagcctcgtgtctactctaaagacgaaaagatcatccgcgaaggagatcctgtacagagaatgatattcatcatgcgtgggagagtcaaacgtaaccagagcctaagcaaaggcgtggtagccactagtacgctcgaaccaggcggctacttaggcgacgagctactctcgtggtgcctacgtcgtccattcatcgaccgtcttcctccttcctccgcaacatttgtctgcctagacaacatcgaggcgttctctctcggatccgaagatcttaggtacataaccgatcatttccgctataaattcgcaaacgagcgccttaagaggacggcaagatactactcctcaaactggaggacgtgggctgcggtgaatatacaaatgtcgtggcgccggtacaggaagagaacctgttcgatgagtcctgtgtcggaacatagcgttgaaggtaacagtgaacgccgtttgcttcagtatgcagcaatgttcatgtccatccgaccgcatgatcatctcgagtaaaaccaaaaaaaaagttgctaaatttatcggtcgaaataattgtttgtatccattgttcgtcctcaattgtttttgttctctttgtgtaaaataaaacctctctttcgattatgtgtatttgagtttaaaactagcattagaagtttctctt

SEQ ID NO: 61 - DNA, 1370 bp, Brassica juncea
acttcccatcacaatctcgattctcaaccacagatccgaagcttcccaacttttttttttcttcctttccccggaaatcacaagaaagaacaatctcgatctcctctctcccggaagaaagagaacatgtgcagcaagatggcgtttactctgacaatccctcgatttcactccccagtttctcgcaaacccaccacgtgttcttctccttctcctccctcgaagacccagtgtgctcacttcagccatgggcgatcggtttctctcagacgaagacttttcttacttcccgtcaaagccactaccgatcagtcaggtcaggtgggtggggaagaagttgatagcaagatcttaccttattgtagcatcaacaagaacgagaagagatcaatcggtgaaatggaacaagagtttctccaagcgatgcaatcattctattacgaaggcaaggctgttatgtctaacgaagagtttgataaccttaaagaagagttgatgtgggaaggaagcagtgttgtcatgctaagttctgatgaacaaagattccttgaagcgtcaatggcttatgtgtctggcaatccaatcatgagtgatgaagaatacgacaagcttaaaatgaaactaaagatggatggaagtgagattgtgtgtgagggtccaagatgcagtcttcgtagtaaaaaggtttacagtgatctcgccgtagattattttaaaatgttcttgttgaatgtaccagcaaccgttgttgctctcggactattcttcttccttgatgaccttacgggctttgaaatcacgtacttgctcgagcttccggaaccattcagtttcattttcacatggttcgctgcggtgcctgcaattgtgtatctggcgctatcactcaccaagctgatcataagagactccttgatcttgaagggcccttgtccaaactgtggaacagagaatacatccttctttggaacaatactatccatctccaatgacagttccaccaacaatgttaaatgctccggctgtggaacggcgatggtctatgattcaagtactcgtttgatcacattaccagaaggaggcaatgcttaaaccctatgggccaaggtttcattttcaggtgaaatttatataaaaaagagacactaatagatgaaggtggagaaattaagcaaaagagttgtgtttgtgtgctgttttctatagtcctcagatgtttccatgtagctctcgatgacttgtattgtgtgttgtaagtaaatgtgaggtgaaatcagagaaagaacaccatgtgattacttctttgaggaatttcgctctcactagaaaataaaatggaaaaaatggcacgacaaattacctgcatttgt

SEQ ID NO: 62 - DNA, 1343 bp, Brassica juncea
acgttcggattgaaattttagggttggagaatgacaatgaactcgcttccaaggaggttcgggaaaaatcaaggatacctagaccgagaccaccgcagagggaggagatccgattcagactccgacgaagagctgaaaggattgagtcacgaggagtaccggaggctcaaacgcctcaagatgaggaaatctggtaagcactgcatctggaagaacacgccgagtccgcctagagatcccaacgaggtggagtccgatgagaacgccgacgacgaggaggttccggaaaaggacgaggaagatccgaaaccaaaaggtgaatctgattctggtaagtcggaatctgagtctgatagatctaggaagaagagaaagagtaagagctctaggagtaagcgtagtagacgatatagtgatagcgagagtgatgatgattcggatgaggaagataggaggagaaggaggaggaagaagaagcagaagagtagtaggaagaggagaggacataggaggaagaggagatacagtgattctgatgatgaatctgagattagcgcttcttcgtcttctggagaagaacgtagcaaatcaaagagcaagaagaacactgactcgaaggggaagttagaagaagcggtgaaggagcctgagcttgacgaagaggagatgaagatgattattgaatcgaagaagaaagctttaccagaagatgaagaagaagaaggtgaggtgggtccaatgccgttacctaaagccgaaggacacatcagctacggaggtgcgttacgacccggtgaaggagacgctatagcacagtacgttcagcaagggaaacgtatcccacgtagaggagaagtgggtcttaacgctgatgagattcagaggtttgaggatcttgggtatgtgatgagtgggagtaggcatcaaaggatgaatgctattcgtatcaggaaggagaaccaggtttacagtgctgaagacaaacgtgcgttggccatgtttaactatgaggagaaggctaagcgtgaggctaaggttatgtctgatctttcgaggcttgtgcagcgccatatgggagaagagttgggtccgaatcatgacccttttggtgctggaaagactgatggagctgatgattgattttctttgctttcttctgctgtttatgtgggtacttatcttatgcttttgttcttgtaaactcttccttattgcatcatagttactgtttgtttgctacttgcccattgatgagtttcatagtttatgctttaatttgctatggtgtatcatattattgcgtttgtgtcttaaagatgaaagactcgactttagggatctgc

SEQ ID NO: 63 - DNA, 2173 bp, Brassica juncea
gagatttctccatctcctgcacagcttcttctgatcaaaagggggcacagagagagagagtcttggcttcccttcttctccttcttactattttcttctccgagtaatcaggaagcaaattttcagataaccatggggtcttcaagtagtccagggtgagcttgtttcttcgattctccgatctctgctagctctttccaagtgttctcatcctccattgaagtaactgaagttgaagaagcttgtgtaagaagagaagaagatctgaagttgtgtgtgtgtatttagtgatggagactaattcttctggagaggatctgattgttaagacgaggaagccatatacgataacaaagcaacgtgaacgatggactgaggaagaacataataggttccttgatgccttgaggctttatggtagagcttggcagaagatcgaagaacatgtggcaacgaaaactgccgtgcagattagaagccatgctcagaaatttttctccaaggtagagaaagaggctgaagctaaaggtgtaccagtggctcaagcgctagacatagctatccctcctccacgccctaaacgaaaaccaaacaatccttatcctagaaagaccggaactggatctctccccatctctaaaacgggtctcaatgatggaaaacagtcccttggatcagataaagtcttggttcctgagatgaccaatgaagatctgcaggaagacaactgttcagattgtctcactcatcaacacctctctgctgcatcttccataaagacatcaaacgctagcacttttcgagagttcttaccttcacgggaacaggggaataacaaggagtcaaactcagccaattacagtgaaaatatagaggcagaacctcagacttatccaaggcatatccctatgctagttccactgggaagctccataacaaggtctctgtcacatgctccagacgagaatagtcatcatccccacacagttgcaggcgatcatcagtcgtttcccgaccatattatgtcaagccttttacagacaccagctctatacacagctgcaagtttcgcctcaacgttttggcctcctgatactagtgttggcccacaagggaacaacttaactccgaatctggctgccatggcttcagccactgttgcagctgcaagtgcttggtgggctgccaatggactgctacctctatgtgctccttttagctcaggtggtttgacctctcaccctccaactattacttatggaccttcttccggtgaagtagacgtcacaaaaacaacggatcaagaacactctgaggcgtcaaaagctcggtcttcattggactcagaggagactaaaaatgggagtaaaccagattgtcatgagcatcatccttgtgcagcaactgagactgatgcaaagggatcagacggagcaagagagagaaaacaagttgaccggtcttcttgtggctcaaacactccttcgagcagtgatgatgttgaagctgatgctttggagaggcaagagaatggtggtaacaatgatgatgaagtgaaagaagtgaatgcagacactactaacaacaatccacaaactacttcagagtcaaatgcaagacgcagtagaatcagctccaacttagctgatccatggaagtctgtttcagatgagggtcgaattgcttttcgagctctctttgcaagagaagttttgccacaaagttttacatatcagagagaggagggtcaacaacaacaacaaagatatccaatggagcttgatcttaactcagcagctgatgatcaagaagagaacagaaacatagcgtttttgggtgcttcaaagcagcagcagctaagtagaggaaggacaggtttcaagccttacaaaagatgttcaatggaagctaaagaaagtagagtcatcagcaacaccaatcctatcatcagtgttgaacagaaagatcctaagcggattaggttggaaacacaaacttcaacatgaaaaaaagttgtaactctattattatatctgttgtttctctattttcattcaagtttcaaagatcactgatacattttcttctgtttttgagggcctgtgtattttgtccatagtcttcttgtaacgtttgactctgtattatcaaacaaatcataatctgtttaatt

SEQ ID NO: 64 - DNA, 1545 bp, Brassica juncea
caaattagcggtgaacagtcgggaggaagggaagggatgatgatctctcaattcttcgtcctatctcagcgaggagataacatcgtcttccgtgactatcgagctgaggtaccaaaaggaagtacagagacattcttccgtaaggtcaagttctggaaggaggatggtaatgcagaggcaccacctatttttgtaaatgtcgacggtgtgaactacttccatgtcaaggttgttggtctatacttcgttgccactacgagggttaacgtctcgccttctctggttttggagcttctacaaaggatcgctcgtgttattaaggactacctcggtgttttgaatgaagactctttcaggaaaaattttgtgcttgtctatgagttgcttgatgaagtcattgattttggctacgtgcaaactacatcaaccgaggttttgaaatcctatgtattcaacgagccaattttgattgctcctgcacgccttcaacctatcgatcctgctgccatcttcacacaagggtccaaaagaatgcctggaactgcagttacgaaatcggttgtagctaatgatcctgggggtcggagaagagaggaaatttttgtggacgtcatcgagaaaatcagtgttacttttagttcaagcggttatatactaacttctgagattgatggcactattcaaatgaagagttatctttctggtaatccagaaattcgtttagctcttaatgaggacctaaacattggaagaggagaacgatcagtatatgattataggagttcttcaggttcaggggtgatacttgatgattgtaactttcatgagtctgttcgtcttgatagcttcgactcggatagaactttgtccctggttccaccagatggggaatttccagtaatgaactaccgtatgacccaggagttcaagcctccttttcatgttaataccttgattgaagaggccggacgccttaaggctgaagtgattattaagatacgagctgaattcccttctgacgtagttgcaaacacgattactattcagatgccattgccaaattatacttccagggctagttttgagttagaacatggtgcagctggacagaagacagatttcaaggaaaccagcaaaatgcttgaatggagttttaaaaagattgttggcggggctgaacatacactgcgtgcgaagctgacattttcacaggaatttcatggtaacatcacaaaggaagctgggcctgtcagcatgacgttcacgataccgatgtacaatgtttctaaacttcaggtcaaatacttgcagatagcaaagaactcaagtagtcaaaatccatatcgttgggtgagatatgtgacacaggccaattcgtacgtggctcggatatgacctactttcatattatgctgcttcgtcacttttgtatgtccccaagtgacttttctcttacccttctcgacaatgtttgttcggattctggtcatacttgttctatgaagttgttgacaagatgcttcacagcacgtgtctgaatgttaa

SEQ ID NO: 65 - DNA, 2359 bp, Brassica juncea
cttcttctttcctccctttaatggctctatctgcatttgcttttccttcttacataacaaccaaaggaggtttaacagattcttgttgtaaatcaaattctctgtcttcttctcgatctttgtctgcagatcttccatcaccatgtctgaggccaaacaccagtcattcaaacagaaaggcaaaagtgaatgcttcacttgcagagaagggtgaatactattcaaacagaccaccaactccattacttgacacaatcaattacccaattcacatgaaaaatctttccaccaaggagctgaaacaactctctgatgagctgagatcagatgtgatcttcaacgtctccaaaacaggtggacatttggggtcaagtcttggtgttgtggagctcactgtggctcttcactacattttcaatactccacaggacaagattctttgggatgttggtcatcagtcttatcctcacaagattcttaccgggagaagagggaagatgcctacaatgaggcaaaccaatggtctctccggattcaccaagcgaggagagagcgaacatgattgctttggtaccggacatagctcaaccacaatatctgctggcttaggaatggcggtaggaagggatttgaaagggaagaacaacaatgtggttgctgtgattggtgacggtgccatgacggcagggcaagcttatgaagcaatgaacaacgctggatatctagactctgatatgattgtcattcttaatgacaacaagcaagtctcattacctactgccactttggatggtccgagtccgcccgttggcgcattgagcagcgctcttagtcggttacagtcaaacccagctcttagagagttgagagaagtcgcaaagggtgtgacaaagcaaataggtgggccaatgcatcagttagctgctaaggtggatgaatacgctagaggaatgataagcggaactggatcaacgctgtttgaagaactcggtctctactatattggtccagttgatggacacaacatagatgatttggtagccattcttaaagaagttaagagtgccagaaccacaggacctgtccttattcatgttataacagagaaaggtcgtggttatccttacgctgagagagctgatgacaaataccatggtgttgtgaaatttgatccagcgactggtaaacagttcaaaactactaacaagactcagtcttacacaacctactttgcggaggcgttagtggcggaagcagaggtagacaaagacgtggttgcgattcatgcagccatgggaggtgggacagggttgaatctcttccaacgtcgcttcccgacaagatgttttgatgtggggatagcggaacagcatgcagttacttttgctgctggtttagcatgtgaaggccttaagcccttttgtgcaatctattcttctttcatgcagcgtacttatgatcaggttgtacatgatgttgacttgcagaagttgccggtgagatttgcgatggatagagctggactagtgggagctgatggtccaacacattgtggagcgtttgatgtgacgtttatggcttgtcttcctaacatgatagtgatggctccatcagatgaagctgagctctttaacattgttgcaaccgctgctgctattgatgaccgtccttcttgtttccgttaccctagaggtaacggtattggcgtcgcattacctcctggaaacaaaggtgttcctcttgaggttgggaaaggtaggatcttaaaagaaggagagagggttgcgttgttggggtatggctcagcggttcagagctgtttaggagcggctgtaatgctccaagaacgtggattaaacgtaaccgtggcagatgcacggttctgcaagccgttggaccgtgctctcattcgcagcttagctaagtctcacgaggtgctgatcacggttgaagaaggttccatcggagggtttggatcgcatgtggttcagtttcttgcattggatggtcttctcgatgggaagctcaagtggagaccaatggtattgcctgataggtacatcgaccacggttcaccagctgatcaaatggctgaagctggactcatgccatctcatatagcagcaactgcacttaacttaatcagagcaccaagggaagctctgtattgaggagtagaatcggtggaaaacatatacaagaagcaagtcatttggatgagatggtaaagacaatgtgtgtgcaaagattagttgtaatgtaaacgttgttaaggggtgtgtgtgattgagatcgagctgtacaaccatatctaacatctttgtaaaaatcaaatattccctccgtttctaaaacgtta

SEQ ID NO: 66 - DNA, 2633 bp, Brassica juncea
ggacatgacatggactgaaggagtagaaaaaaccaaaagctctcaactttctcatcgatctcaatccaatcatgtcgaacccagctgaatcttccgactcgaaatcgaagaaagatttcagcactgctatcctcgagaggaagaagtctccgaacagacttgtcgtcgatgaggccatcaacgatgataactccgtcgcttctctccaccctgccaccatggagaagctccagctcttccgtggcgataccattctcatcaagggtaagaagaggaaggacactgtctgcattgctcttgctgatgaatcatgtgaggagccaaagatcaggatgaacaaagtggtcaggtctaacttgagggttagacttggagatgttatctctgttcaccaatgccctgatgtcaagtatgggaagcgtgtgcacatattgcctgttgatgataccgttgagggagttactggaaacctctttgatgcttacctgaaaccttatttcctggaggcataccgcccggtgaggaagggcgatctcttcctagtcagaggaggaatgaggagtgtggagttcaaagttatagagacagatcctgctgagtactgtgttgttgctccggacactgagattttctgtgagggtgagccagtcaagagagaggatgaggaaaggctagatgaagtaggttatgatgatgttggtggtgtcaggaagcagatggctcagatcagggagcttgttgagcttcccttgaggcacccgcagctgttcaagtcgattggtgtgaagccaccgaagggaattctgctttacggaccacctgggtctggaaagactttgattgctcgtgccgtggctaatgaaactggtgcatttttcttctgtatcaatggtcctaagatcatgtcaaagctggctggtgagagtgagagcaacctcaggaaagcgtttgaggaggctgagaagaacgctccttccatcatattcattgatgagattgactctattgcaccgaaaagagagaagactaatggagaggttgagaggaggattgtgtctcagctccttacgctgatggatgggcttaaatctcgtgctcatgttattgtcatgggagcaaccaatcgtcccaacagtattgatccagctttgaggaggtttggaagatttgatagggagattggtattggtgttcctgatgagattggacgtcttgaagttctcaggatccacacaaagaacatgaagcttgctgaagatgtggatcttgaaaggatctccaaggacactcatggttatgtaggtgctgatcttgcagctctgtgcacagaagctgccctgcaatgcatcagggagaagatggatgtgattgatttggaagatgactccatagatgctgaaatcctcaactccatggcagtgaccaatgaacacttccacactgctctcggaaacagtaacccatccgcactccgcgaaactgttgtggaggttccaaatgtttcttgggatgacattggaggtcttgagaatgtcaagagagagctccaggagacagttcaataccctgtggagcacccagagaagtttgagaagttcggtatgtctccatcaaagggagtcctattctacggtcctcctggatgtggtaaaacacttttagccaaagccatagccaacgagtgccaagcaaacttcatcagtgtcaaaggtcctgagcttctcaccatgtggtttggagagagtgaagccaacgtccgtgaaatctttggcaaggcacgtcagtctgctccgtgtgttctcttctttgatgagctcgactccattgcgactcagagaggtggtggaggcggaggtgatgctggcggtgcagcggatagagtcctgaaccagcttttgaccgagatggatggcatgaacgctaaaaagaccgtcttcatcatcggagcgaccaacagacccgacattattgactctgctcttctccgtccaggaaggctcgaccagctcatttacattccactgccagacgaggattcacgtctcaatatcttcaaggccgccttgaggaagtctcctattgctaaagatgttgacatcaacgctctcgctaagtacacgcagggattcagtggtgctgatatcactgagatttgccagagggcttgcaaatacgccatcagagaaaacatcgagaaggacattgaaaaggagaagaggaggagcgagaacccagaggccatggaggaagatggagtggatgaagtgtcagagatcaaagctgcacactttgaggagtcgatgaagtatgcgcgcaggagtgtgagcgatgcagacatcaggaagtaccaagcctttgctcagacgctgcagcagtcaagagggttcggttccgagttcaggttcgagactaatgctggttcaggtgcaaccactggagtcgctgatccttttgccacgtctgcagctgctgctgcggacgatgatgatctctacaattagtgatcaagtttatcagactctgttatttaagttttcattcggattctctctacttctggataccttgtgttttcttttaagttatcagaattatgttggtccttttaatcaatgttctcaattgactcctct

SEQ ID NO: 67 - DNA, 1570 bp, Brassica juncea
gatctacacttcttctctctctctctctttctctttctctttctcttcttcctctcgcaggcaaggttgttaatggcggaatcatccaaagtgattcatgttcgtaatgttggacatgagatttctgaaaatgatttgcttcagcttttccaaccgtttggtgtcataactaagctggtcatgctcagggcaaagaatcaggctctcctccagatgcaagatgtttcttcagcaatcactgctcttcagttcttcactaatgtgcagccaaccatcagaggaaggaatgtgtatatccaattctcctctcaccaagaattgacaacagccgtgcagaatattcatggacgtgaagatgagccgaatcgtattctcttggttacagtccatcacatgctgtatccaattactgttgacgtcctgcatcaagttttttctccctatggatttgtggagaagatcgtcactttccagaagtctgctggttttcaagctcttatacagtatcaggcacaacagtgtgctgcctctgctagaacttctctacagggtcgtaacatatatgacgggtgttgccagttggatatccagttctcaaaccttgaggagctgcaagtaaattacaacaacgatcgatctagggattatacaaatccaaacctgccatcagagcaaaaaggccgtttacctcaccctggctacggtgatgcaggagtggcatatcctcagatggcaaacacatctgcgattgcagctgcctttggcggtggcttgcctccgggtataactggcacaaatgataggtgtacaatccttgtctctaatcttaatactgatagtgttgatgaggataagctgttcaatctgttttctctttacgggaacattgtgaggataaagcttcttcgaaacaaacctgaccatgcccttgtccaaatgggagatggtttccaggctgagcttgcagtacatttccttaagggagcgatgctgtttggtaagcggctagaagtaaactactcgaagcatccaaatataacaccaggcacagactcgcatgattatgtaaactcgaacctgaaccgcttcaaccgcaatgctgcaaagaactaccgctattgctgctcccctaccaagatgattcacctgtccactcttccgcaagacgtgacagaggaagaagtggttaaccatgtccaagagcacggggctatactgaacacaaaagtctttgagatgaacgggaaaaagcaagctctggtgcagtttgagaacgaggaggaagctgcggaagcactggtttgcaagcacgcgacctctctaggcggatcaattatcagaatctccttctctcagctacagacaatttaaagtcgacaaggcctctctctctcttttctctctctcacctctaataacatttgggtatggtgaggatgatgaatgtgtgtttctttaactcaaatatctctgctacttgtttggacttttctgcactctttttaaacttggtcccttggtttaaatttgtgtgtgtttctttaactcaaatatctctgctacttgtttg

SEQ ID NO: 68 - DNA, 532 bp, Brassica juncea
ggggtctattagtttgtttctggattattcgctcagcgccgcgtgctctcgtcttcgatctccctccaggaaacaatggaagcgattaggaatctgaagataaagacatcaacttgcaaaaggatcgtgaaggagcttcactcctatgagaaagaggttgagagggaagctgccaagaccgctgacatgaaggacaaaggtgctgacccttacgacctcaaacagcaggagaatgtgttgggtgagtcgaggatgatgattcctgattgccacaaacgtctcgagtctgctttagctgacctcaagtccactttggcgggattggaagagacgacaggtccagaagttgaagatgcaaagaagactgtcgccgatgtggagaagcagtttcccactgaagatgcctgatttttatccatcctgtgagtcttgtttggcatgtgtattctgagaatggttaaatgctgagtttgacgattattaattgtaagactctcggttttctttcagtgctacaagtgttttcgtttgc

SEQ ID NO: 69 - DNA, 1454 bp, Brassica juncea
accacaccagtcgtagtttagtgtatatctctatacgcctcctcggatcttgctgccattaattacgaaactacccttgtctcctccagttcttcttagcttcaccattaatgctagcagcagccatacgaatctctatctaatggctaggacagctaggccagacggagaagaagggatatcgctgctcgagtttaacggtaacggcgaccgctcatggcagctaaacttcgacgatttccaggtgtctccggagcacaaggagaagaaatcgccgagcaaactccataactgtcttggctgcttgggtccggaagacaatgtgacagattattaccagcaacaggtagagatgcttgaaggctttactgaaatggatgaactcgcagaacgtggctttgtccctggaatgtcaaaggaagagcaagacaatctagctaaaagcgagacattagcgatcagaatatcaaacatggcaaacatggttctctttgccgctaaagtctatgcctccgtcacaagcggctctttagcaatcgttgcttccacgttggactctcttctcgatctcctctccggcttcatcctctggttcaccgccgtctcgatgcagacaccaaacccgtatcagtatcccattggcaagaaaaggatgcaaccactgggaatcctagtatttgcatcagtgatggccacacttggattgcaaatcatcttggaatctcttcggacaatgttatccagtcacaaggagttcagcttaacgaaagagcaagagagttgggtggttgggatcatgctctccgttacattggtcaaactgcttctcgttctttactgcagatccttcactaacgagattgttaaagcttatgctcaagaccacttcttcgacgtcatcacaaacatcattggactcattgcagtgatcctcgccaattacttcgataactggatggatccagtcggagctatcattcttgcattgtacacaatacggacgtggtcaatgacggttttggagaacgtgaactcactagttgggaaaacagcaacgccagagtatctgcagaaactgacttacttgtgttggaaccaccataaagccataaggcatattgacacagtgagggcttacacgtttgggtctcattactttgtggaggttgatatcgttctccctgctgatatgcctctgcaagtggctcacgacattggggaatcgctgcaagagaagctggagctgctgcaggagatagaaagggcctttgtgcatcttgattatgagtatacgcacaaacctgagcatgctagatcccactgttagctggattattcttctatccctacgtctaaaaattcttagagctaaagaatcttcaccatattgtttagtagacaaaaaaaatacctttgtaatctagttttgttaaaactataattttaagtctaaa

SEQ ID NO: 70 - DNA, 1524 bp, Brassica juncea
gggcccccacacgtgtggtctagagctagcctaggctcgagaagcttgtcgacgaattcagattggacactgacatggactgaaggagtagaaagtcgtcctcgtcttccatttttcttttacttttcataaaaatacccaaacaggatctctctctctctctctcttttcccttaatatctattttgatccactttcatttttctctctctctctctctcctgcttgtggtgatctccctctcgccaaatcttgacgaaatcgaacaacacccttttggattcagagaaaaatgggtggtggtgaggaagagatcaaggaacgtttacaaccagcaacggagaagaagcaacacaacgtgaaggggaagagactatggcagaaggtgaagtatcagctggttgagtaccacgcattgcctgcttacctgagaggcaacgagtacgtccttggtcattaccgatccgaatggcccattaaacagatcctcctcagcatctttactatccacaacgagaccttgaatgtctggacgcacttgattgggtttttcctgtttctagcgcttactatatacacagctactaaagtccctagcgttgtggatcttcactcccttcaacaccgtttacctgatgtcctgagggaaacagatcttcacaaacttcactctgacctcatgtctcgtcttccttctagtccttctaagtggcatgtcatggagcttctttacaactgtttgcctgagagattctctcatggcaactccaccgacatgtgtgttctgcattctgtgaaggaagatcttgcgaacatggtagctcctttgatcttcagaccaatcactcgatggcccttctacgcattcctaggcggtgctatgttctgtctattagcaagcagcacttgccacctcctatcctgtcactcagagcgagtctcttacataatgcttaggctcgactacgctggaatcgcggctctcatttctacttccttctaccctcctgtctactactccttcatgtgtgatcctttcttctgcaacctctacttaggattcataacaatcttgggaatctccacggtgctcgtctcgctcttaccggtcttccagagccctgagtttcgtgttgtgagggcctctctcttctttggaatggggttctctggagctgcgccgatactgcccaagctgatcatcttttgggaccagcctgaggcccttcacacgacggggtatgaggttctgatggggttgccttacgggttcggagctttggtttatgcgactaggattcctgagaggtggatgcctggtaagtttgatatagctggacatagtcatcagttgtttcatgttttggtggttgctggtgcgtttacacattatagagcagggcttgtgtatctcaagtggagagacattgaaggatgttgatgatttgatgtaacctttgatgttttgaatcattttcttttgtagcttcacgaaaaaagttggattgtgaatcattttcttaa

SEQ ID NO: 71 - DNA, 1346 bp, Brassica juncea
actccaaaagaaagaacaaaaaaaacacattttaattaaaattcaaaaaacccagaaacacagacgaagaaactaattcaaaggatcaagaaaccgcttcacttttaaaaagagatggtgatggtagtaggagaaacatccatggagctagaccagtgttttcagatgatgatgatgaagatggaaggagtttcgatcaaagagtggaaagacatccctgttgagcttcttatgagaatcctctcccttgttgatgatcggaatgtcattgctgcttctggtgtttgctgtggttggagagatgccatctctcttggtctcactcgtctccgtctcccttggtgcaacaacaacatgaacagcttagttctgtctcttgctcccaagtttgtaaagctgcaaactttaatactgcgccaagacaaacctcagctagaggacaatgcggtggatgccatagcaaatcactgccatgagctacaagagcttgatctcagcaaaagcttgaaactcactgaccgttccctctacgcacttgctcatggctgccccaacctcactaaactcaaccttagcggttgcacttcgttcagcgacaaagctattgcgtatctgaccaggtcctgcagaaacctgaaagttctgaatctttgtggatgtgtcaacgctgtttctgactataccttggaggctattgggaacaactgcaaccagatgcagtcactaaacttgggatggtctgagaagatcagtgatgatgggattatgagtttagcttatggctgtccagatctcaggaccctggacttgtgtggttgtgttctcattacagatgagagtgtggtagctttagctgattggtgcgtccacttgaggtcactggggctatactactgcagaaacataacggacagagccatgtactcgctagctcaaagcggggtgaagaacaaaccaggggggcaatggaaatcatcagctaagaagagcaaattcgacgaagaagggctgcgaagtctcaacatcagccaatgcactgcgcttacaccttcggctgttcaagcggtctgcgatacgtttcctgctcttcacacgtgttcgggaagacattcgcttgtgatgagcgggtgtttgaacttgacgtctgtgcactgtgcttgtatccttcaggctcatcgctcggttcctcactcggctcactgaaagagagaggaatgggtaatgtttgtatatagatgcttaatatgttgatgaagagattagatgccaaactctaaaattgcttttgagttggtttctttacgttgtcttgaaggatcttttgtaagaactctttgttactactt

SEQ ID NO: 72 - DNA, 1755 bp, Brassica juncea
tcatgcctcggaagtagagataagatggaaggaagaaggatcacagctagccctagaccttgcagcggaagaagagtcgtggccgcggagaaaaagaggtctcgtcccgatgggttcgtcaacagcgttaagaagctccagcgaagagaaatctcgtctcgcaaagatcgagctttctcaatcagcaccgctcaagagagattccgcaacatgcgtctagtggagcaatacgatactcatgaccccaagggacatagtttagttgcgttaccgtttctgatgaagagaactaaagttatagagattgttgccgcgagggacattgtctttgcgcttgctcattctggtgtctgcgctgccttcagtagagagacgaacaaaagaatatgttttttaaatgtaagtccagatgaagtcataaggagcttgttctacaacaagaacaatgattccctcatcactgtctctgtttatgcttccgacaatttcagctctttgaaatgcagatccactaggattgagtatattctgagaggtcagccagatgcagggtttgccctttttgagtctgaatcattaaaatggcctggctttgtagagtttgatgatgtcaatggaaaggtgcttacgtattctgcgcaggacagtgtgtacaaggtttttgatctgaaaaactacaccatgctgtattcgatatcagacaaacatgttcaagaaattaaaatcagtccagggataatgttattgatcttcaagagagctacaagtcacgttcctttgaagattctgtcgatagaagatggcacagttctcaagtccttcaatcatttgcttcaccgaaacaagaaagttgatttcattgaacaattcaatgagaaacttcttgttaagcaagagaatgagaatctccaaattcttgacgtcagaaacgctgaactaatggaagttagtagagctgagttcatgacaccctctgcgttcatatttctgtatgagaaccagctgtttctaacattcaggaaccggaacgtatctgtgtggaactttcgcggagagctcgtgacttcctttgaggatcatctcctatggcatccggactgtaacaccaacaacatctacataacaagtgatcaagatctgatcatctcgtactgcaaagcagataccgaagatcagtggatagaaggcaatgcgggatcgatcaatatcagcaacatattgactgggaaatgcttagctaagataacatcaagcagtggacctccaaaagaaggcgagactgagagcagtagtagcagtagcagttccttggggaacaactcgaagctaagaagaaacgctgtggctgaagcgttggaagacataacggctctgttctatgacgaagagcgcaatgagatatacacaggaaacagacacggctttgttcatgtgtggtccaattgatttcacattatcatcatcatcgtcatcatcatcgtaagctactacttctactacttgttgtactgtgttattttgtttacttcaattgtgtgtgtagcgatcaatcaatctgtttaacttagttgtctttcgagcagctatttgtgttgctttgaactacgtttggggcatgtgtgtgtgtgatttcagaatgcctattgtgtacactagtgtcatgggtttggttaaatctattacagaccctttattacatctttgctattcctttgctaacagtcaagttgagctgcaagttttgtatgattacat

SEQ ID NO: 73 - DNA, 500 bp, Brassica juncea
cgcgggactcacaaacacaagaacacactttttataaactctcaaaccaaacaaaagaagaacaagaagaagaaaaatgctgatggtcaaggccacatgggtgtccattttggccctcgctgcgtttctcctagtggttctagtcccggcggcagaagcggtgacgtgctcgccaatgcagctaagcccatgtgcggcggcgataacctcgtcttctccaccgtcagcgttgtgctgcgcgaagctgaaggagcagaagccatgcatatgtgggtacatgagaaaccctagcctccgtcgctacatcagctctcccaacgctcgtaaagtctctaacacctgcaagttccccatgccaaggtgttgaaaaaagtgtgtttgcaattatatatgatcatcctataaactatgtgtcgtttgaatcctgcttttggtatgcgtttgaggatgttaattaaaaatcatacccttaagaataacaacgtgtgatcgatgataaa

SEQ ID NO: 74 - DNA, 2034 bp, Hordeum vulgare
gtcgtatctttccctgtccgaattcaccgcgccgtgagcttccacaagcgcgtcatccccatcccatctgcacaccccatataaagaaaccatcttttataccaatccctagtctcacacggttccacccaccgcctccccaatcatcccctccgatttcctccagttcccaatctgtagctgctgctgctgctgctccttctgtgggattcgtggatcgaccccctcttttccatttcaggcaattagactcgcagagatggacactactgctggctaatagtaaaacgattatatggccaaagatattagggcaatgtgcaagggaggaaacgatttctacttcatcaataaggagacaagtgctgattcaatcaggcaaaacaattccaaaaattctcatcggatggcatttgatacagcaagaataactaaaacagagacatcaaagttgaagaacgtcatttcagcatcattcaaacccttgtctctgacaattcccataggagacggattccacgaatcgttccattcgagccattgctatttatagtatctactaaggttcataagtaagccaaaggttttcagtactattggctaagaaggggaggcaaacattgagctgcttgctgccacattttgcaatggttacaatcgttggtacacgggaacagtttgttcaaccacagtcgtgtctccgtgctacaatgcagctcaagtccccaacaaggccaaaactttccttctgctttacgccacaaggggattgcgatcaatactgtgctttaatccctggcttgccagaagacctggcaaagatatgccttgcccttgttcctcgaactcattttcctgtcatgggtggagtatccaagaggtggatgtcattcctagagagcaaagaattaattgctgtaaggaaagaggttcggaagcttgacgagtgtgtgtacgtcttgaccgctgacgctggagcaaagggttctcattgggaggttttgggatgtcaggggcaaaagaacacccctcttccgcctatgcctggaccaaccaaagctgggtttggtgtggttgtccttgatgggaagctcgtggtcattgctggctatgctgctgaccatggcaaggaatgtgtttctgatgaggtttaccagtatgattgtttcctcaacaggtggactgccatttctaagatgaatgttgctcgttgtgacttcgcgtgtgcagaggtcaatggtgtgatatatgttgctggtggatttggtcctgatggtgatagtttatcaagtgtcgaagtttatgacccagaacaaaataaatgggcgttgatcgggcgccttcgcaggccaagatggggttgctttgggtgtagctttgaagacaagatgtacgtcatgggtggccgttcaagcttcaccattggtaactcccgtttcattgacgtgtacgatacaaatagcggtgcctggggtgagtttaggaatggctgtgtaatggtcacggctcatgctgttcttggtgagaagctcttctgcatcgagtggaagaaccagaggtctctggcgattttcaacccagcagacaattcctggcagaaggttcctgtgccgcttactggtagttctagcacgcggttttctctcgggacacatgacgggaaattgctgctcttctcactggaggaagaacccggctatcagacactgatgtatgatcctgctgcgccaacaggctctgaatggtgcaagtctacgctcaggccatcgggatcatgcttgtgcagcgtgaccatcaaagcctgatgcttcagctcggggtcgctgaaggatgatacccaagttacttcctgccttgtcttccgtggttaagatcaggctttgtttggtttatcgttgggtcctacttgctagaatttacatccgcttgttgctccacccaataatagtatgttcttgcttcagttcattcggttgcttgctgacaatggaccgccataatgtactctgttctcagttgtattgaaaaactatt

SEQ ID NO: 75 - DNA, 5809 bp, Hordeum vulgare
ccctgcttcctcctcctccccctcctcctacctccgtctcctcttcgcccgtccctcccacggttgcacctcccctcggcttatcttaaaccccatcctccgttcctgcgtgctcttgccggggtagatagaggaggggttctccgagggagggcggcaatggcccccaagcatgccggccgtggcaagggccggggcggcggcggcaagggcgaccgcaagaagagggaggagaaagtggtgccgagcgtgctggacgtcgcggtcgccaccccctacgagtcccaggtgacactcaaggggatatcgacggatcgcgtgctggacgtgcggaagctgctggtgtcgaacgtggagacgtgccacgtcacgaactattcactcccccacgtggtgcgtgggcagcggctggaggacggcgtggaggtcgtggcgctgaaaccctgcgcgctcaccatcgtggaagaggagtacgcgacggaggaggccgcggtggcgcacgtccgccggctgctggacatcgtcgcctgcaccaccgccttcgccaaggcgaagcagcacaagtcctcgtccaagcacgcgcagcgccccgccacgcccccgtctcccccgcccgtctcctccgccggggccaatggcgtcggcgccggcgccggcggcgaggccgcgcccgcgatatcggcggcgcacgacatggtggccatcggcccgccgcccaagctcggcgagttctacgacttcttctccttcgcccacctcaccccgcccctccactttatcaggaggaaggagaggaatggcgctgcccaggacggcgattacttcgaaatcgaggtgaaggtttgcaacgggaagcttctgcacatagttgcctcggtcaagggattctacctggtgggcaagccgcacaccgtaagccggtccttggtggacctgctacagcagctcagcagtggatttgccaatgcgtacgaggcactgatgaaagcttttgtggatcacaacaagtttgggaatctcccgttcggctttcgtgcaaacacatggcttgttcctcctgtatatgtggattctgctacgaagagcccagctttgcccgctgaggatgagaactggggtgggaatggaggtggctgcggacgagacggaaaacatgaccgaagacgctgggcaagagaattttctattttggctagaatgccgtccaagactgaggaagagagggtgatcagagaccggaaggctttccttttacacaacctgtttgtagatacagcgattttcagagctgcgtcgacaatacggcgactggttgatactagtccgcaaactggtccgaatggttcgttactacttgaggaacgtgttggggacctccatataattgtgaagaaggatgaggctgatgctagtttgaagttggaggacaaagttgacggagttgccatctaccagacggatgctatggatatatcacaaagaaatcttctcaaaggtttaacttctgatgagagtgtcgttgctaaggactcttccacgctaggtgtggtgattgttaagcattgcggatatacggcaatagtgaaagtttccggacgcacaaagaacagcagcgatggcaaacaaaccagtgatatctctgatcatcttgatgaaatacctaacatcgatgtggatgatcatccagatggaggttctaatgccttgaatgctcacagtctaagaataccactgccgaaaattaccaacccagaaatcgctgccagtagccagcaccttgcatctaaaccacatgttgataattatgcgaggaaactagcatgtacggtacttgaaaccagcttgaggaagctggggaacaccccgaacaaaaatcctagacgtatcaggtgggaactcggtccctcctggctccagcacttgcagaaaaaagatgcttccgtctctgaggacagtgagaagaatgcaaaaaaatctgaaaaagattcatctgtcaaaggtctcggcaagcactttgaacaattacgaaaaattaaaaagaaagaaagcactactgaagatgctaagactgagaaggaagaatctgatagcaactgcctgacaaatggtatggaaaagtctgaaaatgtagccgttaccgaaaccaatatcgagactgaaataaggaacctgattacagaggatgctttctgccgcttgaagagtttggaagctggccttcatcaaaagtcccttgaagagctcacaatgatggcccataagttctatgatgatactgcactcccaaagctggtggctgattttgcttcccttgagctttctccagtggatggaagaacgatgactgatttcatgcatacaaggggactaaatatgtgctcattaggccgagtggtagagctagcagagaagctcccacatatccagtcaatatgcatccatgaaatggtcattcgagcctttaagcacgtcattcgagctgttattgcagcggttgatgacatgcaaaatatgtctgcggttatagctgagactttgaacattttactgggatctccaagattagaaaatgatcttgacacagatgctgatgagcataacttgcggctgaaatgggtagagagcttcctttccaaaagatactgttggacactgaaagatgaatttgcgcacttgcggaagcccatcattctgagaggcctttgcagcaaggttggccttgagttagtcgcaagagattatgatatgaatagcccaaacccgtttgacaaatccgacattgtcaacatagttcctgtatgcaagcatgtcgtctactcatctattgatagtcgaaacttactagaatcatcaaagatggctttggacaaaggaaagcttgatgatgctgttaactatggagcaaaggccttgtccaaagttatagctgtttgtggtccataccatcggctgactgctaatgcatacagtcttcttgctgtagttctttaccatactggagattttaatcaggcaactatatatcaacagaaggcccttgatatcaatgaaagggagcttggtcttgaccatccggaaactatgaagagctatggtgatctgtcagttttctactaccgtctccaacacattgagatggctctaaagtatgtcaaccgtgcactttatctacttcaattttcttgtgggctttcacatccaaattcagctgccacctacataaatgtggctatgatggaagaaggtatgggaaatgttcatgttgctctaagatatttgcatgaagcgctaaaatgcaacaagagattgcttggagctgatcacatacagactgctgcaagctaccatgccatagccatagccctctccatgatggatgcgttctccctaagcgtgcaacatgaacaaaccaccttacagatacttcaggagaaactaggagaagataaccttcgaactcaggatgctgctgcttggctagagcatttcgattcaaaagcattagaacaacaagaggccgctcgcagaggaataccaaaacctgattcctctattgcaagtaaagggcatcttagtgtatcagatctacttgactacataagcccggatcaggaaagaaaagagagggatatgcaaaggaagtgcaggcgtgcaaagaataataccagagcacaccaaggtgaatcagttgaagagaaggagaacttccagcatgactcaggatctcttcttgaagcagacaaaaaggattttcaagaagcaaaactggaagcaagccctcgtgtagtagcagcagtagcggaagaaacttatgctgtccatgatgagctgaggcaggtagatactttgtcacctgaagagtattctgatgaaggttggcaagcagctactttgaaagggagatcttcaaatgtgcggaagaaaagcatccgcagaagaccatctctcactaaattattggttgatcgtacagaagatggtcgcactccttctgctcataggagtggtgtacaaccacaagcaaaagagcataaagaagaagctgtaaactcccctagccaactatcatttggcaactttataagaagcgacaagttgaatggggatcctgtgattaccgaagacaagtcttctaagggcacctctaaatcagaatggaaggtaaagcctacaggaagtaagaggccaactaccatagcttcaaagttggtatcatacaaagatgtggcagtgtcaccgcctggcacagtgtggaaaccaattttggaacagaaggaagcaaaggagaaggataatgaacaagatactgatgcagcaccttcatccgaggaaggagatagaaagcttatagatgaagagaaggagaagtcaagtgatgagagcatcaaagagattgtctcaattcagccagaggaaagcagtcccacagagccagagaaagcttctgacagcaatagtgacggaagctcatctccgggcaagaaaacaagtggaagcaaactttcagcctcagcacctccattcaaacctggatcactcttatcagtgtcccatccttacagcacagtggcaatatatgatgctagcgttgtgcttcagccgattccaagtcaagcaatggagattctccctcatgctgtcgatactagagtaccccgtggccctcggtccaccttgtactatcgtactgggcattctttccaaaggaaacaaggttatacgcagagccagagcactattctgagaggcagcacctcccccccaaccatgaatccccatgctgctgagtttgtgcctggaaagactgtgcaacaagctgatttggctacagaggaacaagctaattctgtgactgatccagcaggtcagcagttggcatcacatgcttcagatgaagtgaaagtcgatgttcgtgaggctgacaaggcaggtcaagtggagaagacaactccaggtaaagggaaggaacgagcgaaagacgcgatgagagattcatacaaagcagaactcgcaaggcagattctgctcagcttcattgtcaagtcggtccatgacagcttaggttcgactcgacctcaaccggacagaaaaccaagcgggtcagatgaagctagtaacgaacagagcagcaacataaccaagaccgccttaagtccaaaagagttcgacaaacaaccgaaggccaccgaggcgcccaaaagcgagaaggatacagagggatttacagtggtttcaaagcgcagaaaaagcaagcagcatttcgtgaatcccataaacggtctctactcccagcagtcaatctgcacttcggtcagctgaggttgctgcacttcctgagatctgcaagcagtgcaacgtgttggaagatggtattgcttactttgctcttttaggcgcttggtagcagagttttgccctatattcagatgaacgagcatgttgtcaaactgtacaaagttttccgccgccccccctttccaatatttttttcgtaatttgaggtagcagaataaaatggtttcccccctccttcctatggatgtactatgttattatgacagaattataggatatagtagcaaacattcatttcctcccaacactccaatgatgctcctgaatttgctttgatgatttgcactcgtcaagtaccgctgcagaacgtagttttgccctatccagatgactgagcatgtagccaaactgtacaaatatttccccaattccattttctaatattttttgtaatttgggttggcagcagtgctgaataaaatgttttccccttcctgtgtactagtagttatta

SEQ ID NO: 76 - DNA, 2743 bp, Brassica napus
ctcctccacagcctctaaacctctctctctctctctctctgcttcgtcttcttcttcttaccttctacgcaggtttgtaatctgcaaaatcacctttcaatggcggcttcttcctcttcttcttctccctcgtctctcctcttaccgaacatcagtttccattccacaaccactcgttccgtttcaatccccggaatcttcctgcctagaaatcgcttgagacacagtcacactctcccgcttcgaatcagagcttccagagacgataatgtcgcagtggaagatcgtgaaaacgcagtgatcaacggaaacggaagcgtacgtctgaacggcaacggagctgcgagaaaatccatcaacggagatttaaacggaaacgtccctttaaacggcaacggtagtttggtgaagtacgtgaacggaagcgtaacggaggaagtctcgaagaagagagaagaagaaaagaggcagaagagagtagaagacatcggtcaagaggatgcttggtttaagaaaactcaacagaaacaacaagtcgaggtttctgttgcacctggtggtcgatggagtaggttcaagacttactcgaccatacaaagaacattggagatttgggggtttgttataacgtttatcttcaggacatggttgagcggtcagaagttttcatacaaaggggggatgactgaggagaagaaggttttgagaaggaaggttttggctaagtggttgaaggaaaacatattgaggttaggtcctacgttcattaaaattgggcagcagttctctaccagagtggacattcttcctcaagaatacgttgatcaattgtcagaacttcaggatcaagttcctcctttctcttctgctacggctttatcaattgttgaagaggagcttggagcatctgttgatgacattttcgaccgttttgattatgaacctatagctgctgctagtcttggccaagttcaccgtgcaagattgaagggtcaagaggttgtcattaaagtacagagacccggtctcaaggatctctttgatattgatcttaaaaacttgagggtgattgctgagtatctccaaaaggtggatccaaaatcagatggtgcaaagagagattgggttgcaatttatgatgaatgtgccagtgtattgtaccaggaaattgattacacaaaggaagcagctaattcggaactgtttgctaataacttcaaaaacttagaatatgtaaaggttccatccatctactgggagtacaccacgcctcaggtcctgacaatggagtatgtccctggaattaaaattaacaaaatacaagccttagatcagttaggtgttgatcgaaaaaggctagggagatatgctgttgaatcttaccttgagcagatcttgtctcatggattctttcatgccgaccctcaccctgggaacattgctgttgatgatgtcaacggcgggcggctgatattttacgactttggaatgatgggaagtatcagcccaaatattagagaaggtttactggaggccttctatggtgtttatgagaaggaccccgataaggtcattcaagcaatggttcaaatgggtgtgcttgtacctactggtgatttgacatcgatcagaagaacagcactgttttttctcaacagtttcgaagagcggcttgctgcacaaagaaaggagaaagaagaactagcagcagcagaagagcttgggttcaagaagccactaaccaaagaggagaagcaagagaaaaagaagcaacggttggctgcaatcggagaagacttattagccatttcagctgaccaacctttccggttccctgccacattcacatttgttgttagagccttttcagtattggatggcatcggcaaaggtcttgaccctcgctttgatataacggagattgcaaaaccatatgctttggaattgctacggttccgggaagctggagtagaagttgtagtgaaggacctgagaaagagatgggacagacaatcacaagcattctacaatgtatttagacaagctgatagagttgaaaagctagctgtaatcatccaacgacttgagcaaggtgatttgaagcttagagtccgagcattggagtctgagagggcgtttcaacgtgtagcagctgttcaaaaaacagtaggaagtgctgttgctgcaggaagcttagtcaatctcgcaacgattttgtatctgaattctttaaaaacaccagctactatagcatacacagtatgtgctttcttcagcctccaggttctgattggagttataaaagtcaagaagttcgaccaacgtgaaaaactgatcactgggacagcttaaaagaaatcttgtttgatgtattaaaaaaacttcttcttcagtctccataaaatcttttgtgctaagaagccacaaagatttctcccataaagctttccgtaggagtgatgatgatctcttgttctgccatagaaaaaatcttatggaagctttagaggctagatatgttaaaaccagtgaacgaccagactcatctctctctttttatttctttctgaaagtttttgattattgggcattttatcaacagagccacttgtaatggtgtgtagagatgtagacattaggtcaactttttcgtcaaaatatatgtatatataaaaaaaaaaaaaaaagggcggccgcgtgagagtatccaaacttacgtacgcggcatggctcacttcagtta

SEQ ID NO: 77 - DNA, 898 bp, Brassica napus
gatcacaattccttttttaaaaatctcctcctagcttcttcctcttcctcctcctaaaagagaccgaacacatccaagatggtcttgtgggtgttcggatatggatctttgatatggaacccgggtttcgattttgatgagaaactcattggctatatcaaagactacaaacgtgtcttcgatctcgggtgcattgatcatagaggcacgcctgaacatcctgcaagaacttgcacgttggaggattccgccggagcaatatgctggggtgcagcttattgtgttcgtggaggacccgagaaggagaagctagcgatggagtacttggaaggaagagagtgtgaatacgactcaaaaacactcgttgagttttacacggaaactgacaccaccaaacagtccaaaccaatcttgaccggagttatagtattcacgtcaaccccagacaaagtgtcaaacaaatactacttgggccctgctccaatggaggagatggcgatgcaaatcgccacagcttctggaccttgtggaaacaaccgggagtatctttttaagctggagaaagcaatgcacgacatagagcatgaggatgagtatgtgattgaattggcaaatgaggtcaggaaacatctcgacttaccaaaggaagttaaggcattgctgaaacctgtggtttctcgtgtatccatcaagtctcattctcaagctcatgtttccactcttcaacgagtctttgcatcatgagagtcaagcaaagtcatggagctaaccaacaagttgatgaagagtttttacggatgtgacttttaatttatagttccacttttatttgttttcacatttgaactttcaaaagtttcgactcagaaaacagacctttatatatttctttactctg

SEQ ID NO: 78 - DNA, 3264 bp, Brassica napus
gattctagtgttgtagagaagagagattcattttgtttctccaagttcatagcctcaccgattcgctctatgatctgattgtgaatctctctctccgtatctggtgatgagtgtgtgtggatgaatgttatggaaagagtgggtgaagaaacagtagggagtaacaacgtgcaattgaaaggaggaagagttgatgatgttccttgcactacgcttcatactgaatcagatgctgggaggagcgattgtcctggaagctcagctcctccaggggataagatctccgttgaagagctgacttatagagctgctgttcaagggactagtcataatcatatggagagttctaggcccgctggcaagtttgagcatctctaccgtctcggctcttctgcgtttaggggaggagatgttgattctcagccacgtgatgtggatcagatgctgtcgaggatcaggcagcagctcgcgggagctccttccgagaggcagaacttggtgaagccttttgtgaacaagaggagcgatcagaatcttgaggctttctccgagcgtctgagagcagctggtggagagaacagcgtggggcttgcgtggatcagcgacggtgtccagttgaaaatgactccgttgagttcttccagtttttctcagctgatacttaaaagagctatgaaggggaaaggcgtggttggtaaacaccaggatgctccccctcctgagtttgtttgtgagcaagatggtgtttgcaaggataaaaagttggatattagcagcaagtcgcctgttgctcaagaaccgatcccgaaaggtaatgggattgtatcgcatggtcaagggaatcatactaataactcttcttctagtggaatcagtttgagggagtttattagatcgagttatggtaaacgagagaaacgacacagcctttctctatttaggcagctggtggagctgattggctcagctcattcgcaaggattgtttttgcttgaactgagaccatcacttttcgctttggtcccgtcgaagaaacttagatataatggtactttcggaaagagcaatgtagagtcggatgttgacgaagatttgaataggaagaggcacgtggttcaggaatcatctgttgtgggtagggatttgaagaagagaagaatggacttgaacgctccagggaatcaacttcttcaggccactttgactgggagaccttgcaaaaggaaaagtcccttgattgatttaaacgtggttgatgtacgtaatccagacagttgtgaacttcaacagcaaagctatatgaaaaatttaggcgtgccttcagtgacgagaaaacagtccatgtccacttggctagaagagcaatggtacacttgtccagaggaaataaatggagaagatatcggagaaaagtcgaatatatatgctcttggtgttcttctatttgagcttctatgccattgtgagtccagtgagatgcatgctgcaatgatggcagatttacgtcatcgtattctcccaccagcatttctctcaagatacccaaaggaagctggattttgtctttggcttctacatcccgagccttcctcccgaccaacagctagagaaatactgaagtctgagttgatatgtgtggaggattcagttaaatcgactgcggctgacgaggagatatctgagctgttacttcattttttgtcttcacttgaaaagcagaagaagaaaaatgcatctaagcttttgcaagacatccaaaccttggaggatgatatcaaagaggccgagcgaagatattcttcaaaagcatcgctggtgagatctcatgaaattattgaaagcaaagtgcaatcatctcccataggcgagcgctgtacaacaacttctggcgccttgtttgtaccaactgctaatacagacaggctgatgagtaatattcgtcaacttgaagaggcatatttcttcatgaggtcacaaatgaagttatcggattctgcggctagtgcccgttctgacaaaagccttctaaaggacaaggacaagtggtctgaaaaccaaaataaagatcaggatgcgagaaccaaaggaaaatcgtcagatcaacttgaagtgtttttcgaggggttgtgcaaatttgctcggtatagcaagttcgaaacctgtggaacaatcagaagtggagaccttttaaactccgccagtgtggtctgctcattgagtttcgaccctgatgaggaacacatagcagctgctgggatatcaaagaaaatcaagatttttgacttcaacgcatttatgaatgaatctgtcggtgttcattatccactagtggagatggtcaacaaatcgaaattaagctgcgtttgctggaatagttacatcaaaaactacttggcctctactgactatgatggtgtagtccagatatgggatgctgggactggacaaggattttcccaatacacagaacaccagaagagagcctggtcagttgatttttctccatccgaccctacaaaatttgtcagtggaagtgatgactgttcagtaaagctttggagcgtcaatgagaaacggtcgttaggaacaatctggagtccagcaaatgtgtgttgcgtgcaattctcttcatattccaatcatttactggcatttggttcagctgattacaaggtctattgctatgatcttcgttacgtcaaaactccttggtgcacattggctggccacgagaaagcggttagctatgttaaattcatggattcagagaccatcgtcactgcttccactgataactctctcaagctttggaatctcaacaagacaaattccactggtttgtctactggtgcttgttcaatgacgtataaaggacatacaaatcaaaagaactttgtcggattatcggtcttggatggatacatagcctgtggttcagagaccaatgaggtatatagttactatagatccttaccgatgccaatgacttcatacaagtttggatcggtggatcccatatctgggaacgaatactttgatgacaatggacagtttgtgtcgagcgtctgttggagaaaaaaatcgaatatgcttgtagctgcgaattctaccggaaacatgaagctactaaaactggtttgacatttgtgggcgagtgagttcttttggaaaacaaatctctcaagtctgtatctaagacaacagtttgacttgaacctacgtttttgtcctggaaaacgttgatccctatatgaccgtgacaga

SEQ ID NO: 79 - DNA, 2236 bp, Brassica napus
cgggacgtgcgcatcgtatagtaccggtccggatttgccggatcgacccacgcggccggcaacagcatgaaggattctgaatccagtgggcgatgtgtggaggaatcagagaggagagtgatttggggtctgtgattggactctctttctctagtcatgtttgattgggacgacgaagagcttactaatatgatatggggtgacgagggagagacagacgaccatattgtgccttttaaagtaagaaacaggaaggaacaaggcgatgaatctaataaggcagttaagccagctgaaagtaaaactcaccttcatgatagtaagctgggggggagcagttcagggcaaaatattgagtgtatgagctcatggcctgactcatcagtatctaatgctagaaaagctgatccaggaccagattcgagtgagccagctagatatgattcaacaagaagtgagaaagcgtctgaacttgcgaaaggccctgatatttttcatagcactgatgagagtaaagagcaaggtgatttcgatgagtatggatgggctaacattggtagctttgatgatcttgatcgaatgttcagtagtgatgtccctatatttggcgatggcactctcagcggtgcagatgagttatggtcttcttctaaagatgcatccaagccgttaccatccattttggactctcaagatctaggattggatattagaactgagtttgagcaacaagagaaccagcagtttccattgactggagaaaccaatggtccatcatcccaaagtgcgcctagagttcgtgtaaccccaaaagctgagcaatatcatgagcataagagacaatcctcagttgatgaccagccatatcaacaaaacaaaatgatgaagttctcggaaatgttggggacttgtgaggcaggatcatttcaagatccgtacggtcagaggactctgtccaggagaaaatttgcaaaccagttgggaccgtcacgatcatctatgatgggtgttaatctgcagagtgagtctcaagggtctgggacatcacattatccacatatgccaaaccaatacatggctacttctggttttggtaatccatattctgctgtgcctgtagtttcagccttccaacgtcctgatgttaacaagaatcagctgatgcatccttcctacaaccctgcttctgctatctctgcaaacacggtaacagatgtctgtgcacgaccttcaacaatgacgccgcaggaaaaactagaaaaacttaggcgcagacagcaaatgcaggcgatgcttgctattcagagacaacaacagcaatttcgtcaccaggttcctgtagcagatcagtccattactcagcttgtcgacaaaactagtcttcaagggctaactgcaataccttcctttgatcccaattcatctctggaactagatgattctggaaactttgctgctgctgttgataatccatcagaattctcggttctttatcggcttcaagatgttgtagcaaagttagatatggaaacaaggacttgtataagggatagcttattccgtttggctgatagcgcaggtcagagacatcacactagtgatacaccccacagtaataagagtagccaagatgaccgggaggttattcctcaagaaaaatccagatatagatatgcagggatgctagacacagaaacagtaaccaatcccacagacagaactgtggctcatttgctctttcataggccttttgatatgtatgcggcaaagcatacggaaggactagaatcaccatcttcttcgaagatgggagctgaagtaaaagggagttttcctagcacaagagagagtcgcatgattaagcagaaggcaaaagaggaagatgtacctgcaggttcacttgctttagggtatgcatccaactcaggatccagtagcactgttgctgagagggttgttgaagcatcccaaggaaacaaaagaaagttgtgaagtatagaagtttaggtttgcggtgttagagaggagcctgaggaaatctgcagcgtaggcaacatctctctgcattgctagaaacaatctcctgtttactcctttcatgtaattagatgtttttttgttttgttttaattgttgaataccctttcttattacacatatttccatgagaaaacattttggaaaactcatgtagtttgctcttacaatttcctttttaaaaccagatttgatctct

SEQ ID NO: 80 - DNA, 1768 bp, Brassica napus
gcacacttggaaaaattcaaacaatggcgttgcttgtggagaagacgtcgagtggccgtgagtacaaggtcaaggacatgtctcaggccgacttcggccgtctcgagatcgagctggccgaggtcgaaatgcctgggctcgtctcttgccgcaccgagttcggaccttctcagcccttcaaaggcgctagaatcaccggttctctccacatgacgatccaaaccgccgttctcatcgaaacgctaaccgctcttggcgccgaggtcaggtggtgctcatgcaacatcttctccacgcaagaccacgcagccgccgccatcgcccgtgactccgccgccgtgttcgcatggaaaggagagactcttcaggagtactggtggtgcacggagagggctctcgactggggtccgggaggtggtcctgatctgatcgttgacgacggtggtgatgctactctcttgattcacgaaggagttaaggctgaggagatctttgcgaagacgggtcaggtccctgatccgagttctactgataatcctgagtttcagatcgtgttgtcgattattaaagatggtcttcaagttgatcccaagaagtatcataagatgaaggagagattggttggtgtttcggaggagacgaccactggtgttaagaggctttaccagatgcaggagactggagccctcttgttccctgccattaacgtcaatgactccgttaccaagagcaagttcgacaacttgtatggatgtcgccactctctccctgacggtctcatgagaaccactgatgtcatgatcgctggaaaggtcgctgttatctgcggttacggtgatgtcggaaagggttgtgccgcagccatgaaaacagctggtgcacgtgtgatcgtgactgagatagatccaatatgtgccctccaggctctcacggaaggcctccaagtcctaacccttgaggacgtcgtctccgaagctgacatattttgcaccaccactggaaacaaagacatcatcatggtcgaccacatgaggaagatgaagaacaacgccattgtctgcaacattggccactttgacaacgaaatcgatatgcaaggacttgagaccttccctggtgtgaaacgcatcaccatcaagccgcagactgataggtgggtgttccccgacaccaagtcaggcatcattgtgctagcggagggtcgtctgatgaacttgggatgcgccactggtcacccgagtttcgtgatgtcgtgctcgttcaccaaccaggtgattgcgcagcttgagctatggaacgagaagtcgagcgggaagtatgagaagaaagtatatgttttgcctaagcacttggacgagaaggttgctgcacttcacttgggaaagctcggtgctagactcaccaagctcaccaaggaccaatctgactatgtcagcatacccattgaaggtccctacaagcctggtcattacaggtactgagagaacaaaggactgagcgttcttcgtgtggtttaaaggagaaggccacagaaatccatcacacgggcgcccgcgcgaacaaatgtgagatattggtcttctgaggaggttgaccaaatatttgtatgaataaggaattgttgttcttggttttgagaggcttgttttttgttttatattttctcaagataaattagtttttgttttacactgttgttaggcttacttatgcgatgttctgtttaccagttaacttttcgaacaagtgatcaaacaagatatgtaaa

SEQ ID NO: 81 - DNA, 763 bp, Brassica napus
acacgcacacatagaccaacaacaacaacaatggctatatcaagaacattcatgtcctttaatctcttcatcttcttcctcgttattgctacaaccaatggtcaggctccagctccaaccccttcaggtccaaccaacataaccgcagtcctagaaaaagccggtcaatacacaatgttcataagactcctcaagagcacccaagcagcagaccaaatcaacactcagctaaattcttcctcgagccaaggcctaaccgtgtttgccccgaccgataacgcctttagcagcctcaaatccggaaccttaaactcattatccgaccagcaaaaagttcagcttgttcagttccatgtccttcctacactcttaaccatgcctcagtttcaaactgttagtaaccccttacgcacgcaagctggtgatggacaaaacggtaagttccctcttaacatcacaagctccggtaaccaagtcaacatcaccaccggagttgtgagcgccaccgtggctaactccgtctacagcgataagcagctcgccgtgtaccaagtggatcaagttttgctgccattagcaatgtttggttcaagctcggcggctcctgctccggcgcctgagaaaggcggctcggttacgactggttcagcttccggtagcgacggtggaggagattctactgattcatctgatgcagagaggatcagatacgggataatcgccaccgtggcagccattgctgcttcttctctgtggatataac

SEQ ID NO: 82 - DNA, 3273 bp, Gossypium hirsutum
gcctctgcattgcatcactctgctatttttgattttcagctttcgatcctactgctcgttacttatcacgccgtatcatctcatcttttctctctctgtttactttggtgagaagcagatatttgttttaaagctatccgtttagcggaaatagataacgttatcgccgctattttccgttacaccgcctattgagatctttatagcggcggacggtgccgatattgcaaaatagcgacccgcggcatcgatatttgaaacactgccaatacgatggcagttaaaaagcggaaagagagagccgttggcggtgaatccggaaacagcaagaagttcaaaaagtattccaactccaaaggaccgatgaagaaaaacaagaacgatacgagaaagaaggggaaaggtcctcgcttgccttctgcgctacgaacggagcttgatcgcctggaccctaaaatagcttccgatagtgatgacggtatcgatttagatgttggaaacgatgtttatgagtatgaggaagaagttccacaagaagagtcccggaagaaccgccgtttcgatcctgtcgagaactatgagtatgagctacctgaggattttgaggatgagaatgtaccatcagatgacgacgacgatgatggtgactttggtgttggtgggaacaagggtagtctaaatgatgatgttgatgcgagtgatggggatgaagaggaagatgatgaaaggcacttgaggatgttgcaaggggtcactggaatgtcaactgatgcctttggaggcaagaagaagaggaatagtgtggttatatccgaggcacatcctgagtcagaatacaaccctactcgtgatgttcttgagggtgacagccacattacacttcaagatcttttggatcctattcaaggaaaagcggggtatagcaaacttagaaaaagagtgcaacacatggacagaaagtctacatctgttcaagctccattgccgaaggtagatagagagaaattggagaggatggcagtttatgaacattcaaagaaagatattactaagtgggagcatctggtcaaaaggaatagagaagctcctactgttttttttggtggagatgtagacttggggttttcaactgtaggggcaatagcttctgaatttgagcctagaactgagtttgagaagaaaattgcttctttggtttatgatgacaaagttatggaagctcacaaagcagatggttccaaacttctggagttaaataagatatctgaggaagattatatgaagcaccaggatcatgttgctaaaatgcgcggccttcttttccgccatgaaatgaagcagaagcgcataaaaaagatcaagtccaaaacctatcatcgtttaaagaataaggataaactgaaagtggaatctgcagaaatgctgatggatccagaggcagccaaagagcaggctaggaagcaagagttcaaacgagctgaggagcgaatgactttgaagcacaaaaataagtcaaagtgggcaaggcgtatcttagaacgaggtttgaatgcccaggatgaaggcactcgagcagctatggctgaacagcttcaccaacatgctcttttgacaagaaaaattaacactgttaaagacagtagtagtagcagtgatagtagtagtgacgatgatgatgagggttcaaacgaggatagggcatctgagttgctagaaaaagcaaaagagaaaacgctgaaagtattagaagacgatgaagaattgcctaattctggagttctttccttacctttcatggttcgtggactgaagaaaagaagggaagaagcgattgaagaagctaagcttgctcttcaagagtatgagcaattggagggtacaaatgatgcagaaaattcaaaaccagccactgcaagtggtagaagggtctttggcagggcaaataatgaagttccagattctaacaagaagaccaaaactgataataagatgaaaatggataattattatggtaatagtgatagtgaagacgatttgaaagccaaagagaatgttaacattgagggcggcaaaagaaatgatgttgagaaggatgttggccctaattatgatcgtaaagaagcagctgatgtttccatattcaagaattttgatgacaatggagaccctggttcaaaaacaacatatgaagttgctatttttgcttccgactcgcggagaaagatgaaaagtgagaatggaattgataaaaatgcgaaaaagttgcaacaagtgaaggaagctattgtgcataataaagacatggaggagggagaagaggatagtgattcggagagcaaacaaatggtggatgggattttgtcctcagcccccaaggaatcatatgaactcccttctcagtcagaactcattcgacatgcttttgctggggacgatgtggaagaagaatttgaaaaggataaacaggaaatcctgaacgaggaaaaccctgaaccggataaacctgttttgctccccggttggggccaatggactcatgtacagcaaaaaaaaggtttgccttggtggatgcttaaggaacacgaagacgctaagcgaaagagggaagaaagtcttaagaaaaggaaggatgcacagctcaagcatgtcattatatccgaaaaggtggataaaaaagctgagaaattgcagacaaaatctttgccctacccgttcacatccaaggaactttttgaacaaagtatgcgaatgcctattggatcagaatctaacccggagacagcaatcagaagtcttaatcgaccagaagtggtgaagaaacctggggtaattataaaaccaataaagtttgtggagatgcatcatcacgaaaaatccgaggataacaaacggagtgggcagaaacagaagaaaaataaaagcaaaggtgccagtggcaagaacaagaaacagagcaactaaatctcataaattttggctgaaattaggtgtagaaaatttggctgtaccaccttgttaagtggtgtaaggaagcaaaacaaactgcttttccaggcaaaggtaattgagaaaggcagtttaaacagccgccgtacgttcctacacttttggaggcaattttacgatgcgagtttatatttatataagttatattttgctattagtttattcaatttgatcttagtttttgtattctaaaattttgaaatatcaattttgattctaatgaattttaattgtggaattttatacataaaatattattttaatttg

SEQ ID NO: 83 - DNA, 2485 bp, Gossypium hirsutum
aaagttcagttgaagagaaccacaaggtgctagatgagaaaaggactttgatgaagtttgtttcagacttgggcaaggagaaacacaatctagaagaggaaaactgcgctgtctttgctgaagcagtatctcaaagtaacatttcgcttattctcaaggacattattactgataattttgttgaaataaagcatctcatggccaatctggataaactcaaatgtttcaatgatgatcttgagggaaaactgaggataatggggatcaagtttgaagaaacgcaaatggtaaactcacatctcaaggataaggtgcagaacttggagaatgagctagtttcagttaaatctgtttgcaatcagttaaatgacgaagtcgtgaagggaaaggatctactatgccagaaggagaatgagcttctggaagcagggcagctgctcagtgcaactcaagaggagagaacccaactgcatgaagttgtggaggatctgaagactaaatatgtggaagtcaagctgataggagaagatcaaaagaagcaaattctgaaactctctggagactatgatattcaaaacaaggagattgaaagcattcgtcaggctaatcagagttttgaggctgagttatcaaaattgcatgaagaacttgaagaatggaaatgtagggaagagagtttgtgtgttgaactacaaaagggaagaaatgaggttgaactttgggagactcaagctactgcattgtttgatgagctacagatttctactgtccgtggagcattgcttgaggagaaggcttgtgagctcagtgcagaatgtgaagtccttgaaagtagaagcaagtccaatgctatggaagcagaagagctggaaaaaagtgttagaatcttggaatgtgagaatggaggacttaaagctcagttggcagtatatgttccagctgttgtttctctctcggacagtgtgacatctttggagagtcgaactctcttgaatcctaaacttaccacagatcataaccaagtaaagaacgccactccggggactgacttgcatgctgataactgtcaacaaacaaatgaagttcaaattgccacagttccagatggttgttctgacttgcagggtatcaacatgagaattaaagctattgaaaaagcagtgttggaaatggaaaagcttgcaatgacggaaaacttaaatctcagttccaaactagagactgctatgaagcagattgaagatttaagaaatggaagcagctcaggtcaagaaaatgttggagaaaagaggcatgtgaatgataaacaaggactggaacatggccagggactcggtaacaatgtcaaaacgcagagactaatacctgaaatcattgaagaggacaatgagatgatgacaaaagatattatgcttgaccagatatctgagtgctcatctcatgggttaagccggagagaaacttcagaggctgatgatcagatgcttgggttgtgggaagccagtgaccgtgatggtacaattgatttgagtggtgataaggcccagaagattgtcacgggaccatctgaccatcaacaaattgatacagtaaaggtacacaagggcagtcagcactctacgaaatctcatgtcaaggagttgggtgtagataaagagaaatctaagagatatacagagccaaaccaagaagaaaagaagaggaagattttagaaagacttgattctgatgctcaaaagttggctaatcttcagataactgtgcaggacctgaagaggaaggtagagataactgagaagggcaaaaaggggaaaggaattgaatatggtacggtaaaagagcagctagaagaagctgaggaagctatcacgaaactatctgattttaatcgcaaattgatagtgcatgctggagacccttcacggtcccttcttgatgggaaacctgcaatagattcggatgggagcggaagtggtaggaggcagcgaatatcagaacaagctcgaaaagggtcagaaaagattgggcgcttgcagttggaggtgcagaaaattcaatttctcttattgaagcttgacgatgaaaaagaaagtagaggtcgaaccaaaatcaccgaacacaaaacaactgttttattgcgagactatctttacggtggtgtaagaaacatcaagaagaggaagaactcactcttttgtgcatgcgtgcgaccccaaactaaatgagatcgaggcaattaatcatgggcacataatcagtgtagtttaccgataatgagactagttgcattgtcaataaagttcaccttcctagttttgcatttcacatatttaatgtcttagagaagctttcatcttctttagtttcgagatcctgctgtatatttcaggcacatcaaagtgaaaagaagctgcacttttatagcctaaaaacttccttttatttataaatttaccttggtataaatcctggatttcattagaaa

SEQ ID NO: 84 - DNA, 1564 bp, Gossypium hirsutum
ataaaaacccatcaaaaacagatcaatttttcatcatctcttcgtcaactcaaagaaaaaattgagtgtcagtttgaaagtgttcttcagatatggctatgaaacaagttgctaattctgctatcaaagcaattgccaattctgggtcatcctctcttcttaccagacaactccatgcttctccagggagcaaaaagattgttggggtgttttacaaggccaacgagtactttacgaagaatcccaactttgttggttgtgtggagggagccttggggttgcgccaatggctcgaatcacaggggcatcagtatatcgttaccgacgacaaagaaggaccggactgcgaacttgaaaagcatatccctgatctccatgtgctcatatcgaccccattccacccggcttacgttacggctgagaggatcaagaaagccaaaaacttgcaactgcttctcacagcagggattggctccgatcatgttgatcttaaggcagctgcagaagctggtttgactgttgctgaagttactgggagcaatgtcgtctcggttgctgaggatgagctaatgaggattcttattcttgttcggaatttcgtacctggttatcatcaagttattactggagattggaatgttgcaggcattgcttatagagcttatgatctcgaagggaagacagttggaactataggtgctggccgtatcggcaagctcttactccaacgattgaaaccattcaactgtaatctcctatatcatgatcgagtcaagatagatccagaattggagaaacagaccggagctaaattcgaggaggatcttgatgcaatgcttccaaaatgtgacattattgtcataaatatgcctctaactgagaagacaagagggatgtttgacaaagatcggatcgcgaagatgaagaagggagtcctgattgttaacaatgctcgaggagcgatcatggatactcaagctgttgctgatgcttgttcaagtggacacattgcaggttacagtggagatgtttggtacccgcaacctgctccgaaggaccatccatggcgttacatgccaaatcaagctatgactcctcatatttctggtaccaccattgatgcgcagttgcgatacgctgccggagtcaaggatatgcttgagaggtacttcaaaggtgaagactttcctgaacagaactacattgtcaaagcaggtgagctcgctcctcaataccgatgatttcgtggtttcttcgtccatgaaagagagtccaaatgtgttcggttggtagttaaacgtagctactattgaaataatgtgatgtttagtatgttgcaaataatgtgccatctatatggtgctttgaacttgatgttacgttgtaatgagttcagcttttgatggttcatctttttatgagtggtggttgtcatccaatgaaggagggcctctatgtaccttttcgtttttcttcaagtatcttcataataataattttttgtgaaaactttgaaatacgaatatccgaaataggatatataagttaaaacgtgggttaaaaa

SEQ ID NO: 85 - DNA, 5588 bp, Gossypium hirsutum
aaatccaatgacattactcaaaaatacccttcccttatcttatcatctcctctccatacccttattcactctctaaaaacaccatcccttttctttcttctgcatattttcactcattactctcctatcatctttacgtaaaccacattattttggacttcaaattaagcttttcagctccattttcattcaagtttttgaatttgggtttttattatatctgtagccttttctttttccatataagaaatggccccagggtcagggaaaagcaagtcaagtaaagcaaaagctgagaagaagaggaaagaggagaaaattgttccttatgttcttgacatcactgtcactactccttatgaaactcaagttgtgctcaagggtatctccactgacaggatacttgacgtaagaaggctgttggcttctcatgtggagacatgtcaccttacaaactattcttttgctcatgaggtcaaagggaagagattgagtgacaaagtggagatggttaccttgaaaccatgtttgctcaaaatggttgaagagaagtatgcggaggaagccgaggcggtggctcacgtgcgcagactggtagatattgtagcatgcacctccaggttctcgaggcctaaacgcccccgatcacaatccttatcagcgccgtcagattcaaaagccgaaaaggtcaataggcccaacaacagcgctcttccacctgcgccctcggatggcgaaacgacgccaattccggagaacttggacatggctgccattcatcccaccccgaaattatcggaattttacgatttcttctcattctctcacctctctcctcccattctcaatttgaggaaatgtgaccccaaggatgtagaagggtggcgtgacggtgactattttgtaatgcagataaaaatctgcaacgggaagttgatacaagtggttgcgtcagtaaaagggtttttcactgttggaaagcacttcttccagagccactctttgttagatcttttgcaaaacctcagtcaagcctttgccaatgcatatgaatcccttatgaaggcatttgtaggacacaataagcttggtaatcttccctatggatttcgggcaaatacatggcttgtccctccccctgttgctgagtgtccagcaaacttcccctctttcccatcagaagatgaagaatggggtggtaatggtggaggtcagggaagaaatggtgaatatgatcttcggccatgggctacagatttttcaattttagccagccttccttgcaaaaccgaagaggagaggattattcgagaccgcaaggcctttttgctccatagccagtttattaatgtctcaatctttaaagctgttgctgcaatacaacatgtcatgaattccagattaaatgtcaagggccatccagactccgtccttcatgaggatcgcacaggtgacttgtccattttagtaaaacatgactcggaagatgtgaaacttgagtgtggggtaaaggttgctggccatcaatcatctgacatgactaccaatgaaattgctcgaaggaatttacttaaagggataactgcagatgagaatgtagttgttcatgatacttctgcattgggcactgtcattgttagacattgtgggtacactgcaattgtaagtgttgttggtgatgtgaagaaggaaaaatctggtgctccggatattgaaattgatgatcaaccagatggaggagcgaatgctcttaatattaacggtctaagggttttacttcacaaatccagccctgcggaagtaactggtggaggacagtcaaatcagtccaacttgattgattccaaatcttctagatgtcttgttcagcgagtaattaaagagaacttgacaaaattagaggagaactcagctgcccctgaaaggactattagatgggaacttggttcttgttgggtgcagtatctacaaaagcaggaaacttcaacagatgctacttcaaaaggacttgcaaatgatcaggaggctgaagctgctgtcaagggtcttggaaagcagtttaaatttttaaagaaaagggacaaaaaaccaagtaatatcagtagcacagttgagaaggaagacaatgattctgagttatgcagtgaggatgtgaagtccaatctaggacaggaaggcaacgttgagttgagcagtgagatgggattgaagcacctgatttctaaagaagccttctcacgtcttgaacaaagtggaactggtcttcacttaaagtcagctgaggagcttattaagatggcatgcaagtattatgatgaccttgctttaccaaagctggtaacagattttggatcgcttgaactttctcccgttgatggttgtacgctaactgacttcatgcatttaaggggattacagatgcactctttgggtcgtgtggttgaactttctgagaagcttcctcacatacaatcacttcgcatccatgagatgattactcgagctttcaagcatgtagtgaaagcagttgtggcatcagttgagaaaattgaggatttacctgtggttatagcttcaaccctgaatttcttacttggaagttgcggagtggatgttaatgcctcaagtgcaaatgatgactatttaatcaaactgacgtggttaagaaagttccttggagcaaaattcggttggaaactgaaagatgaattccaacatttaaggaaactttctgttcttcgcggactttgctataagattggtctagagttggttcctagagattatgatatggaatgccaagaaccgttcagaagttgtgatattattagcatgtatcctgtttgtaagcatgtaggatgctcttctgctgatggtagaacattgttggagtcatccaagattgctcttgacaaaggaaaactagaggatgcggttaactatgggacaaaggcattgacaaagatgaaagctgtatgcggtccttatcatcgaacaactgcgagtgcttacagtcttcttgctgttgttctctaccatactggagatttcaatcaggcagccgtatatcaacagaaagctttggatattaatgagagggagcttggtcttgaccatccagataccatgaaaagctatggggatctttctgtattctattatcggctccaacacatggaaatggctttgaaatatgtaaaccgtgccttattccttcttcattttacttgtggattgtctcaccctaacactgccgcaacatatataaatgtggctatgatggaagaaggcatgggaaatgttcatgttgctcttagatatctacatgaagctcttaagtgcaaccagagactgctaggagctgatcacatacagactgccgcaagctatcatgctattgccattgctctttcattgatggaagcttattcattaagtgtgcaacatgagcaaactacactcaagatacttcaagcaaaactcggaccagatgaccttcgtacccaggatgctgctgcctggcttgaatattttgaatcaaaagctctagaacagcaagaagcagcacgaactggaactccgaagccagatgcatcaattgcaagcaaaggtcatcttagtgtatcagatctcctcgattacattagtcctgatcaaggttctaaaggaagcgatgtgcagaggaagcagcggcgttccaaggtgttacagattagtgataaaacccatgatacacatcacaacttacaaacagatggtgctgtgtttattgatgcaacagataaagctacagcaactgtggatattaatgaaataggtaccctgacttctattcatcccgaagaaccagaggaaaccgataatatttctagtattgaggcaactgttacaactgaagttgttgaagatacaactttagatgaagggtggcaagaagccaattcgaaaggtcggtcaggaaatgccactggaaagaagtatggaaggaagaaaccagtttttgcaaagctaaaggtgaatggttgtgaatattcaaatggtagagagagtgggagtaggcgagacattatctcaccagcaggaaaaactgtcccgaagaacattataagggaaatgcaaacagtaaagcaatccaagtcttccagcttgaatcctagagggacttcaattggtttacctgcttctgtttccagaggttcctccccttcagcaaatcttagtgccattgcttcaaaatcactttcttacaaagaagtagctgcggcacctccaggtacagttctaaagccattatcggaaccaagtgagggaaaaatggaacagtcaatgtgcgctgagacagcaaatgtagagcatgggaacaacatctctgttgtcgatgatgtagtggatgacaatggtgaaactgaaggaactcatgatacagaaagtcagtcggaagaaactgctcctgaaattgataaggtgtcttcttgtagtcaggaaaaaggtttagaagcaaagcggagtaagctatcggcatcagctgaaccattcaatcccggagcactctatcaccctttaaactcagtttctgttacatgtgtctatgatgtaacagctagtcaaggcatgcttgttgagcctgttgtacctccagttgctgctcgagttccttgcgggccaaggtcgccattgttttacagaaacaataattcttacggtagctttcttagataccaaactcctattttggaacaaaatggatttggatctccgagagttatgaaccctcatgcacctgagttcgttccaagcaaaatttggcaaatgactggaactggtgatttgagtggctctgaagaagctatgaacacagaagtgaaggaagttgataagaagttgagtagggaagttaacggttctaatccaaaaaagagcagcgcagaggagaaatccgagctggcaaggcagattttgcttagcttcattgtccggtccgccaagcagaacatggatggtgaatgtgaggctttaatcaatgacaaaaggctcaaccattcccaaaactcttcggatgcagttacaagcgacactgcaataataaaaattctatatgggaatgaaggaaaggacttggattctcaatccagtagcaatgaagaaccaaaagcgttggatataaataataagaaacccggagatggcgaaggctttacagttgtaaagaaacggcggaaaaacaggcagcagcttactaatgaagtcactgggctatataatcagcaatccatatgtgcttctgtaaggtgaagaaataaccttaggaaaataacagtgtaagtgtcatcatgttccatttccagttttatttattatcatatccttgcttccatattaacaaagcaatttagagtgaagcctggttctttagttcctacttattttgagaacagcttggtgttatgctaataatctctgcaaattggttctcttgtttagagattttgtttgatcaataaaacggccaattcgtaatttcatacttcaatttttcattttggagtatttttgtagttttatggaaatactgtacccgggccctgtac

SEQ ID NO: 86 - DNA, 1094 bp, Gossypium hirsutum
tcatcatcaaaagttgaagaaatcattttaatattgagcagcctgttcaacaggttggccagcattagatagagctcccttgcaaataattgaagcagctaacaggaaatattgagatagaaaagaaaaaggatagggaaactatgacacacttcgttctagttcatggtatgtgtcatggagcttggtgttggtacaagattgtgtcgctgctcaaatcaggcggtcaccgtgttactcccttggatcttggtgccagtggaatcaaccccaagaccatcactgacttggcttccttgtccgattatgcggagccattgatggcattaatggcctctttgcctcaagacgagaaagtgatactagtgggtcatagttacggtggggttatcatttccttagccatggaaagcttccccatgaaagtattggccgctgtttatctcacagcttttatgccgaatcatgattctcctattgcgactggagtagctgagtacttcagaagagttatggcggagccgctcatggatttccagttattgtttgaagatgggtcggaaaatccaccaactcatgccttatttggaccaaaatacatggaggcaatggtttatcaactctcaccaaaagaggatatagaattggccaacacgttgctgagacaaggaaagtggttcatgaaagatttgtccaaggaatctctgctatcaaaagagaaattcggatccgttgatcgggtttatatagtttgcaaagatgatttgctgataaaagaaagcttgcagaaatggtacatcgaaaatagccctacagatgatgtgaaagtcatagctggtgccgatcatatggccatgttttccaaaccccaggaggtctgcaaatgtctccaagaagttgctgagaaatataattgattctaccatcaaatatttcacttagccaactttgtaatcaataaataaaacaagtgttctatgatgtacggaatcaagttttaatactcgtaacttttataagcaacttataataattatctgtcaataaaaatagttctttaaattcctgtcgaaaaagaaaaagtaccgactgcg

SEQ ID NO: 87 - DNA, 1963 bp, Gossypium hirsutum
agaggaggcggcattaatcaaaaaaggcattttcacctcaaagaaacactgttttcaagacgtaaccatcgttgagatctgaagacatgagttagtaatacatcacttttaatcactccgccccctaaataataaggttggagtgccttccaagcacaacttccaaatgccaattacgtcatcgacgctggttttcccttttttcttgttgggtttagggtgaaacttaagtgaaaccactcagatgggatccggtgggagcaagggttgttgtagagtaggaggaggaggaagagacactgcacctgctgcttcctcgtctagcagcggtgggctgaggggaagatccaaggttaagaatagagttttccggtcctcttgtttgggagcgttatctagatctgcttctcctaaacccaactttgatcaccggaaacaacctgcgtcggaatcggatctggtgaaaagagaaagtaacagaaagcttgaaggcgaagcggcatctaatgaggaaatgcaattgccattgccaaccccatgcatatcttccggtggtagcacctctggtgcagctgtaacagctgctcatcgctctccttctcgctgcctctccggcattagcttccttcctggtaatttgagcttccggttcagcagagctaatagcatggggtcctccgcggagatgttgaaccctgatgacgattctgagacacttgaacctcaacaacctccccgcaattcttgttctccgattatcttcaatgattcagatggaagtggagagactctcgaaagcaacgctcgttttagcagagccttaagtgttggaaggcttcgtgatcgtgttcttggtagagctcccacattctgccctttgcagcaagacatacaaattactcagcagcaattagctacctctccatccaccactgcttccgctcatgcttcctccgttatttcccacgatgaaattgaaacttctcgatccagagaagcccggtatcatgatttgctccaccatagatccaatttccttgaaaggcggagaagaatacgatctcaggttcgagctcttcaacggctaggaagccgttttgagaacttttcagggcatgaaagatcctgcattttatctggccaacatagaagtggtcgatgcacatgtcgtgtaaataatcgagattctagttcaaatgatgacaccactggtgctaggtctagtgtatccagaatcgttatgttagctgaggctttatttgaggtcctggatgaaattcaccagcagtctatggttttatcttcgcgaccgtccgtgtctccaattggttctgttcctgcacctaatgaagttgtggaatcacttcctgtgaaagtgtacaagtcacccaaacttaagaatgatgaggctgtgcaatgttacatatgtcttgtggagtatgaggagggggatagcattcggagattgccttgtaatcatgaatttcatagaacatgtatagacaagtggctcaaggagattcacagggtctgccctctttgtcgtggggatatatgcggacctgatttgatgcctggggagaagtagagcttctggtttttatacgagaggagcattggcaactgactttggttacaaaagggaaaaagaaagagaagagaagtgataattatatactattattattgaggatgaatgtgaatgagtttgtttaatataccatctgtgatcagggtgatcaccttttggctgcacaataaaataatacaggaatgggttgggagtagtaaggggctattgaactttgtgatttgcagtgtaaggctgtgtgtaagccttcttgccttggggccacaactcagctggaagaaagaaaggaagggaagaaatttgattgttcatcttcaatgttgttaccaaagaaatattattaccaactccctctctctacagccactccac

SEQ ID NO: 88 - DNA, 2318 bp, Gossypium hirsutum
tgcacgacgacgacggcgtagaaaagttgaaggacatgcttcagaacagtattcttgtcctcaagttcatccttattttttcttcatacgatgcatcctatacctaacaacatcatatatctgtgcataatctagacaacaataagagtgagtgtgcagtttaatcttctcctctccctctttcacacgccttctccttctttgcaggcacatcatcgcgcacatatcgtttggttctccaagaaaagctccgctgcgcttacttgctgaacgctgttttctttactctttggctcacctttttctatcaattttcgcctcaatcatcttttcaacagttcttcttgcggaagcatattatgtgatgcaaattagtttggaaaattacgaggaagttgtttaacaccaatcacttaaaaatatgagcatcgagccatttaacaggttggttaaacttgctgctcgggggttttatgatgacgtgacaacaaaaggagacaatcagccaaagacgggtcgaggggataatagagggattgctgttgtagttcttgatgctcttacaaggagacaatgggttagggaagaagatttggcaaaggagttgaaactccattcaaagcaacttcggcggattttacggctatttgaggaagaaaaattagttacccgtgatcatagaagagagacggctaaaggggcaaagatttatagtgctgcagttgctgcgacggctgatactcaaacgggtgggaaagagggagaggagaagattaaactgcacactcactcttattgttgtctagattatgcacagatatatgatgttgttaggtataggatgcatcgtatgaagaaaaaaataaaggatgaacttgaggacaagaatactgttcaggagtatgtctgccctggctgtgggaaaagatacaatgctttggatgcattgagattagtttctttggaggatgaatattttcactgtgaaagatgtaatggagaattggtggcagagagtgacaagttagccgcgcaagatgtaggagatggagatgacaatgcacgacgacgacggcgtgaaaagttgaaggacatgcttcagaaaatggaggtacagcttaaaccattaatggaacaactcaacagagtaaaagatatgcctattccagaatttggaagtctccaagcatgggaagctcgagcaagtgctgctgggcgtgctgtaaatggtgattctggttctaatgatccttccaaaaattctcagggttatggtggcacacctatgccatttcttggggagacaaaggttgaagttgccttttctggtcttgatggcaaggaagatgtcaagtctgaaagtgctagcacatccctgaaagttttgccaccttggatgataaagcaaggtatgaacctgacgaaggaacaacgtggagaggtcaagcaagagtcaaagccagatggcagctcagcacaaccagaattttcagatgacaaaaagtccactgttgaaaatgatgataagaagaagatacaggacgagtatcttaaagcttattatgctgctttgtataagaaacaacaagaactagaagaagctgctaagaaacaacaagaattatcagacattcctctagccactggtctttctgactcttccaatcgtcaagttggtatgaaagctaaacgtgatgacaatgagggagaagatgatattgattgggaagaagctcctgttgctggcaatacaattgagagttataaggtcaatgatttgaatgtggaagcagaagaatctggagatgatgaggatgatgtagattgggaggaaggctgaattaatggttcagcttcctgtgatgtgtatggcattgacaaagggtaatgggtggtttatatgtcacactcgttctcgtataatcatgtgctctttcaaagatatgaagccccttctaagtgttcgttagtaacaatcagtttcatctatcatttttctgacattgtgccaacagttgctgagggaagtccaaaagatgatttttatttggtcttaataaatggatttggcgaagttgttgtgaactatggacaaagcaagcggtagtgttacaaaagcgtttttatcataacttgcaagcctgtttctcagttgtactttctagtttgtgttttttttttttggtttttaccaaaggaacctgaagtgttaatttgaacactgtattctatgtagaaaaaacaaacatcggtaagaagacaattatcttcgttgccatgtcgtttctatgctttgcaacatattgcagagattcaaa

SEQ ID NO: 89 - DNA, 2715 bp, Gossypium hirsutum
gcagacgcgtacgtatcggatccagaattcgtgattggacactgacatggactgaaggagtagaaaagtaggaaatataaacaccacgaagttatcgttatccctaacctcacacataaaaaaaaagagaaacaaagaacagatatttcgtgaggccaaaaacaaaaaaaaaaaatgacagcagagacagcgctaagagtatcgagttcgagttctactgtgtgcaatctaaatgggtttcaaaggagaccaacccctttatcttcttcaactcgttttctgggtcttcgtcctcgagcttcttcttcttcaatttcctcttctttatcccagttcatggggagtgtcagaattggctcaagacttcctatttcacgtcaacaaaaggggaagagaaggaacttctctctctttgctatggccgctgatgagtcaaagcgtgctgtacctttgaaagattatcgcaatatcggaattatggctcacatagatgtcggaaagacaacgacaacagaacgtattctatactacacaggaagaaactataaaattggtgaggtacatgagggaactgctacgatggactggatggaacaagagcaggaaagaggtattaccataacatcggctgcaactactacatcttggaaagaccaccggattaatattatcgacacccctggccatgttgacttcacacttgaagtggagcgagctctcagggttttggatggagctatatgcttgttcgacagtgttgctggtgttgaaccgcaatctgaaaccgtatggagacaagctgataagtatggggtacctagaatttgctttgtcaacaagatggatcgtctaggagcaaactttttccggacgagagatatgatagttacaaatttgggtgctaaaccgctggtgattcaactaccggttggtgcagaagataattttaaaggtgtcattgaccttgtaaagatgaaagctgtgctttggtctggggaagaattgggtgcaaagtttgagtatgctgatattccggctgatcttcaagagttggctgaagagtaccgatcacaaatgatagaaacgatcgttgaattagatgaccaagctatggagaactatctagaaggagttgaacccgatgaggaaaccattaagaaattaattaggaaaggcaccattggaatcagttttgtacctgtattatgcggctcggcttttaaaaataagggtgttcagccattactcgacgctgttatggattacttgccgtctcctcttgagttgccggcaatgaaggggactgaccctgagaatcccgaagtgataattgaaaggacaacaagtgatgaagaaccgttttccggattagctttcaaaatcatgaccgatccgtttgtgggatcccttacatttgtgagggtgtattcaggaaaacttgctgcaggatcttatgttttgaatgctaacaaagggaagaaagagagaatcggtagactattggaaatgcacgccaatagtcgagaggacgttaaggttgcattggcaggtgatattgttgctcttgcaggtctaaaggatactattacaggtgaaactcttagcgaccctgaccatcctattgtacttgaacgaatggacttccccgatcccgtgattaaggttgctattgaacctaagactaaagctgatgtcgataaaatggctaatggtttgatcaagcttgctcaagaagacccttctttccacttctcacgggatgaagagatcaaccagaccgtaattgaaggaatgggagaattacatctcgagattatcgttgatcgtttgaagagagagttcaaggtcgaagccaatgtcggtgcaccacaagttaattaccgggaaagtatttccaaagtttcagaagtgaaatacgtacacaagaaacaatcaggtggacaagggcagtttgctgatattactgttcgtttcgagcctatggaggcaggtagtggatacgagttcaagagtgaaatcaaaggtggagccgtgccgaaagaatatattcctggagtgatgaaaggactggaggagtgtatgtgtaatggtgtccttgcaggttttcctgttgttgatgtacgtgccgtgctagtagatggttcttaccacgatgtcgattctagtgtattggcatttcaactggcagccaggggagccttccgagaagggattagaaaggctggccctaggatgcttgaacctataatgaaagttgaggttgtcacacccgaagaacatttaggtgacgtgatcggtgatctcaactcaaggagaggccagattaacagctttggtgataagcctggaggactcaaggtggtggatgcccttgttccgcttgcagagatgttccaatatgtcagcactctccgaggtatgacgaaaggtcgtgcatcctacaccatgcaactggccaagtttgatgtcgtccctcaacatatccagaacgagcttgctactaaacaacaagaagttgttgcttgattttgttgtttcataattttcctggcatccaaacactattttttgttcacttcataatttgaagtgcagcactctcctttctttaatttataagttccatgtatcagttttgggtataaatgtaacaaaactattgaagtagaaaatgcaacataaatcagaatttggggtttttacctatataatatt

SEQ ID NO: 90 - DNA, 1053 bp, Gossypium hirsutum
aatcgttttgttgttcgcagccttggcaaccaaatcatcgcaattttgcaatatattttcccccttttatttcccttgtccgaagaaacaacattgaaaaccctaaccctagccacatcttcacccaaatctttaattatttgcgcttttctcatcaaaattcatcaaatcatcggaatcgatggcagctaaaccgcttacaagtgaagcaatcgctctgacagaaaagaagatggacatgacattggatgatatcattaaaatgtcaaaaactagttcaaataaaaccaagaagcagcgaagggtactgaataaaggtcagaaaccttttaataatgctgctaaagcaaaggctttgaaggttcaacagtatatggattcgcggtcctctgtcagacagggatttctagctcaaagaagatcaaacatcccggggaatcaatttcctttggcagctgaggctgcacgcagggctgcagttgccccagttcgaattaagaatgtaaatggtgtcagggtggctaatttgaacaaacctaggactggagtaccacctgttcagaggagggctaagaatggaggttttgcagcaaagccacgccagcaccagccgcaacagcaacaaggagggaatgttgttacaaagcaaaggcctcatacactggattcgttgtttgccaatatgaaaaaagagcgaatgaatggtcctgcacaacgtaacggcagcagtcgacaaagaatgccatggagaagaggccgatttggcaactgatggtgttgtgagacgaagtattccctctgctgctggacaagctgtctcgtcttttttgggcatgatagatgcttgtttttcttactttcgccatcaaaataaactcgcttattcgagcattttacgtgagaaagtgacagttcagttgtatagtgattttccttcgttttctattggctcgtggactgtaccccttgagaattgatacaaatagggttgttcattttgttaattcagttaaaattttaacctatattattgagcttgtagtgcgcaaaggt

SEQ ID NO: 91 - DNA, 1873 bp, Zea mays
cggtctcaggacgaagaagaagttggtggggccagttgaaaacctcgtgcaaccgactcctatttatacgcaccccgtcctgatccgcgaagcacaacactcgtttgcctctcatctcgcttcgcttccattccatcgcgccagtcgccagactcacctgggagagtggggggaaatatcaattagaaacaacgaggaattagcaaagaaagaagaataactcccataagaaaaatcgccaaatacgccattcatcttcttcgcccgggtttcagaacgtacggcagtttagccaggatggtggcgatcgagaaccagagccaggccgcggtggcggcggaggcggtggcggcgccggcgtcgcggatccccagggaggcgcggcgcctgctgcacgagctggcggcggcgtgggcggacgtggccgactgccgcgcgctggaggtcgtgccgctcaagggggccatgaccaacgaggtctaccaggcgcgctggctcactgcaggccctgccggccagaaggaggagcccagggcggagagggaggtgaggaaggtgctcgtgcggatttacggcgacggcgtcgacctcttcttcgaccgcgaggacgaggtgcgcaccttcgagtgcatgtcacgccatggccagggtccccgcctcctcggccgctttccgaacggccgcgtcgaggagttcatccacgcaaggacattgtcagctgccgaccttcgcgatcctgaaatttcagctctggtggcttccaagctgagggagttccacaaccttgacatgcctggtcccaaatctgtgctcatttgggacagacttaggaactggctcagaactgccaagagcttgtgtccacctgaagaagccaaggaatttcggttggacagtctggagaaccagattactgcattggagaacgagtgttcaggtgattaccagtggattggtttctgtcacaatgatcttcagtatggcaatatcatgattgatgaagagaccaacgtgctgaccatcattgattatgagtatgcaagcttcaacccagttgcatatgacattgctaaccatttctgtgagatggcagcagactatcattcatcaaagcctcatatactggactacagcagatatccagatgttgatgagcagaagcgttttgttaagacctacctgaacatttctggtgaggaacctgatgcggaagttgtggagaacctgctccaaagcattgagaagcacacgctcgccagccatctagtatggggcctctggggaataatttcggaccatgttaacgacattgacttcgactacaaggagtatgcgaggcagagattcgagcagtactggcacaagtctgcgatcttaacatcttgaacatgtgtataaacacccgtacgtggtctcaggaactccctgagggcctgtggctgcacacacgaaattgtgcagtgccactgacacatagataagctgtgaaagaagaaatactgacgacgacgacgaataatcccgttttgggctcgggaggttatttctccgcaactcgatgagcttcaggcttcagcttcaggaaggaaggaaggagctatggggatttggctgcccgcttatgctgtaccaatgcaattaaaagataaagatccggtccggtgttgcgtgtgctatgtttagttttggctagcaccgccgagagccgtggtcctgttgtggtgtttctagtttctgtatgcttgatgttgttagtgtgctggataatttggttttgtgcttggggagtccttagctttgggacaacgcatacattgtatactgggtagatgtataaacataaaacagctatgggaatttggttctctacctt

SEQ ID NO: 92 - DNA, 1682 bp, Zea mays
cttgcctcgcactgtcacagtcgtgcactccctgtccccgtggactgtggagagtttctgtcggtggtcgccccgcttcatctgtctcatcttccccagcgcagcccctcccccctgtagcctgtatccgccccccacactctgcgtctgtagtcttctttctcgcgtcggcagtcagcttggcagggccgaaccaatggcggtcgacccgcggcaggtggtggcgggcttcctcaccctctccatgttcgtcatgctcggcaacatgatcaagcacgaccacttctctcccgtcaccgaggagctgggcttcgaggcaacaggtgtggtgtcgaacacaaggaagcttgacaacgatgctgaaatgagcagcgtcgatacggctggagtggaggacctgatggacgctgtcgaggaagttaaaccttgctggaccaaaccaagtccaaaaaatcagccgtctaatggttttgttacattctccttgactatgggccctgagtatcacatctctcagatcacagatgctgtggttattgcaaggtatctaggtgcaacacttgtactcccagacatcagaggaaatgaattaggaaataagcgaaaattccaagacatttacaatgtggataagttcgtgaggagcctggatggtgttgtcgaagtaatagaggatatacctgatgaagtgagtgctaagaagccagcagtcatcagagtaccgaaccgtgtgactgaaagcttcatcacaggcaccatccagcccatcttccaaaaaaacaagtacttaagactagcggtcattttctcttccgtaagtttaaggccaaaggagacgaacaacaaggacatggacgcaactgcttgccttgcgatgttcggtggcctcgagctgaagcacgaatattctgaggtggccagaaaaatgctggataggcttcaagaattaagcaagaagtcagatgggaaggtcttggcgatcgatttgcggaccgacttgctggaaaagaagagttgcaagacaacccgcggcgctcgaagaaaaggctgttatagccctgatgaggtcctggctttcctgaggagtgttggcttctctgctaacacaaccatctacttgacagagacgtcgtggtacaaaggcctggatgttctgaaggaagaattcccaaacacttggtataagggtgacattatgccagccgagaacaaagctgaattcctgaaatccagcaatgcagacctagcaagggctctggaccttgagatctgttcgcagagcgacgtgttcgtccctgccgtcgctggcctgttctacgggcatgtcacgggtaagaggatcgcgtccggacgcacccagatcgttgtgccttcccagtccagcacctcgacacatgcttcagacttcatctccacctacatctccaacaagaaccaccttgcctacgcgtgctactgctaagcatccttttgtacggccgttaataagatcagctgaagggaaagtgctctgggtgcatatacaagtacctctcgtggacatgaatgatgttgtacactagctaatgttttgttatgaggaatattagcatacgactgtgtgttggttacttgtttggatattaaactctggaacagcagcaaggagcatatactgcacgttcctgttggcgcgcaccatc

SEQ ID NO: 93 - DNA, 1734 bp, Medicago truncatula
atattacaatagctgaatagctatccctaattcatgaacaaaaacatgtcaccccttattcttttaccctttgctctcttgctattcttcttgttcaaaaaacacaaaacatctaagaaatcaacaactcttccaccaggtcctaaaggccttcctttcattggaaacttacaccaacttgatagttcagttcttggtttaaatttctatgaactctctaagaaatatggccctataatctcccttaaacttggttcaaagcaaacagtcgttgtttcatcagcaaaaatggccaaagaagtaatgaaaacacatgatatcgaattctgtaaccgacccgcgttaatcagccatatgaaaatatcatataatggattagatcaaatatttgcaccatatagagaatattggagacacacaaaaaaactttcctttattcattttcttagtgtcaaaagagtctcaatgttttactcagttagaaaagatgaggtgacacgaatgatcaagaagatatcagaaaatgcttcttccaacaaagttatgaacatgcaggatcttcttacttgtcttacaagtactttagtttgtaagaccgccttcggcagaaggtatgaaggggaaggaattgagcgtagcatgtttcaaggtctgcataaagaagttcaggatttgctaatttcgttcttttacgcggattatttgccctttgttggagggattgttgataagctcaccggaaagacgagtcgccttgagaaaacgttcaaggtttcagatgaactttatcaaagtattgttgatgaacatcttgatccagaaaggaagaagttgcctccacatgaggatgatgttattgatgccttgattgaactgaagaatgatccttactgctcaatggatctcactgcagaacacatcaagcccttgatcatgaatatgtcgtttgctgtgacagaaacaattgcggcagcggtagtctgggctatgactgcgctaatgaagaatccaagagcgatgcagaaagtacaagaagagattcggaaagtgtgtgcagggaaaggttttatagaggaagaagatgtcgaaaagcttccatatttcaaggccgttataaaagaatcgatgagattgtacccaattttgcctatacttttaccaagagaaacaatgacaaattgcaacattgcagggtacgacattccagacaagacattggtgtacgtgaatgcattggcgatccatagagacccagaagtatggaaggatccagaagagttttatccagagagattcataggaagtgatatagatttaaaaggacaagattttgagctgattccgtttggttctgggcgaagaatttgccccggcttaaacatggctattgctaccatcgaccttgtactttctaatcttctctattcatttgactgggaaatgcctgaaggagctaagagggaagacattgacactcatggtcaagccggacttattcaacacaagaaaaatcctctctgtcttgttgctaagaagcgaattgaatgcgtgtgatcttgaacttgcatgttatgctatatttatgtgaagaaaataaagcatgcatgatgaggtctttgaagagtgtcaccggaaatagagtattatagttaagtgagtcttcatgattaatattgtaataaaagactctatccttgtattatatgttcatagaaataaaaatcatctttctgt

SEQ ID NO: 94 - DNA, 917 bp, Medicago truncatula
ttcttctccttcttcacaactctgtttctctctctcctcttcctccattgatgagcttccactatttacagtcttaactttgatcaatttttttatttttcatgcaaaaatcataggaatgaaactgtgaacacagttactacttaaagttacaaactttaattcttagaacattaacacccaaaaaattgtattcatcacttgcttaacagtacaaaaggttttggtttcaaccctttttctggtttttgcttcagagttatagatgatagctagctccttctgcaatgctgattctatgttttctagtgaagaagggatagatgttagaaagatgatgggacataaaaggagcccctgctctgttgatcaaagcaattataattctattgcatctaaaaagcaaaagcctgatttgtcgatcagcactaaggataggaaggaaaagattggtgaacgaattgttgctcttcaacagcttgtttcaccatatggaaagacagatacatcttctgttctaaaggaggcgatggactacatagggttccttcataaacaagttaagctgcttagtgctccttacctcgaaactgcaccagcaacccagttacaggatacagagtcatgcagcctgaggagtagagggttatgtattgttcctgtctcgtttactaatggagttgctgagggaaatggtgcagatatttgggcaccaatcaagaccacttcacctaaacatgagaaagatgtctcgcaattttagtgattaattctgtcagcttagccgccttaaggttgctaagtcactaaaccggtctattagaattaaaatttatcataacctatttcatggtccatctatagatggaatcatagtaggtaaaatagtcataagctttaagagctcttctattaat

SEQ ID NO: 95 - DNA, 1503 bp, Medicago truncatula
gtggacacaaaataaaagtcagacttcacacagcaaagaccaaagagctgtttttgttttgtctgtcttcttctccgaagaatagctatgagttctgaaggtgttggtgaagattgccttgcatgggcagcaagagatgcatctggtgttctgtcgccttacaaattcaatcgaagggagctcgggagtgaagatgtttatgttaaaattacacactgcggtgtttgttatgctgatgtaatttgggcaaagaataaacatggggattcaaagtatcctgttgtacccggacacgagattgctggggttgtggcaaaggttggtcccaatgtccagcgtttcaaggttggtgaccatgtcggagtggggacttacatcaactcatgcagggaatgtgagtattgtaacgatcgattcgaagttcattgtgtcaagggatcagtttacacctttaatggtgttgattatgatggcacaattacaaaaggaggatactccacttccattgtagtacatgaaaggtattgcttcttgatacctaaaagctatcctctagcttcagcaggtcctttgctctgtgctggaatcactgtttattctcccatgattcgacataatatgaatcaacccggcaagtctcttggagtggttggtcttggtggcctcggtcatatggcggtaaaatttgggaaggcatttggtttgcgtgtaacggttttcagcactagcatgtcaaagaaagaggaggcgctgagccttcttggtgcagaccaatttgttgtttcatctaatcaagaagatatgagggcgttggctaaatcattggattttataattgacacggcatcgggtgatcacctgtttgatccttacatgtcacttctgaagatatctggtgttctggtcttagttgggttcccaagtgaagtcaaattcagccctgcaagccttaatttaggatcaagaactgttgccggaagtgttacaggtggtacaaaagaaatacaggagatggttgacttctgtgctgcaaatgggattcacccagatatagaactgattccaattgggtactcaaatgaagctcttgagagggtcgtaaataaggacgtgaaatatcgttttgtaatagacattgaaaactccctcaagtagaattagagaaacatgaagttgatgattctgaagttagacatggaaggactacctttttagatattacacaccagcagcaaagagaaatgttcagtgttcccataatgattgccggatatagagatgattcaaatatcatatatctagtgatgcaaataaagctcttgagagggtcatagataggacattaagtatcagtttgtattggtcttttaatttagaagagttcggtttcgagaacaaactaaggcaggcctcacagccaacagctcaaagagcatttatagatatatttaggtttgtagtagtctaatgaacagctcaaaacaacaggctttttttatcttc

SEQ ID NO: 96 - DNA, 1281 bp, Medicago truncatula
gtaacggcaacacatgtaacataacattcttaatttatccgatagatagagagagtgtgacataactgactcagcaaacaaaactgtgattcacaattttcacataccctctttcttcaattcattcaatggcggatcagaacaaaaaacctgagatctttgaactcaacaatggcaccatgcagctccttgttaccaatcttggttgcactatcacctccttctctgttcctgccaaagatggtgtgttatccgatgttgttcttggccttgactctgttgaatcctatcagaaaggtctagctccttattttggctgcattgtgggtcgggttgcaaaccggattaagaatggaaagtttacacttgatggggttgagtactcgttgcctctcaacaaagccccaaacactctccacggtggaaatgttgggtttgataagaaggtatgggatgtacttgaatataaaaaaggcgaaactccatcaattacttttaagtatgacagtcatgatggagaggaaggttatcctggcgacatcactgtcactgcaacttacacgctcacctcaagcacgactatgaggctcgacatggaaggagtggcaaagaacaagccaaccatcattaacttagctcagcatacctattggaacttagctggccatagctcagggaatattctcgatcattcaattaagatatcggctaatcatgtcactcctgttgatcagaacaccgtgccaaccggtgaaattgtgcccgtgaagggtactccttttgatttcacatctgagaaaagaataggtgataccattaatcaagttggtttaggatatgaccacaattacgtgcttgactgtggcgaagagaaagccggtttgaggcatgctgcaaaagttagggatccatcaagttcaagggtacttaacttgtggacaaatgcacctggggtgcaattttatactggaaattacgtcgacaatgtaaccggcaaaggaggagctgtatatggaaagcatgccggattatgtctcgaaacacaaggattccctgatgcagtaaacaaaccgaattttccatccgttgttgttaaacctggcgagaagtatcagcattctatgttgtttgagttttcgattgaataaacatttttggagagttggagtgagtactgaaataaattctgcagacttgttctgcttattattatggttttgaacatgaactctggttgctactagaactgtttacttgtgtttaaataattgtcttgattgt

SEQ ID NO: 97 - DNA, 1371 bp, Medicago truncatula
acccgctgacataccgagtgacgatatctcacaaatcgaagaaagcgtaatgagtaggatgcgctcttcgtatatatatatatagtccgtgcaatgcaattaggagtttgtaattattcatcaattcaaccaaaatggccacaacacaaactgaattaattcctcctcctcaggtcccacttggaacccaaggctttcaggtttcaaaattgggtttcgggtgtatgggactcactggagcttacaatgatcctcttcctgaacaagatggtatttccgtaattaactatgctttcagtaaaggcgttactttttttgatactgctgatatctatggaggtagtggtgctaatgaaattttacttggaaaggcattaaagcaattgcccagagaaaagatccagttggctacaaaatttggtatatctagaagagacgtttctcgtctcgctgatgtgaccatcaagggttcacctgagtacgtgcgctcgtgttgtgaagctagcttgaaacgtctcgatgttgaatacattgatctctattatcagcacagaattgatacttctgtgtctattgaggatacagtaggtgaacttaagaaactggtggaagagggaaaagttaagtatattggactatctgaagccagccctgatacaataaggagagcgcatgctgttcatcccatcactgctgtacaaatagagtggtctctttggactcgcgacattgaggaggagatagttcctctctgcagagagcttggtattggaattgtaccatatagtcctcttggtcgtggtttctttggtggcaaaggggttacggaaaatgtgcctgctgttagctccctgacttctcatccccgcttccaagctgagaacttgaacaagaacaaaaacatatatgataagatcgaaagtcttggcaaaaagcatgggtgcactcctgctcagttagcattagcatgggtactccaacaaggaaaggatgttgtgcctattcccggaacaacgaagattaagaatctggatcaaaaccttggtgccttagcagtgaaactatcagaagaggacctgagagaaatttctgcagcggttcctgtggatgatatagcaggtagtagatactacaatggatttgatcatatttcctggaagtttgctaacacacctccaaaagtttgaagtgtctcaacctgaagtataaatcccttttagttggagaatgcagtcagtcatgaataaagcgcagcaatgatttctttatttgtatttaactcttttatgacctggctgaacaaatcaagaccggctgttcacagttgttctgctgttttgattagtaaataaataataagggatttcaatc

SEQ ID NO: 98 - DNA, 1291 bp, Medicago truncatula
gccttaaccagtagctactgttacacctagagagagaaagagagagacaaagaaactatgaaatttgttgttgttggattttgattgaaaaaagaaaaacagtattttgaggaaacatgtacataagtggtggttcttcttccatgggaaggtcttttaaggaatctcttaaactgcttgaagctgatattcatcatgccaataccttggcatctgattttccaagggaatatgatggtgcttgtcttcaaatgagaatgtcatacagtccagcagcacacttgtttctttttctggttcaatggacagattgcaatcttgctggagcccttggactattaagaatcctaatttacaaggtgtatgtggatgggactactaccatgtctacacatgaaagaaaagcaagtattagggaattctatgcggtcatatatccgtctttgttacaacttgaaaaaggtgtcactgatgctgaggataaaaaacagaaggttgtatgcatggagcggtatcgtagaagagaagatgaggagcacaaacaattctcagacatagactttgaaagagaagaagagtgtggaatatgtatggagatgaatagtaagattgtgttgcctaactgcaaccatgtcatgtgcctgaaatgttaccatgaatggagagcaagatcacagtcatgccccttttgtcgtgacagtcttaaaagagtgaactcgggcgatctctggatatttaccgatagtagggacatagtagacatggaaacggtaacaagggagaatcttagaaggcttttcatgtacatagataagttacctttgatcataccagaatccctttttgacccttatgactctcacttaagataagtaactgcgacacacagaaatgtgttctttgatggatggacacacaaaaatgtgttctttgatgggtggttcagatggttttagttttataaactttgaatgtaatttggtgaatttagtttatagagttgtagtgctttgcttccacgtcttctagaagattccagcctcgagtttgcgatgagttggtgatgaagttgaaatggtaaattgtatgtagcacatgcatttgtatatccttgtacagattgaattacttattaagaggtttgcatattactatgtgcctcttatgatattaaggtgaatctcttgacaaacaaccctccctcctaaaaatctttgatcatgaatgcattggatggaatattgaatgtcaactttaccaacaacttaatttaaaaaatcaccttcactcc

SEQ ID NO: 99 - DNA, 2118 bp, Medicago truncatula
gctttcttcgtcagtcagttgaatttcatttcatttcattccagccgtttcattcattcttcatctaccccaccatccccatccccatccctatccctagatttaggacaacatcaccatcaccccctaatcattttctgttacaccttcacctccatcgtatcatatagtagtagtaatggcgaagtgaatgaatacccgatctgaaatcatttagatccattccaaatgggtttcttcagtacaatttttggttttttcggatttggtgttggaatttcaattggtctcgttgttggttattttctcttcatctactttcaacctacagatgttgaggatcctaagattacgccaatagtggaccaagacgatgagactttgcaaaaaatgcttcctgagattcccaattggattaaaaatcctgactttgatagggttgattggttgaacaagtttatagaacttatgtggccttatcttgataaggcgatttgtaagaccgcgaagaacattgcgaaacccataattgaagagcagattccaaaatataaaattgattctgttgagtttcagacgctcactctcgggaccctgcccccaacttttcaaggaatgaaagtttatgtgactgatgagaaggagttgattatggagccttctataaaatgggctggaaatcccaatgtcaccattgctgttaaggcatttgggttgaaagcaaccgttcaggttgtggatttgcaagtttttcttttgcctcgcattacattgaagcctttggttccaagctttccttgctttgccaacatctatgtcgctctcatggaaaagccacatgttgactttgggctaaagcttttaggggctgatcttatgtctattcctggtgtctacaggattgttcaggagcttatcaaagatcaggttgcaaacatgtatctgtggcccaaaaacctggaagttcaaatattagatatggcaaaagctatgaggaggcccgttggaattttacatgtaaaggttctgcatgctatgaagttaaagaagaaagatcttctgggtgcatctgatccttacgtgaaactaaagcttactgacgataagatgccatcaaaaaagactactgtaaagcacaagaacttaaatcctgaatggaatgaagaatttaatttggtagtcaaagacccggagacccaggttttacagctcaatgtttacgactgggagcaggttgggaagcatgacaagatgggtatgaatgtgatcactttaaaagaagtttcccctgaagaacctaaacgttttactctggaccttctaaaaactatggatcccaatgatgctcaaaatgagaaatcgcgaggacagattgttgtggaagtgacttataaacccttaaatgaagaggagatgggcaagggctttgatgagacacagacaattcctaaagctcccgaaggcactccagctggtggaggtcaacttgtagttatagtccatgaagctcaagatgttgaggggaagcatcacactaatccacaagcacgtcttattttcagaggggaagagaaaaagactaagcgcataaaaaagaacagagatccaagatgggaagatgagttccaatttatagcagaggagcctcctaccaatgataaactacatgtggaggttgtcagcagttcctcacgaaccttgcttcatcaaaaggaatcactgggttatgtcgacatcaatctcggggatgttgtttctaacaagagaatcaacgagaagtaccatcttatagattctaagaatggtcgcatccaggtagagttgcagtggagaactgcataagcatgatggtgaaattctccatacatatgtacttctgattccaccctcaccccccaaaaccatctcttaaattttagtctccgtgcagtgtaacaaaaacagtgagaagggcatttcttgtattcttgagttagactgattttatttgtcaatcatgtacatgcctgtgataaaaaagaaaggtttgtttgaatagcaaaagaacatatttgttttgatttggatatataccagcaagggtttcggtcccgtggataaatattctgttctacttat

SEQ ID NO: 100 - DNA, 1099 bp, Medicago truncatula
ttttccgttgggctgcattatctccttcccttcactctagtcagtctacaccactatctacctcatttctgcacattttcggcgacacacactcttccaggatgaagatgatgtcattggttcggccactcttgatgaggcgaggattcagtacgagctctgagaaaatggttgcctctgtgctgtttgagagattgcctgtggttattcccaaaattgaccctaatgtttatgcttttcaagaattctcgtttcgatggcggcaacaatatcaacgcagatatcctgatgaatttctagacagatccgatgcaagagggaaaggtgattatcagattgactatgtgccagcaccgcgaatcaccgaagcagacaaacaaaatgatcgaaggtcactacaaagggctcttgatagaagactttaccttcttctctttggtgatgcttatggggctccaagtggaaagcctgtgtggcattttccagaaaaagtatatgaatcagaggataccatgcgtaagtgtgcagaatctgccttgaaatcagtcttgggagatctttcaaatacatattttgtcggaaatgctccgatggcccatattgttgttcagcctaaagaagagcagacaggatcaacatcttttaagaaattcttcttcaaatcacaagtaattgctaaaaacaagttcgacattggcaaaggtgaggactttgtttgggtgactaaggatgaattgatggagtattttcctgagcaagctgagtttttaaacaaaatgatcattagctgatgacagtggagatggttgtttaatcaaaactattacctggttcattgaattttgaaagaagatgaatgtaacagtttacttggttcattgaattttgaaagaagatgaatgtaacagtttctgggatcaacaaaaggtgtttgaattaaaattagatttaacatctcagtctgaggccattatttagaaacttatttctacttgtcagccggggtgtcagctgtattttggccgtagtttgtgctgtaataacaagttgccatggtgattatgatgttgagaatatgttgcccaattttgtagctgtt

SEQ ID NO: 101 - DNA, 1852 bp, Medicago truncatula
aaccatacaatccctctcaaaaaagcgccaaccaaatacgtcgtcgtttcaacagtcatcatcttcaacaccatggttctattctaagcacttaaacgacgacgtcgttttaacactgatcttcgttacaatggagtgcgttggagcgagaaacttaacggcaatggcgttttgcataagtccttctttgcggttaaggagaaagaagatttgttggagaagaagagaagtttcatcgaacgtgattcggttgcgttcgatgaaagtgaatgcgaaagcaggtggtgcaggaagtgagagttgcgttgttgctaaagaggattatgctgatgaggaggattttgttaaagctggtggttctgaacttgtttttgttcaaatgcagcagaaaaagtctatggacttgcaatctaagcttgcggataagttgccacctatctgtgttggagatggtatactagatctagttgttattggttgtggtcctgctggtcttgctctagctgctgaatctggcaagttaggattaaaagttggacttattggtccggatctccctttcacaaacaactatggtgtgtgggaggacgaatttaaaggtcttggacttgaaggttgtattgagcatgtttggaaggataccgttgtatatattgataataaaaatcccatttcaattggacgttcttatggccgtgtcagtcggcatttgcttcacgaggaattgttaagaaggtgtgtcgagtcaggtgtctcatatcttggctcaaaagtagaaaggattgttgaggctagcaatggtcataatcatgttgtctgtgaatatgatactgtagtgccttgcaggcttgctactgttgcatcaggagcagcttcagggaaactattgcagtatgaggttgggggtccaaaggtgtgtgtacaaacagcttatggtgtggaagttgaggttgaaaacagtccttatgatccaaacgtgatggttttcatggattacagagactatatgaagaacaatgttcaaagtctagaagctaaatatccaacatttctttatgcaatgcccatgtcccgttcaaaagtgttctttgaggaaacatgtttggcgtctaaagatgccatgccttttgatttattaaagaaaaagctcttatcaagattaaagacaatggggatcaaagttacaaaaacttatgaagaggaatggtcttatatcccagttggtggatccttaccaaacacagagcagaagaaccttgcgtttggtgcagctgccagcatggtgcatccagccacaggcatgacatcatcgttgtcagaagctccgcaatatgcttcagtaattgctacaattttgaatgacggtactgcaagggacattgttacttatggaagaagtaaggagaatccatccatgcgagcttggaatacactttggccacaagaaaggaaacgacagagatcattctttctttttggattagcactaattgtgcagctggacattgaaggcactagaacattctttcgtactttcttctgcttacctgagtggatgtggcaaggatttcttggttcttctctgtcctcgaaagatcttctattgtttgcactctacatgttcataatagcaccaaataacttaagaatgtctctagtcagacatctgctttcagatcctacagggtcaactatgataaaaacctacttgacgatatagtacgtttctataaactttttcctcttgttaggtaccctgtattgagagacaggctagattacattaggagccttaatagagtttgtaggttatgtacatatgtttatattattactattattttactaaaaa

SEQ ID NO: 102 - DNA, 1245 bp, Medicago truncatula
ctctattggtgaaatggcagctacgaccaccactcccgctgctctcaggtttcttcctccaaatcccacaaccagaaaaacattcaacttcttctcaattctaaaaccaaatttcaactcacttcgttcattctctcattcatcattattttctctatctcacaaataccctctttctccctgcaaatgctccttcactgcccccgtttccactacaacttacgagttttctgataatgcttcagagatggagttaagattaaatataggaagcatggatgtaagaagcacaaaagacatatcggttgatgcaaacgatacatctttaactatcagagtgttgcagtcaggatctccaattacgttgatagacaccaatcctctttttgacaggattaaaccctcagaaacaatatggtatatagatgatgatgatcttgtggtgaatttcaagaaaaatgatcctgagttgaaatggcctgacatcatggaatcatgggaatcacttgctgctggatcatcacagcttttgaaaggaacatccatctatcttgttggtgattccactgaaatcaaccagaaagtggctgaagagcttgctactggtctggggtacacgccactaagtacaaaagagttacttgaaacttattcaaaccaaaccgtggattcatggctgcttgctgaaggttctgactcagtagccgaaggcgaaggcactgtacttgaaagcataagtagtcatgtaagggcagcagttgcaacattaggaggtaaacatggtgctgctggaagatctgataaatggcgacatctctatgcaggatttactgtctggttgtcacagactgaagcatcagatgaagattcagcaagggaggagacacacagaaacgtcaaagatcgcataactgcatatacgaatgcagatgtggtcgtgaaattacagggatgggatcctgcttatgctaaaagtgtggcacagggatgtttgagtgccctaaaacagttaatcctatcagacaagaaacttccaggtaaaaaaagcctatacataagattgggatgtcgtggtgattggccaaacatcaaaccccctggttgggatccatcaagtgaaggtggtgaaactcttggcacgcaataataatgcttgtaatattaataacaatgtgtaacatcaaattttttcagcagccagttggagttcttggttgcattcacccctataaaacaaaaaactac

SEQ ID NO: 103 - DNA, 2071 bp, Medicago truncatula
ttctgattcctctctctttctctctctataaataaataaaccacttttctttctaagtctgttaattcagtttatttaccatggcaatttccgatacaccggaaaccactgcaaccgccacagccaccgtaacaaccatcgaaaccgacacagatctcaaacgctcttcactccgacgacgaccgagcgccacatcaaccgccggtggtctcttcgacgcggaaagtgcagctgcagatgccgttcgagattcaggctccgatgattcgttgaacggtaagatcaacaacgaagaagaggttaaagatcgaaaaacggatcatgcagaaggaattgttgacgatgatgatgataatgcggttaagaagaatggtggtaatgacgtcatcaatgatcgtgaaaatgttgctgtcgatttcaaattcacttatcgtccttcagttcccgctcaccggagaagcaaagaaagtcctcttagctccggcaatatttttagacagagtcatgcaggactgttcaatctctgtattgtggtgcttgttgcagtgaatagtaggcttattattgaaaatctgatgaagtatggatggttgattcgatctggcttttggtttagttcaaaatcgcttagagattggcccctcttcatgtgttgtcttagtcttgcaatatttccacttgctgcctttgtagtcgaaaagttggcccaacaaaaacgtatttctgaaccagttattgttctccttcatattgtaattacaactgttgcgatcatctatccagttttagttatcctctggtgcgattctgcttttttatctggttccacgttaatgctattgacttgcatagtgtggttaaaattggtgtcatatgcacatacaacctatgatatgagagcgcttgctgtttcaaatgaaaagggagaaacaatgcccgatactttcaatatggaggagtacccacacaatgtgagcttccagagtttagcatacttcatggttgctcctacattatgctaccagccaagctatcctcgcacaccttcggttcgaaagggttgggtctgtcgacaacttctcaagctggtcatatttacaggagttatgggatttataatagaacaatatatgaatcctattgtccagaattcacaacatccattgaagggaaaccttctatatgccattgagagagttctgaagctttctgttccaaatgtttatgtgtggctgtgcatgttctattgctttttccatctttggttaaatatacttgcggagcttctccggtttggtgatcgtgagttctacaaagattggtggaatgcccaaacggttgaagagtattggaggatgtggaatatgcctgtgcacaaatggatggttcgtcacgtgtattttccctgcataaggtttggtatacccaagggtgctgctgctttgactgctttcctggtttctgctgtgttccatgagttatgcattgctgttccttgccgcatgttcaagttgtgggcttttattggaattatgttccaggttcctttggtcttgatcaccaattacctgaaaaataaatacagaaactcaatggttggaaatatgattttttggttcatattttgtattcttggtcaacctatgtgtgtactactatactatcatgacttgatgaataggaaaggtgaaattgactgaggtagcattacatcattacagttatgtggatgagcttttacttttgcagagctaaatcgatgtacatatgttgctcaatgttatctccagtgactatcatctgctatgacggtggttcatatgggttaagcatttccatgtgatttgcttcgtctttttgaagttagttatctatgtatttatttaactgaattgctttggcacttcagcaatatgcagacaattttgaaagcacatgaacaatgttatgcgctaaagtaaaaaccaacaggtttcagataattgaggcataagctgtaagtgcctaaatgatttagctgtagatgatttatggaagttttaaatttgaataatgatggctagtattggtt

SEQ ID NO: 104 - DNA, 1937 bp, Medicago truncatula
gtggttgtcgaatatccacatagcttagctcaccggacgcaactcttgattgatgtgtctcgggttgcaagttcaaatttaattgatgagattcgaagatgtttttcttttacataaaacacctcattttcatatttgttttaagcctcggaataagttgcgttgattttgactaacactattaattttgaatatacaaatgtaatttgtaagatttcatcatggggtttcttgtgcttctttctctcttgccaatcttaattctattcattatacacatctacaaaataaggagtactagtagagcatcatcaactccaccaggtccaaaaccacttcctctaattggaaatctacaccagcttgacccttcatccccacatcactccttatggaaactttccaaacactatggacctatcatgtctttgcaacttggttacataccaaccttaattgtttcctcagcaaaaatggcagaacaagtgttgaaaacccatgaccttaaatttgcaagtagaccatctttcctaggactaagaaaattgtcttacaatggtttagatcttgcttttgcaccttatagtccttattggagagagatgagaaaactttgtgttcaacatctctttagctctcaacgtgtccattcttttaggcccgttagagaaaatgaagtggcccaattgattcaaaagttgtcgcaatatggtggtgatgaaaaaggtgcgaacttgagtgaaatattgatgtctctcacaaatacaattatatgtaagatagcttttggaaaaacatatgtttgtgattatgaagaagaagttgaattgggaagtggacaaaagagaagtagattgcaagttttgcttaatgaagctcaagctttgttggctgaattttacttttcagataattttccattgttgggttggattgatagagtcaaaggaactcttgggaggcttgataaaacattcaaggagttggatttgatataccaaagagttattgatgaccacatggataattcagcaaggcctaaaactaaggaacaagaagtagatgatattattgatatcttattgcagatgatgaatgatcactcactctcttttgatctcactcttgaccacatcaaagctgtgcttatgaacatttttatagcaggaacagacacaagttcagcaatagtggtttgggctatgacaacattgatgaacaatcctagagtgatgaacaaggttcaaatggaaatcagaaacttatatgaagacaaatattttataaatgaagatgatattgaaaagctaccttatcttaaagcagtggtgaaagagacaatgagattatttccaccatcaccattactagtaccaagagaaacaatagaaaattgtaacatagatggttatgagattaaaccaaaaactttagtgtatgttaatgcatgggccataggaagggatcctgagaattggaaagaccctgaagagttttatcctgaaaggttcattatgagttcagtggactttaaagggaaaaattttgagctaattccatttggaagtggaagaagaatgtgtcctgcaatgaacatgggagtggtcactgttgagcttacacttgctaatcttcttcactcttttgattggaagttgcctcatggttttgacaaggaacaagtgttggatacaaaagtgaaaccaggaataactatgcataagaaaattgatctttgcctttttcctaggaaaagaaaaccataggatatatgtactattgacaattagttatgttatttgcatgcctcaaagtttgtattatttctagatcaattgataatggtttcatttgtaatttgggaagtgattaaaagagacttgtaatatgttttcatcttataatgttaacttgtatttgggggagttatgtaccca

SEQ ID NO: 105 - DNA, 871 bp, Medicago truncatula
aatgtaactactgtacgtaataactacacaactataaaataacaaaagttcacacatctctcaaacctcaccaaacacaaaagagatccacaaactctaaaatcaaattttagagtttattcaacaacaaaaaaaaatggctagtctcagaatcatcacttttgtgtcattgatggtgttgttgatgatcaacacaacagaggcacaatcaacagacatcccttcatgtgctacaaacctaatcccatgtgctgattaccttaattcaaccaaaccacctagttcttgctgtgatccaatcaaaaaaacagttgaaactgaactcacatgtctttgtaacctcttctatgctcctggtttgcttgcaacctttaacatcaatactactcaagctcttgcgttgagtcgtaactgtggtgttaccactgatcttaccacttgcaaacacaatgggtcagctccagctcctacttccggcgggtccccaccggctacaacaggtggtaataaagcagctgcaagcagagtctcattcactggattctcttttatactcttattggcatccatgatgttcaattagaaaagtggctctttacccttcttaaacctctactttatttatttaatttttctatgtaatttcatacattgattggctactgagccatttcagagtgcgtttacttttccttcttcgattttttttagtgaactctgattcaatttgggttaaaaattcttatttagtgaaagtgcgttattcttgtgttgataaatctatctgtggtgtttttgatagcaccgtttatatatgatatgatgtggattctcgttcttatcggtgttattattaatttattattaccac

SEQ ID NO: 106 - DNA, 1413 bp, Medicago truncatula
attaataataataaataaaggcaaatctcaaattctataacttcacactctttggccttacctcatctcttctctattcttctcaaaccagcttattttattgcaactattaccatcacttacaatatattatccttttaaaatccaaacaaacccttgggatcaataaacaaaagaaaattgatttgtaatgaaaggagaatacgtagagcaacattcttcaaatcccaacaaaggaaatgaaacaccaccaccttctttactattctcaaagccatttcacccttttcaactttctcatcatgaatgtcaaccaatcggtgaagatgataacaacaacaccagcggcggcgttgctaccactcagaaacctaacacctccggcgacggtgcaactatcgaggtttctagacggccgagaggacgtccacctggctcaaaaaacaaaccaaaaccacctattatcatcacaagggatccagaaactgtgatgagtccttttattctagatatttctggtggaaatgatgttgttgaagctatttcagagtttagtcgtcgtaagaatattggtttatgtgttttaactggttcaggaactgttgctaatgttactcttcgtcaaccttcaactacaccaggaaccaccgttacttttcacggccgttttgatattctttctataactgccacttttgttcctcaacaacacggtgtttctccggcgattccgagtaacttctcgatctctcttgctggacctcaaggacagattgttggaggaattgttgctggaaatttgatagctgcagggacggtgtttgtgattgcttcttcgtttaataatccgtcgtatcataggttgccgttggaagaagatgaaggtggaaactcggtgtctggtggtggtgaaggaaactcgcagaatgtttccggtgcggtggacagtggacaaggtcagggtggtggtggtgagtcgtgtgggatgtcgatgtacaactgtcatttgccgtcgtcggatgtgatttgggctccgtctgctagaccaccaccaccttactgatatcatcatcattcacattttcataaactttgttgcaaaatcttttctgttatgctggtttttttgtctctatttttattatggttatctctgtttaattattattattatatttataattagtagctttgtttagtttgtgaacagaaattaacaagactagcttagtatggtagttatatgtagctagctaggttggtttattttcattgacatatcatttgttgcgttgttcatcatgtattagtattaatctttttactttattaactagttctactttgtgtgggtttgtatgattaattaatgtgtttttgacgaagtggtaactaaagctgaagcatgttttc

SEQ ID NO: 107 - DNA, 1141 bp, Medicago truncatula
gggtctgtgtgaggaaaggcaagccacgtgcaatgtgagcactttactagaagacactgttgttggcggccacctcaaagttgaacgattatatatataataagtctgaacaaactcaactcacacaccgatcaccgatcaccgataagatgcaggtaatagcaaaagcaaaagctgaggagaagaaaatcggcttgacagaaacatggttgaggaaacaccgtcctatctacgacgcagcaaccagacacccttttattcttagcatccgtgatggcaccgttcaatctcattccttcaaaacatggctcgctcaggattacttgttcgttagagcgtttgttccatttgttgcgagtgttctgattaaggcttgtaaggaatcagatgacagtgatgatgttgaagttatattgggaggtatggcttctctcaaggatgaaatattatggtttaaaagagaggccaacaaatggggtatttcattctcagatgttgttcctcaaaaagctaacataaactattgcaggttgctggaaagtttgatgagcccagacgttgattataccgtgactcttactgcattttgggcaattgaagtggtgtatcaagagagttttgcacattgcattgaagaaggctcaaaaaccccaccagaattgaaggagacttgtgaaagatggggaaatgagggatttggtcagtattgccaatctctgcaaaagatactcaatcagcgcttgcagaaggcttctgatgatgaactcaaaaaggctgaagttatgttactcagtattattgaacatgaagttcatttctggaatatgagccgtggaaatgtctgattttgtttaaaagaaatctttgatgtttgtgtactgtgtaaaataatgaaaccttgtttatcttgttaagtgtatggaatgtctagattaattgagtgggaagtaattaagcagcaggttaaaggaatgtaccatgttttattaagaaggaaaaaatgtcgtagaattttcaataagttgttagtgttgctttcttccacctcatttcattagtagacctttttgtcaaattctcaaaatatatgatttcagaacacaaacatacccttaaatagtaatttatcagatattcaata

SEQ ID NO: 108 - DNA, 2545 bp, Medicago truncatula
atttaatgcataccatgttaaagttcaaaaactctttaagttacgtgcttttcttttgctcattgtaaacaaagaagcacaaaatgaaggttgaatcgaggtcacataatgttcatcatgcacatggggaagaagagaaggtgatgacaaggaagcagaaggcagaatctaaggcacatgaagtagagcattctcctaaaaaggctaaggtggaagatgaaaaaaatggtcacactaatggaaaatctgcttctgatgttgtacaagaatatgatgagttttgtaaggccactaatgagcaactatctttggagcaaatgaaagagattcttgaggctaatgatcttgattcatctggctctgatcttgaaattacacgaagatgccaagacttgctgttttttggtgcattagagaaatgcatggtttgcaatggcaacatggagtttgatggaagacgttatggatgcagaggtttctacagtgaatggtctagttgcactttcagcaccagagaacctccaaggaaagatgaacctattaagctaccagattctgttcagaactctccagtttcagatttgctgaagaaataccaggatccaagtaaaaggcctcaaagggatttaggcttagctataaagccttttactggaatgatgatttctttgatgggtcgtcttaatcgaacacatcaatattggaaaaaaacaattgaaaagcatggagggaaggtggcaaactctatcattggagcaagttgtttggtggcttcacctgccgagcgagatcgaggtggaacatccaaacttgcagatgccatggagaggggcatacctgtggttagggaggcatggttaaccgacagcatcgaaaagcaagaaccacaacctttagaatcttatgatcttgtttctgatctttctgtggatggaaagggaatcccttgggacaaacaagatcctggggaggaggctattgaatcactctcagcagaactcaagctttatgggaagagaggggtctacaaagataccaaattgcatgagcaagatggaaagatatttgaaaaagatgggatattatacaactgtgccttctccctttgtgaccaagggagaaaacttaatgactactgtgtcatgcaactgattgtcgtcccagagaattctttgcatttgtatttcaagaaaggaagagtgggggacgatccaagcgcggaggagcgactagaagagtgcgagaatgtggacaatgctatcaaagagtttgtgaggctctttgaggaaataacaggaaatgagtttgaatcatgggaaagagagaagaaatttcaaaagaaaccactgaagttttaccccattgacatggatgatggagttgaagttagacacggggcattaggtcttcggcagctggggatagcagcgacacactgtaaacttgagcctatggttgcaaattttatgaaggttttgtgcagccaggagatctataagtatgcattgatggagatgggttatgactctccagaccttccaataggaatggttacaaatcttcacttgaaaagatgtgaggaaattctgttggaattcatagagaaagtgaaaacattgaaggagacagggcccaaggctgatgctatttggtctgattttagccagaaatggttcactctgatgcactccacaaggcctttcatttttagagattatcaagagattgcagatcatgctgctgcagctttggagggtgttagagatataacccttgcttctcacctcataggagatatgagtggctctaccattgatgatccattatcagacacatacaagaaattgggttgctcaattactcccctggagaaaaattcaaatgattacgagatgattgtgaaataccttgaaaaaacttatgaacctgtcaaagttggtgacattgaatatggggtgtcagttgaaaacatcttcactgtggaatcaagtgcttgcccttcttatgctgacatagtaaagatgccaaacaaggttcttctatggtgtggatcgcggagctcaaatcttttgaggcacttgcacaaggggttcttgccagctatttgttcactacctgttccaggctacatgtttggcaaagccattgtttgctctgatgctgcagcagaggcagcaagatatggttttactgctgttgacaggccagaagggttcttggttttggccattgcttcactaggaaatgagattaccgagttgaaaagtccacctgaggacacaacatctttggaggaaaagaaagttggagtgaagggacttggaaagaagaaaactgatgaatcagagcattttgtttggaaagatgacataaaagttccttgtggtagcataattgcctcagagcatgaagatagccccttggaatacaatgagtatgctgtctatgatcccaaacaggtacgtataagctacttggtgggggtgaagtatgaagagaaagatgccgtgatagacacggcagagtgaaaggcacaacagaatga

SEQ ID NO: 109 - DNA, 699 bp, Medicago truncatula
aacaaacaacacaccaaaacttcaagtataactaacacacattcctcacatatcaaccaacattttccacatttgacattatatataatggagagagtaacaaagatggtttcagaaaggccagtggtgatattcagcaagagttcatgttgcatgagtcatacaataaagacactattttgtgactttggtgtgaatccagcagtatatgaacttgatgagataccaagagggagagagattgaacaagcacttatttcaagacttggttcttctccatctgttccaactgttttcattggtggtgagcttgttggtggagccaatcaagttatgagtcttcatcttaaccgttccttaattccaatgcttaaaaaagctggtgctctttggctttaatctcatcactcatcatcatccactcaataaactaacccgttttggttatatatatctaatgagatcatatgtagagaggaaaaatatatatatatatatatgatgagctactagagtttatggcataaggtaataagtctaacttaattgatagatttgggtaccgatcgatgctacactatagaggaggatccaagccctctgtttagccttcttttttcggggttaaatgtaatgtttttgatgtaatgttctctttttgataagtatgacaattaataaatatggatccatgagtta

SEQ ID NO: 110 - DNA, 1034 bp, Medicago truncatula
atctgcactcttgttctttaaggtgactaaattatattttccaaacatcatcaatcttcgtggacatggcaacatccttgtccacaaccactctactttcctatagaagaaacccacaacacatgtatatccaaccttgttcagttaaaaatgaagtttcaagaactatgcatgcttcagtctcaatagacagtttatcaatcaatgaagagagtgataaatgttcatctttgttggcgaacagaagagcaattttggcttctggagtttccttgttgggttttccaggagtgagtttggctgtggtgaaacaaggtcttttagcagggagaattcctggtctgtctgagccagatgaacaaggttggaggacatatcgcaggccagatgagaaatcaggaggacatggtgttggatggagtcctattattccatacacctttaaagtgcctcaagaatgggaagaggtacctgtatcaatagcagatcttggtggaacagagttagatttgagattttccagctctaaggaaggacgtctgtttgtcattgttgctcctgttcttagattctccgatattattggtgatgatgctacaatagaaaaaattggacctccagacaaagtgatcagtgcatttggtcctgaaatgattggagaaaatgtggaagggaaagttcttagttcaaatgttgcagaacatgaagggagaacttactatcagtttgagctagagcctcctcatattttcattactgccaccgctgctggcaaccgcctatacttgtttggtgtaaccggtaatggccttcagtggaagagacactacaatgatttgaagaagatatctgactcttttcgagttgtataattggaatttccaataaattgaaaatattaaattttcttatgtgtagaatagtgctgtaatgcagaaatttcccactacttttcctgattgggatttctgtgaatcaagagatcaaatatgtaaagtctttgtaccttcaatataccataacagttttgttac

SEQ ID NO: 111 - DNA, 1104 bp, Medicago truncatula
ggggatgcaagtgcacatacactatcgcagctaacccatttgcgcatataaaactaaaactacacacttttgtgagtaaaaggaatgctgagatttataacatcatcatctgcgcccaaattcttccccacaaaaccttttcacatcatttcacccttttcatctcgcttatcagttcgttccatggctgactctgctgctcctttcagcaaaatccagattcaaagggatgataacacaacatttgatgcttacgtcattggcaaacacgatgctcctggaattgttgttctccaggagtggtggggtgtggattttgaaattaaaaatcacgctgccatgatttctcaacttggccgtggatttaaagctcttatcccagacctgtatagaggaaaggttggtctggatgttgcagaagcacagcatttgtttgatggtcttgattggccaggtgctgtgaaggacattcatgcttcagttgactggcttaaagcaaatggttcaaagaaggctggtgtaactggattctgtatggggggtgctcttgcaattgcaagctctgtcttggttccgcatgttgatgctgttgtagctttctatggagttccttcttcagaacttgcagaccctgctcaagccaaggctcctgttcaggctcactttggagagctggacaattttgttggcttttcagatgttacggctgccaaggctttggaggagaagttgaaggcatctggaattccacatgaggtacacatataccctggcaacagtcatgcattcatgaaccggtcaactgaaggaatcaataggaggaagaacatgggattgcctgatgaagatgaagcttcagttcagctcgcgtggtctcgcttccaatcgtggatgacacagtacttgtccagctaggtaatttattactagctgagatattgtgtaatgccatgttctatcttaggaagtactgttgtaatggtttcatctaacgatgtatgtgttctaattaatgcttcaacatggagtgttgattgaataaataaataaatattgggttgaaactctagtgaacccgcaatataagtgtcttaacttgaacct

SEQ ID NO: 112 - DNA, 1699 bp, Medicago truncatula
aaactaaacaagagagagagagagagggaaagcgttgaagcttttcttcttcattctcttctttcattcctttcacatacgtattccttttttcttcctttcaatcttccattaccgatcaatttctcctacgaattcacactcttcctccttattgatcctctctttttcctcaacttttttccaataccattttttctgggtttcgttcaaaaatcaaaaacaatttttttagaaaaaaaatcgtattttgaaatttgggtcttgtttataacaacccaattaagtttgggggagaaaaatttgcgaaaaaaaggattggaaaatgctgggtactacactgcaatttggtggtgttggtggtgatgatcggttttacattccggtgaagacaaggaagaatcagaatcagcgtaagcaagctcagagagacaagaatgttgaagaggaatcaataacagttgcgtctgtagaagagtctgttagtaacattgataggttcttggattccacaaagttattggttccagctcagtatttctccaagacgacaatgagaggttggaagacttgtgatgtcgagtatcagtcttactttgctctgaatgatctatgggaatcgtttaaggagtggagtgcttatggtgctggagtccctttactacttgatcaatgggaatctgtagtccagtactatgttccgtatttgtcagctattcagctatatggtcaacctacagaaaagtcgagtgccaagccaaggtacataagtgaagatagtgatggcgattactacagagattcatgtagtgaaggaagcagtgattgcgaatctggaaaaaggacagaatgttttacagcacagagaagcagtaaacacctgacaagtggtgtctcttctcaaatgagcacactctctatacatgacaaacacaatacagtacaagaaggattttctagtagtgatgacagcgaaactgggaatcctcaagaactgctttttcagtatttggaacaaggtcatccttatggccgtgaaccgctggctgacaagatactagatcttgcacgcgactatcctgccctcatgtcgttgagaagttgtgatttattgccaaacagttggatgtctgttgtatggtatcctatatatcgaatacccacaggccctactttaaaagatttagatacctgctttctaacctaccatacactccatacacccttgacaggaagtggtcctactcctggtcctgtactagtttatcccagtgagatggatggtgtaccaaatatttccatacctacttttgcaatggctgcctataaattaaagggatctatttggatgaaaaaagaagttagtgagaatcaagtaatgaattccctcgtgcaggctgcagataaatggttaaggctagttcaggtgaatcacccggatcatcagttctttaaatcgcatggcacatactacaaatgaattgaatgatatggcgtgccagttatattccctcggttaaaattaagccttaatttcattgccgtggtgcaaactttattaaagtccatccatctgtagagattgtgatggcacggttgtgacagcctaattgtaggtttttcttatacgcctaagcagcacaaaagatgaaactgatctcaagcgatgaattcgttgagattgccaaagcgaagacat

SEQ ID NO: 113 - DNA, 1733 bp, Medicago truncatula
gcacgaggcacatacattgcacacaagcatagcacacctggtgacaactattgctcaagtgaagctcactaaattcctatctaccaaccaacagggaaaaataatatcatggcacctgctaatacttctgctgctgctttatctgaaactgaatatgaaatggtgaaaaacatcattgacattgaagttctagaagagttaagtttagcagattgtagcatctacaaggttcctcacaatctccgaaaagtgaaacaagaagcttacactcctcaactaatctcaattggtccaattcaccttggaaatgaagaacttcaaccaatgcaacaacacaaaaaaaggtatttccatttcttctatgagcgtctatctcaattcaatcaacaatccatgatcaagaactacaaactctatctcgaaaacaaagaacaagaaataagaaaatgttatgcagagaaatttcccaacataagcaaagagaaatttgtggaaacaattttgttggatgctgttttcatcatggaacttttgttgagaaacagttcatggaagtcggatacatcaaaacatgaacatgaatacaagcaatccaagtcatttagatggaaacatagtgatgattacattctaacacaagcttggctcagcaaaagcatcacaagggacttgattttgttggaaaatcagatacctttttttgtattgaagcatctttatgacactgtcgtcccgaacgacgacaaaaaaccaaatcatgaagattttcttgatcttgcactcgagtattttgcattctacgacactcagaaatcgtcatcacttgaaacgaagtttgttttggataagaatcagacaaaaaaatattattatgtgagtggcgtaattggtgatgttggtagtggtaattcagtttccaagaaaaaacattctgataaatctatgagcagtaaccatgggtttcaaggtcccaaacatttcactgatctgataaggtttttttaccttccagctgatttaggaaagagtggttgttctcatattttcccaagaacagtaacaaagttaatggattctggtgtgagttttgagaaagttgtggggagaagattactagacataacatttgagaagaaaccatttctaagtaattttctctgcttaggttgtttaccttcattttcatgtttgaatcatttcaaagcgcgtcttaggatttcgcaattgaaggttgatcacacaacagaatgtgttttaaggaacctcattgccctagaacaatgtcaatatcaagaacaaccttatatatgcaattatgtttcacttgttgattctcttatacatacacaggttgatgttgatttgttggtcgagaaggaagtgattgtgcatgaaatgggaagtgataaagaagttgcaatgcttgttaatggtctttgtaaacatgttgtggtgaattcaacttgttactatgagattattaatgagcttaataagcattaccagaatatttggaaccgtaccatggctgcattatggttggtgtattttagagatgcttggagagctagttctactttggttgggattgcttttcttgtttacactgcattcaactttgtacgtcttgccaagattctcttctagtagagaaacttgaaaatgtataattcgtggtttggattattatcataactagattgatgagtgttatgtgtatttatttattttgg

SEQ ID NO: 114 - DNA, 1539 bp, Medicago truncatula
gttatcaccacattcaacaactattatttttccttcgcatccacctttcaacgccattcccttcccttcttaaataaataatcacttattcctttctcagttttctttcatctcttcactaacaagtaaaaacgcgcgcgcgtttcattaatcacttttcttttcaatttcaattatgcaaacgcgcgttttctctctctagctcaaccatgtcagcacgacaaatcatcgaagtaccacaaacaccgcttctccgctcacaccatgaaggcaacggcggcggtcgccgtacttccctcgctcagctactcggacgcgccaccggacggagaggaccatctgtcctggtacgcgaaacggcggcgcgtgaactcgaagagcgtcgtgccgattggggatactcgaagccagtggtagcgcttgacatgtcgtggaacatggcgttcgttgttgtatcggcagtgatgcttgcgttcaccgttgacgagcgtccgaacatgccgatccgcgtttggatcgtaggttacgcgttgcagtgttttgttcatgttgtattggtgtggattgagtatcaccgccgtaataggagggattcgcggcagaggcagagggagagtgatgctgaattcagttccgacggtaacgatagtgatgacagcgatggcgacgtgaactcgactcagtccagattcaccaagcgatgtgaatcaataaataccggggtttcgttcctttggtggatggtgggcttttactgggttgtctctggtgacgatatccttctgcaagatgctccccgcttgtactggttggctgttgtctttttggcattcgatgtcttctttgccatcttctgtgttgttttggcatgcttgattggcattgctctctgttgttgtttgccctgcatcattgctattctctatgctgttgcgggacaggaaggtgcgtcagaagcagatcttagtatacttccaaaatacagatttcgattatcaaacaatgaggagaaggatagtggtggagctggatcaatggttcccatagaaaccaccagtgcatacttggcaactgaacgaatacttttacctgaggatgcggaatgctgtatatgcctctgcccatatgaggatggagtagagctccacactcttccctgcaaccatcatttccattcttcatgcatagtaaaatggctgaagatgaatgcaacttgtcctctttgtaagtacaatattctcaagggaaacgaacaggtataacacgttatgggagttttcaacgctgttgtgtacttgtgtatatgtagaaattcaagacaagaaacaccgatttgctcagttttgataattgtttggctgatctatttagagaagatttaggtcattttttcatgaataagttagccacgttactatactgagcattattttgtcctttgctagagtcatttgaaagttatccaattatggattattggagttctctgtaaaatatgttgccgttttgaaatataaaaatgtgggttcaataaaaaaa

SEQ ID NO: 115 - DNA, 1207 bp, Medicago truncatula
atgtgagatagataatagataagtgatttgaagaaagaagtgggaacagttggtggtttgttatttcaatggagaaagcagcaagcagtgtgttgaagcagatgaacatcaccagtcgtcttgttcttcccggcagttgctgctgttcttcctttcaatcttcatcttcttcatctctccactttccattcccaatctctgttccattcaaattccgcagcagaagatcaactaactctgtttctgacgctgcttttcctgttccatcttcagtgattaaggttgctgcgacggatttatctcttgcggtgaagaagaaagcagcagatgtatcccctgagctgaaagggtcctccatatttttgattggtatgaaaagctcactcaaaaccaatctgggaaaacagctggccgatgtattgcgatattattattttgacagcgataatttggtagaagaagcaataggtggtgcatcagctgcaaaatccttcaaagagagtgatgagacgggcttctatgactctgagactgaagtacttaagcaattgtcgtccatgggtcgactagtagtttgtgctggaaatggcgctgtacaaaattcaactaatctggcgctcctgagacatgggattacattctggatagatttgcctttagaaattgtggctagggatgtaaccgaaaacccgactcaatttccttcgtttgagatatcaacttcaggatcttacccagaggtaatggatgaactgtgtgctctatacaataagtacaaagatggatatgctacagctgatgcaattatttcacttcaaaaagtagcttctcggttgggttatgaaagcttagatgacattacaacagaagacatggctttggaggttctcggggagattgagaagttgactagagtaaagaagatgatggcagaagctgcaagaccattttaatcaacccgacaaatacttcagttacgaatttcggaattctaaaagctcttagggagattgagaagttgacaagagtaaagaagatgatggaagaagctgcaaagaccattttaaccaacctgggccatgcttccatttacctgtcatttcattattctaaaagtatttttgaatttgtttacatccgatctttgattattcgaataaaatgatactagtttcatttctaaaaatataaaattactcattcatgt

SEQ ID NO: 116 - DNA, 2882 bp, Medicago truncatula
actttctttatatttcccaaaaccctctatctctcaatcaattcacctcgtttcagcctctctcgctcttcatcttctcttctcagccattttcaccatggctgggaagcgtaaaactagctcaaaaaccaccacatccggcaatgccgttaccgttgattctgcttccggcgacactgtcaccgttaccgctgactcatcttccggcaacactgttcgtaaatctaggagattgacaaagtcatcctcctcatctgctgacgctgcgaatgttgctgctgattcagccaccggtgagacacggagtagatctaggaaaacaacgaaatcatctaactctaactcttccggtgatggtcctagtgtctccgctgattcaacatccggtaaagcccagaagaagtctgggaagaagacagatctggataagggtaaatctgttgtagcttcttctggtgttaagaaggaaccaaagactgaatctgatccgatgaatgttgacggtggtgataatgaagtttccaactccaaatttataggggatccaattccaatagaggtggctaaactgcgctggccgaagcggtatcaggagaaggaaaagaagaaatctcgttcaagatcaaatagtgatgaagaggaagttattctagctagatgtcactatacagagacacaggttgatgagggtgtgatatacaaactttacgatgatgcatatgttcaaggggagacggatgattaccattttatttgtaaaatagttgagatgtttgaagcagttgatggaggattgtttttcactgcgcaatggtactatagggctaatgacactgtcatcaagcaactaggaaatctcattgagccaaaaagagtatttttctcggagatccaggatgacaatccgttggattgtcttgttaagaagttaaccattcttagattagagctcaagaaggattttgatgcaacaaaggatattattccaccttgcgattattactgcgacacattgtatcttttaccatactccacatttcttaaactaccttcagaaactacagaaaatggtagtgaaatttcatcaacaatttcaaatgaaactgaagggaatggaaaagctgaggttgattctaaatgttcaaacactgatatttgtgttgaaaagaaaaagccacagatgaagttgctagatttgtactctggttgcggaggaatgtctactggattatgtcaaggcgggattttgtctggttcagatattatcaccaaatgggctgtggaccttaaccaagatgcttgtcagagccttaaactcaaccatccagaaactgaggttcgaaatgtcagcgcagaacttttcctcttgttgttgaaggaatgggagaagctttgcagttacttctctttaattgaaaattctgtgccacatgaggaatacgcaaatctttttaacgaggaagatgaagaggaggaagaaaatgacggcgctgttgaagagaatattgacggacaaatatttgaagtttctgaagtgcatgatgtacgttatgatgataaggaaactggacctggattattctttaaggtttcttggaagggctacaattctgataaagacacttgggagcccattactggattgagtaattgcaaggaaaggattaaggactttgtcactcgcggcttcaagtcaagcctcttaccattgccgggacatgtggatgtagtatgtggcggacctccttgtcagggagtaagcggcttcaaccgcttcaggaactatgataatccttcggaggatgaaaagaacaagcaattagtagtgtatatggatattgttcagtaccttcggcctagattctcattaatggaaaatgtagtcgatcttcttagattttcagaaggctttctaggaaggtatgcattgggccgtcttgttaaaatgaattatcaaagtcggttgggaattttagctgctggtgcgtatgggctacctcaatttcgccttcgtgtctttttatggggggccgcacctaaagagaatttgcctcaatttcctcttccaactcatgatgttatagaaagaggttctgtacctgtggagtttgagggttgtttagtggcctatagcgaaggacatagggcccagctgcaaaacaaacttgtgttaaatgatgctatttcagatctgcctccaattgagaacgatgaaaaccgggatgacatggaatatggcggacctccgttgaccgagttccaaaagtttattagattaagccaaaatgaaatgttgggtggttcgattaacaagaaatctccaaagtctctgcttcatgatcaccgctcttacgaaatgaacgttgatgattatcaacgcgcatgtcgaatcccgaaaaggaagggagcatgctttagagatttaccgtgtgttcgtatgcggaacaaaaaagttgaattgaatcctgatgtggagcgtgaacttttgccttctggaaaacccctggttcccaactatgcaatttcttttgtgcgtggaacttcaccactgccttttgctcggatatggtgggacgagactgttcctactgttgtcactcgaccagaaccccataatcaaaaaattctacatccagagcaagatagagtgctatccgtccgtgaaaatgctagattacaaggttttccagacttttataagctttgtggatctgttaaagaaaggtacattcaagttgggaatgctggttgcggttccacttggcacagctctacgatattgtcttggacttgcatctcacggtgcttctactgacgggcctttgtacaccctacctgatcattttccaaggaaaaaagcttccattgcggcatctgatcaa

SEQ ID NO: 117 - DNA, 2224 bp, Medicago truncatula
aaaccaaacagactatagtgtaaaacaacaccaacgttgttgttttgttcagttgagttgctctcacacgcacacagaaacactctccgagaatgttcggtctcgccgccgccgccgccgccacccgtgttctctgtgcaaccctttactctccttcttcttctttcactactacacatcacttttcttctcatcatcttccatcaactttggtttctttatcttcactgcgattcaggtgtattcctatcaaagctatgtcagagactgatgccccaaaatctgcttcgtcttctcatggcaacaagcaagctttgatatcgttgtcagacaagaaggatctcgcatttgttggaaacggactccaggaattaggattcactattgtttcaactggaggaacagcttctgcattggagagtgctggagtggctgttactaaagttgaacagcttacgcagttccctgaaatgcttgacggtcatgtcaaaactcttcaccctaacatacatggaggtatccttgctcgaagagaccaaaaacatcatatggaagctctcaatacacatggaattggtacttttgatgttgtgatagtgaacttgtatccattttatgataaagttacttcagccggtggcattgaatttaaggatggaatcgaaaacattgacattggtggtccagccatgattcgagctgctgcgaagaatcacaaggatgttttggtagtggttgattcagaagactaccctgcccttctagaatttcttaaaggaaaccaagacggacagttcaggctaaagcttgcatggaaagcttttcagcatgttgcttcatatgattctgcagtagctgagtggttttggaagcaaactgggggagataaatttcctcctagtttgacagtgcctctttcactcaaaagttctctccgttatggtgaaaatcttcatcaaaatgctgcaatctattttgatagaagacttgcagaggtcaacgctggtggaattgctacagccatccaacaccatgggaaggagatgtcatataataacaacttggatgctgatgctgcttggaactgtgtgtgcgagtttagaaaccccacatgtgtagttgtgaagcatactaatccttgcggcgtagcttcacgtgatgatattctggaagcctacagacgagctgttaaagctgatcctgtcagtgcatttggcggaattgtagctttcaatgtggaagttgatgaggttcttgctaaggaaataagagaatttagaagccctaccgatggggagacaaggatgttctatgaaatagttgttgcacccagctatacagagaagggacttgagattcttcgtggaaagtcaaagactctaaggattctcgaagcaaaaaagaatgaaccaggaaagctttcactcagacaagttggtggagggtggttagctcaggattcagatgacttgactccatccgacatcaagttcaatgtagtctcagagaagactcctcaggatggtgagcttcacgatgcagagtttgcatggttgtgtgtgaaacatgtcaaaagtaatgctattgtgatagctaaggacaattgtatgttaggtatgggaagcggacaaccaaaccgtgtcgagagtttaagaatagcaatgaggaaagctggagctgctattaaaggagcagccttggctagtgatgctttcttcccctttgcttggaaagatgctgtggaagaagcatgtgaaagtgggattggtgttattgcagaaccaggtggtagtataagagatcaggatgctgtagactgctgtaataagtatggtgtttcactactctttaccgatgtgaggcacttcaggcactgatcatttttgttttgggagaactttctgtttcaaacgtctataagaaatgctactgaatcctgtttttgacatcaagtaggtctataaggatgttgtaccatatattttatcggcgttgttaaatagtggctattgtggtgctatagtgctacaacgcagaggaatttgaacaaatcgttgttgtttcatatgctatttagtttaaaatagtcaaatggcagctaaagcgacgctatatcattgatgtgtagccgaatttgaacatgtcgctattttatgcgatctgagaaaattgcattatgtatcaaaatagtgctttttaattatgtttttattagctttttgtt

SEQ ID NO: 118 - DNA, 2267 bp, Sorghum bicolor
cgagtaaaaatgcgctgctagcaggggtgagcgggccgaggacggaggcttcatctcgtgtcgacgccttcctcgccctctccgtccgtctcgtcttccgctcctccgcagctggactcgtgcgctattccccaggccgccactcccactagggttttccggattaggtttctagaaccttccgtcgccgcctccccatgcacgcgccgccgctggtcgcgttcgcagggggcgcctgccccgccaccgccgcctcgtcctcgccgtcgccctggctggcctcgccgcgggccgccatcctcgccgcgccggcgaggctcctacggtcccgccgcggggcacttcggctggaagccaaggccgcgtggagggctgccggagggggacggggcccgagggtcccggccaagggcgctgtgctcgcctcctatatgggcgccgaggaggtggtgggaccttcgtcgctgctcgacgaggaagagctcatttcacatatcagaaaggaactggataatggaaaactccctgcagatgttgccagtaatctggaggagttgtattataattacaggaatgctgttctgcaaaatggagatcctaatgcatatgagatcatgctttcaaatatgacggctttgtttgatcgtgttctactggatgtacagaatccatttacctttccaccttatcacaaagctgtgcgagaaccgttcgactattacatgtttggtcagaactacattaggcctctggtagatttcaggaactcctatgttggcaacatttcactttttcatgacatggaagagaagctgcaccagggccacaatgttgttttgatgtctaaccatcagacagaagcagatccagcaattatctccttgcttcttgaaaaaaccaatccatggattagtgaaaacatagtttatgttgctggagatagggttgttatggatccactttgcaagccatttagcatgggaagaaatctcatttgcgtgtactcgaaaaagcatatgaatgattttcctgagctagttgagatgaagaggagatcaaatacccgaagtctcaaggaaatggccttgcttttacgtggtggctcacagttaatttggattgcaccaagtggtggtagagaccgcccaaatccttcaacaggagaatggtacccggcgccattcgattcatctgcagtggacaatatgaggaggcttctggagcatgctggcgttcctgggcacatatatccactatcattgctgtgctatgaggttatgcctccaccacaacaggttgagaaagagattggtgagcagagggtgatatccttccatggagtaggcttgtcagtaactgaagaaataaaatatggggatattactgctcataccaagaatgctgatgagggaagggagctattcacaaatactttgtacaactcagttgttaatcagtacgatgtgctcaaatctgctatctttagagatcgtggagcagctgtatcaaacaatgtcatctcattgtcacaaccatggagatgaatgttagctttctcagtttgggtccagatttattactgaagttaccttttcagaagagcaggtgaactgccattgtgcaatttcactggagaaactcttgaactttaatctttttgataccactcgactttatcagtcatggtggagcctgtcattgtcatgcagatccttgctaagaagtctgtggacaactgttggttggtcaagggtgactggtgattctgcacatagggatcctcgtaactgttgcatgcggtcgtccgcaaattactggttgctcagcaacgtgctggttgggcactgaggaatccgtcaggttgcatcctttttgccttgacgtcaatttgtgtagttgaaggttgaagtgataaattgttttatcttgtcttgtcatcatgtatataggctcgagtcttttttggctccacatttttttggagatataaaagcagcaggagttatgacatgccctcagtcggccctccttgttgaaaccctttggatgtaacctgtctatttcttatatatactcactgaaagtcaaggcaaataccctgtgtttcgagtacgtggctccatgactaccttgcggctcctgtctagctggagatggagcgtaaagaatctgtccgtctattatctgtagctgtagtgatttatttccttgggttggcattgtgacgaaagtgtagattgccagggagggcgaaggtgacaggatcg

SEQ ID NO: 119 - DNA, 1520 bp, Sorghum bicolor
gaagagatcaaccccaccagaaaataaatctgtcaaaaaaaaaagagagagaggagaaaaccctaggcgcaccgatcgaagaggagtgcatcgccggcgacgggtacgtgtatgcctgcggcgatccccagagaaggccaagaccgacgcctcctcgagtgacgctgccgctgccactcctactgccgccgagcccgatccgcttctgtactgtgctgactgctgatatgagggccgcgcagatcgatccgtccctcgccgcgccgcccaagtcgcggctcaagcgcctcttcgagcgccaggtgctgcgggtctcgccggccgagcgcctcccgtcggcgcctcccggtggcggggagaagcaggatgaggtgtcggagcccagctcgctgtgcctggacggcatggtgcggagcttcctggaggacggaggcggcgccgccgagcggggagctgctgcgcggtgctgcaactgcttccacgccggcgacacgtccgacgacgaggacggccccgctgcagccgacgccgcagccgctgacatcgcggagaccatcaaggggctcgtccactgcgccagcctccgggagcggaacctcctagccgacgtctccaccctggtggagcgccaccgcgcgtcaggagcccgcaagcgcgacctcctccgcctgcttgccgagtccctccgcgcagccggccacgacgccgcggtgtgcctctcccgctgggacaagtcggcgtcccaccccgccggggagcacgcgtacctggacgtgctcctcccggccgcgtcggagcgcggcgagcgcgagcgcgtgctggtggacgtcgacttccggtccgcgttcgaggtggcgcggcccaccaaggcgtaccgcgccgtgctgcagcgtctgccgtcggtgttcgtcgggcgggacgatcgcctgcgcctcctggtggcggccgccgccgacgcggcgcgcgccagcctgaagaagcgcggcctccacctgccgccgtggcgcaagctcgagtacatgcgcgccaagtggctgtccccgtacgatcgcgaggctccacctccgcctgaggccaccaccggtgaactcgccggcaacggcgagggaggtgggcccagtgcttaatcatcaccgaggtcgtttttggaataattttctttcttttttgctctttgttcttcgggaatttgcagtgtggtccttgcgtgtacagggactggacgcaaatgtcctgctttgtttttttttccacgctttcttttattctttctttccttttcacccttttgatgggtgtctattccccgcggcgtagtagttgtagtaagtagtgccggtaattatggaggagagaaaaggcacaaaaaaattgtagctttagtttgatgatgaagagataaaagaaaaaggagattccggacagagacctgtctgattcttttggtctcaatcgttgttccaggcagcggaacctgacaacgaacaaaggaaaccatgatttgttgctgtgaatcctgt

SEQ ID NO: 120 - DNA, 857 bp, Sorghum bicolor
ctccgcctccgcctccaccggcaccgcccccgcccctccgtcggcctcgccgcagcggccgtcctgctccactccacctctcctttcgccgattaacatccgacagccatggcgaagcaccacccagacctgatcatgtgccggaagcagcctggcatcgccatcgggcgtctgtgcgagaagtgcgacggcaagtgcgtcatctgtgactcatatgtgcgaccgtgtacactggtccgtgtctgcgacgagtgcaactacgggtccttccaggggaggtgcgtcatctgcggtggcgtgggcatctcggatgcctactactgcaaggagtgcacgcagcaggagaaggaccgggacgggtgccccaagatcgtcaacctcggtagcgccaagaccgacctcttctatgagcgcaagaagtatgggttcaagaagaggtgatgatgtatcacaggatcagtcaggttcgcttggcctcttgttgagtaatgctcatggatactgggagtaggatgttgcggcaacgtttgcgttatgtttattgatggtgatggataccggcttaaaacatgaactgggatggcctctttcgttctcagacgtgaacaagagattggtatatgaattgcagttgagcatccctgatgtgcttgtggttctatgtctgagtagccacagtttgactgatcatatcggcacacaatgtactcatgcaccatgagcatatgttctgaatttttgtgtttagaaattgaagcagaggagtaagtttggcaatcagaaacgacacattatctcctgttagaaattgtgacatcaccattactgaatatacacctgatcagtttcatattctc

SEQ ID NO: 121 - DNA, 2841 bp, Sorghum bicolor
gaaattactcattcagggcaaaagacacaaatccgaaaccctcgcatcatcctgcccttagccgccgccgccgcgacagagcccctcatctcggccgtcctccgcgagcaggcgtcgccggagactaaagatccggccagatctgatgtcaggagggggtggctcatccgggcgcgcggccccgcggtacgccccggatgacccgacgctgcccaagccgtggcgcggcctcgtcgacggcaccaccggctacctctactactggaacccggagaccaacgtgacgcagtacgagcggcctacgccccccgataaccagctactaccgcccccgcccccgttgcctcccccgcctccccggagtcgcgaccgccgcgacaggtccaggtctcgatcccgatcccgcaccccgccccggcgcgaccacagggaccgcgaccgcgaccgtgacaggcgccacgatgagcacgcgtcctccaagtcggcgtctgcccaccaccatccggctccggtagccgccgccgccgccgatccgtcgaccgaggcatatcgccgacgccatgagatcaccgtcacgggggataacgtgccggctccaataacttcatttgaggctggtggcttcccgtcagaaattctgaaggagttacaacgtgctggatttgcaagcccaacacctatccaagcccagtcatggccaattgctatgcaaagtcaagatgtagtagctattgcgaagactggatcaggcaaaactcttgggtatctacttcctggatttatgcatatcaagcgcctgcagaacagcactaggaatggtccaacagtcctagttttggccccaacaagggaacttgcaacacagattctggatgaagctgtgaaatttggaagatcttctagaatttcttgcacgtgcctatatggtggtgctcctaaaggtcctcagttgagagatttagatagaggggttgatgttgttgttgcaacacctggaaggttaaatgacattttggagatgcgaagggtaagtcttaagcaagtgtcatatcttgttctggatgaggctgatcgcatgctggacatgggctttgagccacaaatacggaagatagtgaaagagatgcctcaccgtcggcaaacccttatgtacactgctacttggccgaaggaagtccgaaggattgcagatgatcttcttgttcatcctgtacaggtgacaattggaagtgttgatgagcttgttgctaatagtgctattactcagcatgtagaggtcataacaccctcagaaaaacaacggcgcctggagcagatattacgatcccaggattcgggttcaaagatattaatattttgtaccaccaagaggatgtgtgaccaacttgcaaggacactcaccaggcagtttggagcttcggccattcatggtgacaagtcccagagtgaaagggagaaggttctgaatcattttcgatctgggcggtcacctattttagtggcgactgatgttgctgcacgaggtttggacatcaaagatatcagggtagtgatcaactatgacttccccactggtgttgaagactatgttcacaggattggcaggacaggaagggctggtgccactggtgttgcatatacatttttctgtgatcaggattcaaaatatgctgcggacctaatcaaaattctggaaggggcaaaccaaaaggtgccccgtgatttagaggatatggcttctcgtggtggtgggcgaggtaggaagaggaaccgttgggcatcccactctgacaggggtggttcacgttctgaactggattcaaggagtggtcgtggcagtcatggaagggatgattatggtagccgtggcaggtatgactctggtgaaactgatgggcgatctcgtaggtctgctagaggtcgcagtagaagccgtagcagaagtcacagtagaagccgtagcccaagtcccaagaggtctcgccgacatgaagctagacgtagcaggactaagagccggagtaggagcaggagcaggagctatagaaaccatcgtgctagccgcagcaagagtcgcagccctgttgctagccgaaggtatgaaaagactgctgctatttcaggatctgctcggcctaactcggggcatgcagagcacaaaagccctccaagatctcactctgtggatgaccatgtgaaccactctgaccacaaggatgaccacatggaagatgggaagatggaaagggttgatcttgatcgctcgcccagcccacaagatgacaagtctgctccatatagtcctgtgtacaatggcaaagccagtggctcgatgagccccaacgttcagccagaggcagatgccaaatatgtcaaaccttctgggaaacctgagcctgcatctccagtgcgccacagcaaaggcagagatgatgatgaggaaggtatcatagacgaggatggagagattgctgaggatgatccacgtgcaaatgcagctgtgcagaatggtaataactgacggagagtggcctgcatcttatgtgacaacaagcctctgttatgcaaactgcagtcattcccatctgcaagagtccagaatacagaaatgcatttgtgtgccattacaaatttctcgtagaacatatgatagtgatgcctctgccatctatatggaccaaaactgttgatgcatgtcatgttatgttgttaaacttaatgacattgttgtgttctggtgtcttacggccagttctggaaattgccttatgatacaatatattgtcaggtctgaatttataatttatgatatttgtcaggtctggaagtatttatgatatt

SEQ ID NO: 122 - DNA, 1369 bp, Sorghum bicolor
cttcgcctgatcccctcgtcgcacgagtctccgaagaggcgagagcgacggccaagaaacgtggccgcgaacagagacgaccgcggcgacagccacgagctcttcctcgtcccccctgctcccaccccacaacccctcgccgcggcctcttcctccctccgcccctgagaccgctccaggccgctgccccgcttgcatcgcgcattcgcgggaggtggtttcagggcattatggaatgcttaacaacaagttttgcaagaaatgtgggaaaagagcacagcttcgtatgttcaagtaagttggtgtctgaaaaccaatgggttccaagaaggatttgctgctatgtctctagttcaacaaactccagtcaatggtgcaagttcactaatatggcataccccatgagcccaattatccggaaaaggtcacactggagatcctttgctgcaagtttgaacttagaagatggccctgcaccctctgactcaacgtcatcttcatcagagcagactaccgccgatgctgatggaactaccaacggtgatgcatctgaagatctgctttctcaaaagctgagctctgatgagttaaaggctcttttggctgattcggaacgaagtaagcttttgagaagactcagcgaagcaaatcaatataaccgattcctcaagagacagttgcaaataaaggatgatgcagttgtaaagttcaaaggtgaacttgctgttttggaactagaactgcaggctctggttggcctagctgaagagattgctaattttgatgttccgttagggtctaggaggataaatggaaaatatattcaatctcatcttctctccagattagaagctgttcatgataagattgtggaacatataaaggatgttgactctttaaagaccaaagaaatttctgtctactgggttggcatggctgagaatgtgcaaattatgggttcattcgacggatggtcccagggtgaggcaatgtccatggagtattcaggtgattatggaagattctctgcgactctgaagctaagacctggaaggtatgagatcaaatttttggttgatggggaatggagattgtcacctgaatacccgactgctggagatggaatgacgcagaacaatattcttattgtggagtaacagaactttctcatgtagcattttagtcatccaaacaatgccaaagtgtaccttcacttcatgccttctaccatctgtaaaattatgctaccatgtggttgcctcacagaaaccagtgttcgttgaaatgcaaggtttccagttgcatcagtgtgttctttatcctgacatatgctcccttagtatttaaatgtatgatgaattaattagcc

SEQ ID NO: 123 - DNA, 3218 bp, Sorghum bicolor
tgcgagactgcgtgccactcggcccaatcccctccgtcccctgtctccctcccggccgcacccgaacccacccgccgccacacgtcccgccgtcgccgcgatggacgccgcggaggcgtcggagctgcaggcgcggctggccgcggccgtgcacgcgctcaaccacgacgcgagcccctccgcgcgcctcgccgcaaaccagtggctcctcgcgctgcagcggtccccgcaggcgtgggcagtcgctacctccctcctggccgccccggacccgcccccgcccgccgacctcctcttcttcgccgcgcagatgctccgccggaagatccagtcccccggctccgctttccccgcgctcggcctggcgccgcagctcctcgacgcgctgctcctggcagcgcggcggttctgcgccgccccggccccgcgccagctgctcacgcagatctgcctggcgctcgccgcgctcgcgctccgcgccgagggcggcgtcgacggcctcttcgcgcggatgccgcacctgccgcccccagccgtgctggagctgctcaccgtgctccccgaggaggctgcgcaggaccagggcggcgacacgggggtcgacgccgccgcgcggtgccggttcacgcgcgagctgctcgcgcacgcgcccgccgtgctcgagttcctccacgggcaatccgagaaggcacccaccgatgacgatggggttcccctccacgagcgcaaccgcagaatcctccggtgcctactgagctgggtccgcgtggggtgcttcttggagacgccggcagccgcgcttgccacgcacccacttctcacttttgcgttcaactcgctgcaggtgtccttctcgtttgaggtggccatagaggttatgattgagcttgtcagccagcaccaagaaatacctgaggcctttctgagtaagacaccttatataagggaagttcttcttctaccagctttagccaaccgaagtgagaagatcattgctggtcttgcctgtttgatgtgtgaagttggccaggcggcacctgctttggttgcagaagggggtggccaagcacttgctctcactgatggacttttgagatgtgtagcttttactagtgaagattgggaaattgcagagtcaaccttgcaattttggtgcagtttggcacattttattcttggtattgatgtgaagacagccaaaagaaatgtggtacgagagttgtttgtgcctgtgttttcttcactgctggatgctcttttatttcgtgctcagatggacactgattctgatggagcaccttgtatacctgagggactaacacagttcaggatgaatttggaggagctcctcatcgatatttgtttgcttctaggtgcccctgcatatataaacaagctcttttctggtggatgggacttctcaagccaaacaattccttggaaggaggtagaagttagaatgtatgcactcagcatggttgctgatacgattttacaagatgaaagctccttcgatttttcaatcataatgcattttgtaaacattttgtccagcagaacacctgttgaactgaatggaagtttgtttttggtatataaatcgtttggtgatgtcattggttcgtactcaaagtggctatcgtcttctcaaagtaacattaagcccttactcctgttttgtgcgtcaggaatttcaaaatctatatcatcaaatgcttgctcgttagccttgcgcaaactttgtgaggatgctccttcattcatccatgaacctcagaaccttgaaattcttttctggattagtgagggcatgaataaagggaacctgcagctagaggatgaagaagagataattagtgcaatcacacatgctttaagttctgttagtgaaaaagagttgaagaaaagttcactggccaggttactttgttccagttactcagcagtggaaaagattattgacatagacagagatcaatcgctaaggcaaaatccagctgcttatacacaatcgttggatcttgctgtccgtggtctttacaggatgagtgctttgtttcatcatttggctacatcagtcacatctggtctggttgatgatgatataattatagttcttcttggaatactttggccacttcttgaaaagcttttccgatcatctcatatggagaatgtgaacttatctgcagctgtatgtcgttctctttcttctgctatgcattcttgcggacaccactttcatattttattacctaaagttatggagtgcttatctgcaaatttcttgctgtttcaaaggcatgactgcttcttgaggacagctgccaatgttattgaagagtttggccacaaagaagaatatggggctttatgtgttaggacttttgaaacacttagctctgcatcttcaatatcagctctgaattcttcttatacctgtgatcaagaaccggacctagttgaagcatatacctactttacatctatgtttattcgctgctgtcaaaaggaagctattgtggcatctagctccctgcttgagttatcatttcaaaaggcagctatatgctctacagcaatgcaccgaggagctgcacttgcagcaatgtcatatatgtcgtgttttcttgagtctgtccttgctgctgtgctagaatctcctgagtgcatccctaatgggtcacctggtgtggccttaatccaaatattggcacgctgtggtgaaggtttattatctaatgtgctttatgctctacttggtgtatcagcattgtcaagggtgcataaatctgccacaatattgcaacaactggcggcattgtgcagtttctgtgaggcaacggcatggaaggctgttcttagttggaattctctttgtgggtggctacaatcgacggtgaaatctttgccttcggagtatctaaagcaaggggaagctgaaatgatagttccattgtggctcaaggtgcttcaggatgcaggctcagactatctttacagcaggactggtgataatataagaagccatcaaggttacatgcaagggaagggtggcagaactcttaaacgcataattagagattttgcagaaagccaccggaatgttccaattcccagtacttcatgatatggatccccagtgctgacagtagcttggagtctgactctagagaagggtccttgtggaactgatgtccgtctttgctggcatgcta

SEQ ID NO: 124 - DNA, 2566 bp, Sorghum bicolor
cttcccttcgtgtcccctgtcgctctctcttccccgctctctctctctctctctcgctctcgtgtgggttcgtctaatctagattagatgcgatgatgatgattcgaggcgctagcttattttagctggaatcccaggctaaaccctggctccttggttcagcgggcctcccggtgagaagaatcgcatatccgatcaggatggagacggagaaagtgaagtctgtccctggtcataatcacgctgggagtggatgataagatcataaaaagaaaattctgacaaacatcagtcacaaactcacaactcatattgttgtgctttttccctgagccactgaggtcaggagtgattgattggtttaagttcagtgcacgctgcaagcggtggcatcatgggtagtgcctgttcgaggaagaggggccagttggtccaagaggatgatctctacagtgcgaggttctccaagagcggcagcttcaagtggctgctgcacacgctgccccgcagcaactctgccgatgtgcagcggagaacacagggcccagcgccaggccggtgcccgtctcttgtggagctatgtgtggccaaagtctgcgaggacataaataggtattctgatttctccctcctgcccagagatcttagtcagcagatattcaatgagctggtggaatgcggatgcctcacggaggcatcgcttggggctttccgtgattgtgctttgcaggatgtttgtctaggagactaccctggagttactgatgcttggatggaagtagtggcttctcaagggcagtccttgctatctgttgacctctcttgctcagatgtgactgatagtggattcaatcttcttaaagattgctcaagcatgcaaagtttggcatgcgattattgtgataaaatctcagaacatggacttaagacattatcgggcttttcaaacttgacatcgctgagcattaagaaatgtgctgctgttactgctgaaggagcaaaagcctttgcaaacttagttaatttggtaaacttagacctcgagcgatgtccaaagattcatggcgggcttatacatttaaaaggcttgaaaaaactggaaaaactgaatatgagatactgtaattgcatcacagattcagacatgaaatatttatcagatctcacgaatttgagagagctacagctctcttcctgcaaaatctctgattttggtgtttcttatctgagaggtctgcacaagctaggtcatctaaacctggagggctgttcagttactgcagcttgtttggaggttatatctgaactggcttcgttggtcttgttgaatctaagtcggtgtggcatatgcgatgaaggctgtgagaacttggaaggtcttacaaaattgaaggctctaaatttagggttcaaccacatcacaggtgcatgtttaattcatttaaaagatttgatcagcttggagtgcttgaacttggactcatgtaagattggtgatgagggtctatttcacctgaaaggcctcatacagctaaaaagcctggagctttcagacactgaagttgggagcaatggacttcgtcatctgtctggtctacgtaatttgcagagcatcaatctctcttttacattggttactgacattggtttgaagaagatctctggcttgagctcactgaagtctcttaatcttgacaatcgccaaatcacagatactggtttagcatctcttacaaatctcactggattgacacaccttgacctatttggagctcgcataactgattctggcatgaactgcttcagatttttcaagaatcttcagtccctggaggtctgcggtgggttgattacggatgccggtgtgaagaacatcaaggacctgaaagctctgacgttactcaacctatctcaaaatggcaacctcacggacaaaaccctagagctgatctctggcctgaccgcgctggtgtcgttgaacgtgtccaactcccgggtgtccaactcaggcctccaccacctgaaaccgctgctgaacctgcgctccctatccctggagtcctgcagggtgacggcaagcgagatcgataagctccggctggtcgccctccccaacctgatcagtgtccggccggagtgataggaccagcacttccacagcgacctgtaactgtaaagcaactgctgcttgactagagcaggtcgccttgtacatacttttgcaagaacgagatgtctgtacatattgttctttgtgtcgcgtcggtgtgcctgatggcaacggatacctccgtgtcaccgtgtgcacggtatcccacggatcctgtgataggaaggaacaattgtaaatatgtcgtgcttcctccatgtggggtgctcctgtgtaaatagattggtgcattgctaaatacctctccttggctgctgtgtaaatagattagtgcatttctaaatacctctacttggtatcggttaaatgctagttttgatgtaaaatcgtggtatcggttaaatgctatagtttttatgtaaaatcgtggtatcggttaaatgctagttttgttgt

SEQ ID NO: 125 - DNA, 1238 bp, Sorghum bicolor
ccgcagccgcagccctagttccgtcagaaatcccccttctcgagtccatctccatctcatccctcccaccccaatacatccggccggcgccatcccgggcggcgcgcacgcgagggtgaccatcgaaccctagcccccggccgagccgctcgcccgccgtgcatcgcgggatcgctcgccccctgccgcgcggccgctctgcgccgaccctattagaatctccgtccgacaccgcttggatccgatagagatggaatcaccacccctcacagctgaagcaattgcttttaccgagaaaaagatggacatgactttggaggatataatcaagatgtcaaagaaaaagaatcctggaggcaagaaacctcccaggcagccgatcaaaaagcgtccattccagaatggcaactctaataaagggaatggcaaggttcaacagtttatggaatctagatcaaccattagacaaggtgttcttgcacagagaaggtcaaatcttggtggaagtcagttccctgctacaaagcaggctgcaaagaaggctgctgctatgccaatgcgcaacggggctgtgcgttggaacaagccaagtggaagtaccttagtgcagaggaggcctgtaggtgatgcttttcagaattccaaggtcgagtcgtcgcagaaccaggcagcaccaaggacgatggatgcactctttgcacagatgaaggcgcaacgcatgaggaccgtaccacagcagcaggcaaaccctgcccctgggcgtcatttcaaccagcagcgacgtgttcagcagcagcagaggcgaggtagaggatatggtggccggaatgttggcaaccaatgaattcaactaagcatatctgctgcatcgaagcccattctcttcactggtcttacggaccttggaagaaaagacgcccctgggaaaatctaacttggctttgtttttttagaggaaaggttgtggacagaatatgaagcgaagtttgtgtggagttttctagttacctgcttccgtttcaacatgtataatgacctatggaaattatttggtgctacattatgatgtcgtgtttcttgagttgattaggttcatctcttcttcaaaagaattaggagtaatttgccttttaccctatgatgtataaattttaaaataccattcctgtgaggttgacaagctaggtatatgatactcttttcgtttcaaaattataagatgttttggttttctaaat

SEQ ID NO: 126 - DNA, 2366 bp, Sorghum bicolor
caatccccatccccaaatctcccatggcttcttcccctcccccaccgcccatccgcaccgtcctcgccgccaccctgctcctcctcctcgtgtacctcctcccgcacaatgccgccgccgccgccgccgtagccgacgcgtcgtctgcggtgaacccgttcacggcgaaggcggcattcatccggtactggaaccgcaaggtgcccaacaaccgcccgcacccggccttcttcgtcgccaagctctccccgctcccggccgccgactccgcctccttccccaccgcgctgcccgacatccgcgcccgcctccccgagctctgcaccaaggccgcgctcctctgccccggcccggctaccaccgacgcggcatcgctggcggcatcgggccccagaggcgggggcccgttcaagggctacagcaacgccaacttctccaactacggcaccggcggcgtagcgggggccgactcgttccggaactactccccggacctcaacatcgccgccgacagcttccgccgctacggccgggactcgtcgggacgcgccgacagcttcgcctcctacgagtccgacggcaacgtcgtgaccgccaacttcacctcgtacgccggcggcgccacgggcgggtcgggctccttcgccgcgtacgccgcggagaccaacgtcccggactccaccttcaccaactacgacgccggcgccaacggccgcggccggagcttcgcgtcctactcccaggaggccaaccacggggagaacggcttctccggctacggcaagagcggcaacggcgtgcgggagacgttctcgtcctacggcaacgagtccaacgtgctgggctccggcttcgccaactacgggcagtccgccaacggcgccacggacacgttcacggggtacggcgtggaggggaacgtccccgagaacacgttccggaactacggcgccggcgggaacgccggcgtggacaccttcaagaagtaccgcgacgacgccaatgtcggcgacgacaggttcacctcctacgccaagggcgccaacggcggcgcggcggagttccagagctacggcaactcggcgaacccgggcagcaccaccttcaagggctacggcgagggcagcaaccccaaccaccacattgggttcaaggagtacgccggcgagaacaacaccttcaaggggtacgccaagaccggcgtcagcttcaaggagtaccacaacacctccagctctactgcggcgctgacggtgtcggcggaggcggcggcatcgatgcagcaccacgaccacctgaagtggtcgccggagccagggaagttcttcagggagcaggagctggtgtccgggaaccgaatgccgatgccggacatcagggacaagatgccgcccagggcgttcctgccccgcgccatcgcggcgaggatccccttcgatccccaggccgtgtcggaggcgttcggtctccccctggacacggcgctggggaaagccgtgtcgtcgacggtggcggagtgcttgcgcgcgccgagcaagggcgagacgaagcggtgcgcgacgtcggccgaggacgtggtggactttgcggtggagacgctgggcgacgacatcgtggtgcgcagcacggcgtcgacggcgggcagcggcggcgacgtccggctcgggacggtgacgggcgtggacggcgggaaggtgacgcggtccgtgtcgtgccaccagagcctgttcccgtacctggtgtactactgccactcggtgcccaaggtgcgggtgtacgaggccgacatcatggccgccgccgccgccgccgatgatgatggtggctcggacgccggcgagaaggagatcatcaaccacggggtggccatctgccacctggacacgtcggactggagcccgacccacggcgcgttcgtggcgctgggcgggaagcccggcgaggtggaggtgtgccactggatcttcgagggcgacatgacgtggacagtcgcggattgagtgacgacgttcgttctcctgccctgctgctagcgggctttgcaagatcacaacaagactgaactactaagaagaattattttctctctcgcaattaattttttttttattttcactcctttcttgatctaccttatataacgaacgaaggtggtaagaattgtgcgattggtgcaggaggagaaaaaaaaggtttggtgatgatgaaaactgtaaaactgtaaaaatcttgggtgggggatggaatggaatagctggcgatgtgattgtcttgatcaaattgctgcttatggtcaatggtggtggtgcaactgcaaacaaaggaattagttataattccaaaacaaaagcttggtcaaatttgag

SEQ ID NO: 127 - DNA, 1332 bp, Sorghum bicolor
aaccccgaaccccccggtcccggcggcggcacgactgcagaagcttcccaaatcctctcctctcctctgcccccctcccctctcgcgcctcccacctctctccagccggttccccgcgcctcgcctcgcctcgccgcgctttgcctttgcgcagggcgcactcccggcccggtatattatataacccgccggctccggtgagattcgacccaagtcgatggggctcgagatggaggtcatgtctgaggctgctgctcctacgacggctgttgtgcctgcggcggcggcgagggagccgggggtggatgtggatatttacccgctcacacgctactacttcggcgccagggacgccgccgccgccgtgccccgcggcctggagaccgccgctgaccgcgcgctacggctcaaggcaaacttcgcggcgcgcgggctccgcaccagcgtccatggcgtcctcctggtggagctgttcgatcacccgcacctgctgctgctgcaggtccggaactcctcctttctgctccccggaggccgcctcaggcctggcgaggaagaggtccaaggcctcaagcgcaaactctccagcaagctctcctttgtcgatgcagatgatgatcagaccattgaagaagaggatgactggcagattggagagtgcatcgggatgtggtggagatctgaatttgaggccatcccatttccatacatgcctccaagcttccgtgcaccgaaggaatgcatcaagctgttcctggtcaggctgccgatgtctcggcagttcatcgtgcccaggaacatgaagctcctggccgtgcctttgtcccaggttcatggcaatgctcaggtttacggtccaattatatctggcattccgaatctactgtccaagttctccttcaacgtcatcagtgactgaaatatgggaaccggaatctgagggtttagtagacagacgtgcatatttggctaatcgtagtcatagagcagtatgcgataccgatggaagcatgtatcgattgagaagtagcttatccgtactgtgtgtttgtatagcgtatccccccaccccctcgctgatacattgagatgtactgtgtgtatttcttgcgacatgtgttcgaccgtgagaggatgattcggttctgtacaatatctcaagtagttatgctgctcgccgaccgcttgtcccttatgttgtgtatacctttctaaaatttgtatggcttgtaagccttgtacattgatatgtattgtacagtgtttctactgtttctttttccctttttgtcatatagaggttaatcaattacgtgccatatagaggttaat

SEQ ID NO: 128 - DNA, 2651 bp, Sorghum bicolor
cgcccatccccgccgccgggtagagcccgatccgacggcccccgccgcgcccatgggccgcggcggcggctcgcgcgcggccccggccgccacggcgccgccgtggcacgtgctcccggacgaggtctgggagcacgccttctccttcctccccgcggactcggaccggggcgccgccgccgccgcctgccgctcctggctccgcgccgagcgccgctcgcgccgccgcctcgccgtcgccaactgctacgccgcgtccccgcaggacgccgtcgaccgcttcccggccgtacgcgccgtcgaggtcaagggcaagccccacttcgccgactttgggctcgtcccgccagcctggggcgccgccgccgcgccatgggtcgccgcagccgccgacggctggccgctgctcgaggagattagcttcaagcgcatggtcgtcaccgacgactgcctcgagatgatcgccgcctccttcagaaacttccaggtgctgcgcctcgtctcctgcgagggcttcagtaccgccgggctcgctgccattgccgccggttgcagaaatctaagagaacttgaccttcaggagaatgagattgaggattgctctattcattggctcagtctctttccagaatccttcacttctttggtaactctaaatttttcatgcctagagggggatgtcaatatcactgtacttgaaagactagtaaccagatgttgcaatctcaagactctcaagctcaacaatgctatacctcttgacaagcttgctaacctccttcgcaaagctcctcagattgtagaacttggaacaggaagattctctgcggattaccatccggatctcttttcaaagcttgaagcagcatttgctggttgtaaaagcttaagaaggctctctggggcttgggatgccgttccagaatacctgccagcattttactgtgtatgtgagggcctcacatcactaaatctgagctacgctactgtacgaggccctgaactgattaaattcattagcagatgcaaaaatttgcagctcttatgggtgatggacttgattgaagaccatggtctagctgttgtggcatcatcttgtaataaactgcaggagttgcgggtcttcccttctgctccttttgatgcagctgagcaggtttctttaactgaaagaggtcttgttgacgtctctgctagttgcccaatgctggagtcagtcctctacttctgcagacggatgaccaatgaggcccttattaccattgcaaagaaccggcccaactttacttgcttccgcctatgcatcattgagcctcacactccagactacactacacaccagcctcttgatgcaggttttagtgccattgtggaatcatgcaagggccttaggcggctttctgtttcaggccttctcacagatagtttatttaaatccatcggggctcatgctgatcgtcttgagatgctctcgattgcctttgctgggaacagtgatttgggcctgcattacatcctatcgggctgcaagagcttgaagaagctagagatcagggactgcccatttggtgataagcccttgctggcaaatgctgccaagctggagacaatgcgatccctttggatgtcgacgtgctcactgaccctgggcgcatgccgacagcttgcacgcaagatgccccgccttagtgtggaggtcatgaatgatcctcgacggggatgccccttggactctctcacagatgagagccctgtcgagacattgtatgtctaccggacaattgcaggtccaaggtctgacacaccagcctgtgtccagattgtctaaggggcggccacctgtagtttacaaaggtactatggaagtgtccattttcaatctcattctgtaccgtcaacaccttactagcataacttggatagtctccttgaagtagaaaggctggtgatctcgataatcctatcataatctctgatcagctgtacaactgtttctgcgagtttagggcaagactcgggggcccctttcaggtgttaataactgtagggaggagactcgacgagttacaggaacaactagatagcgtcttgagaaaacttgggtttgttttcttagcgtgtttagttcttttcatcatgtataaaaaaatatgggaccattccaatgccacaatgtactgtactattggaacaattgtacctggagcctctacttttttgacctcccctctctaattatgagtttctgttgctccagcttgtgaaataattatgggtgaatgtggctctgccttcatgtggcatctctctcgttctggagaatggtggagaatggtaacttcactggttgtaagtcccacccttattaaggcttgagcatctgaactggaagtgtatccacctttaggccgtgacgctgggtggtttagaggtctggtttgcttcaggttctggtgttgtgctttgatttcaatttagttaagttgtaaaacgtgttccttctccagccgaagttggatttaccactagggattagggaaggcataacttgtgtgttggtattgaatttagtcacatgtgaatccatccattccatatgctctactcagctgagtgctggacagagaatctaatttgttttcctagccttg

SEQ ID NO: 129 - DNA, 640 bp, Glycine max
acaccatccaacatggcttaattggtctcctcaaactccttgcattctttctttctttacaacaatgactttcgaagagaaaacaatttatcaaaccactttagcctcaattccccactacacccttctagagtgtgtcttggggatttgcttcacagtgatcaccatcctccttcagcttccttatgagtacatagacaacaatccagttcccaccatagtcttcaagggtcgcccgagaacattccatgccttcataatatgcataatcttcgccttctcgggtgccaccaatgcacttgtggcattcaataagtcaagattttctaggctttgtgggtattatgcaatggcttctatggcttcggctttggcaattctcttgtgggcattgtgctgcacatgtatcaattagaaaggctggactttgattctggaactgctatagctttataaagattaaacagtcctgtgttgtatcttgaagatttttggcttcaacctcttaggaaactattggtttgtgagagccagtatgataaaacttttgatcaaaatttgaattaagtaattattgattggtaatttattggattaataattataattttaatggtaaaacatattaaaattgattatt

SEQ ID NO: 130 - DNA, 775 bp, Glycine max
agccaatgaagtgacccgtgcgtggatccccaccctatctgtgccttatcctatgtatgcgaattaaatgaagcaagcattcataaagcataactgaagaaaactaaggaaggaaggaaggaaggaagagtgagcgtgaaagatgccttcggcgaggctttcagggtcaccaaggctcgacgttgctattgacatgggcaatccatttctcaatctcactgttgatggtttccttaagatcggagctgtcgcagccacgcgatcagctgctgaagatacttatcatattatccgaaacgggaatatctcaagtcatgatttcgagaaaacgttgaagaagatgtgtaaagaaggtgtatattggggaactttagctggtgtttatcttggaatggaatatggggtagagaggatccgtggcaccagagattggaagaatgccatgattgggggtgcagtaactgcgactctgttatctgttgccaccaccaacaacaaagacaaaattgtacctgatgccattactggggcagcaattgctactgctgcagagttcataaattaccttacctgaatgaatgaaagtggatgtcttgctggttttcttgcatgttttggaaagggattgcaactcagtctcttttgtcatatactttgtaacggttccatcttgatattggtgcagttacttctaagatatgctatttatttaactttctataaaacctatgttttgataaattatattggccaatggtttttccgcatgttagta

SEQ ID NO: 131 - DNA, 2865 bp, Glycine max
cttttttgaaataatcttccatatgaacagagttcatctcctcctccattctccggcaactacactgttccatcattgcttataattctctggtatcttctatgaaagccaatttttctggtgtcagctgttgaaaaattggggtgcttaatattctacaaggaaattttccatctggtaattatgcatgtctggccccgtgaccatagctgattattcaaatggaggagcactttcttgtgcagagagaacaaaatctgttgatgcgattcctgaattagaccatctgtcaatattgacaaatggtgaaattgacggctttagtgttggacaactcttactttttaatggggagtcatattctggatccctttatggcaatgtttctgaaggccatggaacgtacgtgtggtgtgatggttgcgtatacgagggtgaatggaggagagggatgagaaatggttatggaaaactaagatggccttcaggagcagtgtatgaaggtgatttctctggtggatatatccatggtacgggcacatacattcgttctgataaattgaaatataaaggtagatggaggttgaatcttaaacatggtttggggtttcaagtttatcctaatggagatacctttgaagggtcttggatgcaaggaacacaagaggggcctggcaagtatacctggaccaatggaaatgtgtatgtagggaatatgaaaggtgggataatgtcaggaaaaggaactcttacttggataaatggggactcatacgaaggaaactggttaaatggcatgatgcatgggtttggagtttatacttggagtgatggaggatgctatgttgggacttggacatttggtctaaaagatggcaaaggaaccttttacccgagaggtagccgtcttccttgggtgcaagaaatttacctcagtgccttgagaaaaagagggttgctgccagatttgagaaaacagaaacaggtgagagatgtcaaggtaccagagaaccatatgtcaagtcatgtttcatctgataagtttgcaaaaggaaacctgttaaatctggaagagtctaatagaagaaatgtctctctcgaaaggcgttggagtcttgaggtgtctattgagaaggtgattggatatgattcagcattaagatttgcagaatctgtaccagaaagtagagatggagaagttgatgcaatgatcccaattttggaacgagagtacatgcaaggtgtgttaataagtgaggttgtgttaaataatatgttttcatcaatgtctagaagggcacggcgacttcaaaaaaagcttgtcaaagagattaaaagacctggtgaggcaatcattaaaggtcacaggagttatgatctgatgctcagtttgcagcttggaataaggtatactgtgggcaagataacacctataccgactcgaggagttagagcatcagattttggtcccaaagcaagcttttggatggattttcctaaagaaggttctcaattaacacctactcatcaatcagatgattttaaatggaaagattattgtcccatggtgtttagaaatttgagagagctgttcaagattgatgctgccgattacatgatgtccatttgtggaaacgatactctgagggaactatcttctccggggaaaagtggtagtgtcttcttcctgtctcaggatgatcgtttcatgatcaagacactgcgaagatctgaagtcaaggtccttctaagaatgcttccagactatcatcatcatgtgaagtcatatgaaaatacacttatcacaaaattttttggtctgcacaggattaaaccttcaagtggtcaaaagtttcgctttgttgtaatgggaaatatgttctgcacagacttaaggatccatcggaggtttgatttaaaaggttcttcccttggaagatcatcagacaagatagaaattgatgagagtactacgctcaaagatttggatctgaactacagcttctacctggaaccatcttggcgagagtctttactaaagcagattgaaatagacagcaaatttttggaagcacagcacattatggattacagccttcttctaggtgttcactatagagctccccagcatctacgttctcacgtttcatacaaccaaagtagaagtgtggatggattagcaatgcttgcagaggaagatcctctagaggatgaagtattctatccgcaaggccttgttctagttcctcgaggaggagatgatgacagtgttgttgttggctcacacatgaggggtagccggttgcgagcttcatctgctggtgatgaggaggtggatctacttctacctggtacagcaagactccaaatacagcttggtgtgaacatgccatcaagggcagaacagatttcaggaaaacaaaaacaagaaaagcaaatgtttcatgaagtgtacgatgtggtgctgtaccttggtatcattgacatattgcaggactacaacatgactaagaggattgaacatgcttataaatctcttcagtttgattcattgtctatctcagctgtggaccctacgttctattcgcatcgcttcctggaatttattcagaaggtgtttccaccaaatgcaacgacaggttaatcaagataattttggggttatatttaaccagtaagtttatttagaaagtgtgaatattgcacttttcatgcttgctccagaatttttatagtaggtggccacgtgggcaccttgttgatggtggtaataggaatcaagtgaataatgaggtaaatagatttatctcatgtaaagtgagtaaatatataataaaaaaaaagtgttatatttattattgactt

SEQ ID NO: 132 - DNA, 1337 bp, Glycine max
gcaaactagaaaggagaataaagaaatgggcgcaacgaagagtggacgagttaaacttggaacacaaggccttgaggtttcaaaattgggattcggatgtctgggtcttactggagcgtataatgagcctctcccggaacaggatggcatatctattatcaagtatgcattcagtaaaggaatcacattttttgataccgctgatgtttatggagccggtgctaatgaaattttgcttggaaaggctctgaagcagctacctagagaaaagatccagctagccacaaaatttggtattgcgagattagatttttctaacatgctgatcaagggttcgcctgaatatgtgcgctcatgctgcgaaactagcttgaaacgtcttgatgttgaatacattgatctctattatcagcatagggtggacacatctgtacctatagaggaaacagtgggtgaacttaagaaactggtggaggagggcaaagtgaggtatatagggttatctgaagccagctcagatacaataaggagagcgcacgcagttcatcccatcacagctgtgcaaatagagtggtctatatggactcgtgacattgaggaccagatagttactatctgcagggaacttggtattggaattgtatcatatagtcctcttggtcgtggtttctttggcggcaaaggaattctggaaaatgtgtctgcaagtagctccctgaaagtacatccacgctttcaagccgagaacatggacaagaacaagaatatatatgaacgaattgaaagccttgcaaagatgcatcggatcactcctgctcagttggcattagcgtggctactccagcaaggcgaggatgttgtacctatccctggaacaactaagattaagaacctggatcagaatataggtgccttagcagtgaaactgtcagagaaggacctgagagaaatttctgaggcggttcccattggtgatgtagcaggcggaatacactactatggactggaacacattacctggaagtatgctaacacacctccaaaagattcgagcatctcaacctgaagcactcaacattcaacttctgttagagaattccactaagtcgtgaatgaggctaacgaggctgacaaaggctaatatcagcaagctataaaaatatcaataatgtagcccaggtctctattcccctatgtcttgtgtaaagctaaaatttatgcttgattagatgatgccactgttatggttagttttacaaatattttgtttgtaacaaataaacctccaagataatgaagtatgtgcttcacttcattccaatatatttgtgtaggtg

SEQ ID NO: 133 - DNA, 1242 bp, Glycine max
atgatatacatcatcaaccccgaaaccaaaacctccttcaaccacgctagttcaactcaaccaattacttcatattcatatatatggattcccctgcagtttcctctatccactttcacaacgcccatgtcttacccgaaccagacctttttatgcacactcccggtggtaaccgcattccagcgcacgcaaccattctggcttcggcatccccagttttagaaaacgtcattgcgtccaaccgagtcgtcaaaatccacggcgttcccgacggcgccgtcacggccttcgtagcgttcctctactcctccaggtgcacggaggaggacatggacaagtacggaatccaccttctagcattgtcgcacgtgtattcggtgccgcagctgaagcagaggtgcatcaagggactggcccagcgcttgagcacggagaacgtggtggacgtgttgcaactctctcggctctgcgacgcaccggatctctacctcaagtgcgtgaagctcctcaggaaccgtttcaaagccgtgaaggaaacagagggctggaaattcctcgagagccacgacccctggctcgaactcgacgttctccgcctcatgggcgaactcgaaaagaggaagaggagggtgaggaagtggagggaggaggagaggttgtacgtgcagctgagcgaggcgatggagtgtttggagcacatatgcacggaggggtgtacggaggtggggccatacgaggtggaggttggacgacaaaaaacgccgtgctcaaagttcgccacgtgtcagggtttgcaggtgttgatacgacacttgggaacttgcaacaggaagctcaaaggagggtgtttgcggtgtaagcgtatgtggcagctcttcaggctccactcctccatttgcctatgccagaattcatgcaaggttcctctttgcaggcaaattcgattaaaaatggagcaagagaacatgaaagatgacgcaaggtggaaactactggtgaggaaggtggcctcggccaaagccttgtcttccttggcgctgccaaagaggaaattagatcagagctagggaccatatatataaataaataatggcaagttgtgcctacatgtttcggggggattacaaaatgatcgagaaataatggcaagttgtagtgttaacatgtcattagtatttcttttctcacgggttatagccttattggtacctattttatatgaaaggtataatatactcattg

SEQ ID NO: 134 - DNA, 1228 bp, Glycine max
acagagagtgcaaaaacaaacacagcagttacgccctctttctctctcccacccatatccccaaaacctgcctctgtcatctgtgagagtggctcataccatatcatatcacatcttatccagacaaaacaactgttatggataggtatcagagggtagagaagcccaaggcagagagccctataaacgagaacgagatacgcgttacttctcaaggaaggacgaggaattacatcacctacgccaccactctccttcaggagaaaggatctagtgaaattgttctcaaagcaatgggacgtgcaataaataagactgtaatgattgctgaactgatcaagagaaggattgttggtctgcatcaaaacacccaaattggatcaactgatataactgacacatgggaaccactagaagaaggccttcttcctttggagactactcgccatgtttcaatgatcacaattaccttgtcaaagaaagaattggatacgtcatccacaggataccaacctcctcttccagttgatcaagtaaaacctttaaatgaatatgatgaggaaggagaaggctcaccaaggatacgaggaagagggcgtggtcgtggaaggggcaggggtagaggattttacaatgggggtatggaatatggtgatggttgggatggtggacgtggctatggtggaagagggcgtggtcgtgcaagggggcatgcttttcggggacgaggacgaggacgaggctatggtgtgcagccagttggttactatgactatggtgaatatgatgctccacctccaccacgtggccgtggccgtggaaggggaagaggccgaggccgtggccggggaagggaccaggtaccagctgcttgatcaagtgtttgttgcttatcatgtatatgttaagttagatgttgcctctctgtttagttctttgtgagatttacttgtatttttggtattatttgaagcgttcagtgttgcagccatgtttctgcagttttgatgtagtgtttaccccctgtaacctgtataattttgctacgttgggtaggttaagttagatatgttttctttgtttaaagactcgtaaaaatcacaattgtaaaattttttaataggaattgttgcagtaagctaagtttgatttactatgattggtttagtttattgaagaaatagtattgtttgccaatttttaagagaacgtttaaaaagaaagtgat

SEQ ID NO: 135 - DNA, 2340 bp, Glycine max
tttatttggtcatcaaatattgtttttatcttctctctctgattcagtgtcgctagtattatattcatttttgagatgattgatcattcactcaggggcgaggatttgatgaatccaatgggtgctagtactgtaagcaacgaagaactcaaagagatcgagagtctcgggagagaggacattgaagaggctccaattgtgcccgaggatgtgagcagaatagcaccatggataagacagattacacttcggggactagtagctagcttcctgattgggataatttatagtgtgattgtgatgaagctgaacctcacaactgggttagttcccaatctcaatgtttcagctgctctccttggctttgtgttcattagagcttggactaaggttcttgcaaaggccaaaattgtttcgaccccattcactagacaggagaacaccataatccagacttgtgcagtcgcttgctatagcatctcggtaggaggtggtttcgggtcttatctcttgggtttgaataggaggacatatgagcaagcaggagttggtacagaggggaataatcctggtagtaccaaggagcctggaattggatggatgacagcctttctctttgtgaccagctttgttggattgttggcgttggttcccattagaaagattatgataatagactacaaattaacttatccaagtggaactgctactgctgttcttattaacgggttccatactcctaaaggagatgttatggccaagaagcaggttcatggtttcttgaaattcttctcagccagtttcctctgggctttctttcaatggttttattcgggtggtgataactgtggatttgttaagtttcccacttttggattgaaagcatggaaaaattcattttattttgatttcagcatgacttatgtgggagcaggaatgatttgttcccatcttgtaaatttatccttgcttcttggtgctgtgatttcatggggcattatgtggccattaatcaggggactaaaaggggaatggtttcctgcaagcatagcagagagtagcatgaagagtcttaatggttataaggtttttatttccattgctttgattcttggtgatgggctttacaattttgtcaaagtcctctatttcactgccacgaatattcatgccaccgtgaaaaggaagaaccccgaaactttttcagataaccagaaaccactccctcttgatgatcttagacggaatgaagtgtttgctagagaaagcattcctatatggctggcctgtactgggtacatattattctccatcgtttctatcattgtaatccctttgatgttcccccagttgaagtggtactacgtggtgtttgcctatctttttgcgccctctcttagcttctgcaatgcttacggcgcaggcttaactgacatgaacatggcctataactacgggaaagtggctctctttgtgctagcagccttggccggaaaaaatgatggcgtagttgctggactagtggggtgtggcctgataaaatccattgtttccatttcatctgatttgatgcatgatttcaagactggccatctcactttcacttcccctcgctcgatgcttctaagccaagcaattgggacagcaataggttgtgtagttgctcctctcacattcttccttttttacaaggcttttgatgtggggaacccagatggggactacaaggctccatatgccatcatatatagaaacatggcaattcttggtgtggaaggattttctgcccttccacatcattgcttgcagctttgttacggattttttgcatttgccatagcagccaacttggtcagagatctagcccccaaaaacattgggaaatggattccacttccaatggcaatggctgtccctttcctagttggtggttactttgccattgacatgtgcatgggtagtttggttgtgtttttgtggcacaaactaaacagaaatgaggctggtttaatggttcctgcagttgcttctggtttgatttgtggagatggattatggattctcccttcatctattcttgctttgttcaaaattcgtcccccaatctgcatgagcttcctgtcagccagtgccagttagaagttcacaataacattcaaatatatgcagtcaacaacttagtacctacggtcattatgggcataatgtcgtaggatgcttgcttattagcaatttcattcacaaagattctgctcttggagaatcttgagcgatatgtaaatatttttacatactttattagagaaactaatcaattcgagcggaccttccacctctcta

SEQ ID NO: 136 - DNA, 1273 bp, Glycine max
ggacgaaccgcgcaaggtaacgaacgtagctgagcaataacaatgccactgccaacggtcgtttccccattttcttcttcctcaggcaccttcttatccacagttaccgcgcgctcttcactccctccaaaacgcaacgtctccccttccccttcccccttctccactctctctcgcagagacattgctctgctttccttcttctccctctccctctcagcaccatcctccgccatcgacattggcatctcaggaccgaaggattggctgaaagagcaaaaaaagaaggcctccaagtacctattggcccccgtcgatgcctcccgccaaatccttcgctctgcctatctcacgctcacggaaactgacgctgcttatacggatgaggatttggagaagatgcagcagctctttatatctgctgccagggattgcgtcccacaggaccggaattctttcgtcactctccaagccaacaccggagtagaggtgtgcacctttcgattgattgtgaagaatgcagcttcgttgcttggaaataaggatcctgtaaagttgaaagccgaagctttgctagataatcttataagatctttcacctctgtcagtgggctggcaagcgaaaccaacattcaacttgcatcagataggaaaaagatagctgatgctgtatcagataccatatctgatcttgacaaatttgagcagggaatcagggattgccttgaaacctaactctaaaggatagcctagcctacttttttatgtggaaagttggccattaaatatcatgcaaggaatctattggtttaatcaccaattttctgttatcaccggtgtgctgtctgccgggaatatcaaaatgcttttgccctacttaaattacttcttattagttctctcaatctaaaatctgtgaggactctgtcaatatgtatctgatactctttttcaatgcattcaatcctatggatcatttcatagaggaaatgcacaggctcttgatagctttatccttttgatattacggggtgtgttcataatttgcacatactgaatatgtaataactaataaactttggtaatttcttaaacaaaggtaaatgctaggatgttctgaaatgatttcttaaaatcagtcaaaaaatgtatgtatttttacattttccttaaattatgactgtttccctttttgtttcgaaatgtatggggaatgtccttttgtcaacaaaagggatcaaacaaatgcatatgatacgattattactgctct

SEQ ID NO: 137 - DNA, 1594 bp, Glycine max
ataattaacttgttagcattggcgttacagagagagagagagagagttattatggtgactatggaagagagtccaaggagcccagaggcgaagctggggttgcgagtggaggatctatgggacattcaggaaccacagctaagtcctgatgagaagttcaatgcttgctttgaaagcatacctgtctctgccttccctccacctccttcaaatcaagaaattgagataaaatcagatgccaccctagccgaggcagtaaaaatacttgcagaacacaacattcttagtgcacctgtggtggacgtagatgcacccaatgatgccagttggattgacagatatataggaatagttgagtttgctggaattgttgtttggattctgcatcagtctgaacccacatctccaaggagtccatccggtggagctgctaatacggctgcagtgaatggaataacttctgaagcattcggccttgaatctgcttcgacaacttcaggcaatttctttgaggatctgacttcttctcaactatataagaacaccaaggttcgtgacatttcagggtcattccgctgggctccatttctcgctctggagagatcaaactcatttttgaccatgcttttgctgctttccaagtacaagatgaagagtattcctgtggtggacttgggtgcaggtcgaattgacaacattattacacagtcttctgtaattcacatgttggcagaatgtgctggtcttcagtggtttgagagttggggaaccaagaaactgtctgaagttggtcttcccatggtgacaccaaatcatattatcaaggtttacgaggatgaaccagtgcttcaagcatttaaactgatgaggaaaaagaggattggagggttgccagtgatggacaggggtagcagcacggcaattggtaacataagcctgaaagatgttcaattcctcctaactgctcctgaaatctaccatgattatagatctattacagcaaaagacttcctgacagccattagaagctacttagagaagcatgaaggggcctttccaatgtcaggtgacctgattacatgcaataaggattgcacaatcaaagaattgattcaactgcttgaccatgagaagattcatagggtctacgttgctgacaatgacgggaatctggaaggactaatcacactaagagatatcatctcaaggctagtacacgagcctcgtggctattttggtgatttctttgatggggttctcccaatgcctccaaacagcagggtttgaaatgctttcaggaagaataagttctattccataagtaacaaattgatgtgtttctcatcagagctgacgacaagatcctagcccctttgtaacatcagcacctagcactttgcaagttacttgctctcgttttaccgtaggtgaaactgtgaaattttgtgtaaattttgacgtaataatttggagttttggtcacatttttcttttgaacaagttgatccttaatctcatgctactctgcaattaaaagccagggaacttaacggaaacacaagttggtgcccccgaataccaacatttggtaccc

SEQ ID NO: 138 - DNA, 7851 bp, Glycine max
atggctaatttaacaaaaaaacaatatattataattttttcctaatttaactgagatgtagttatagtatcaagctgacagaatggagtctgtgttgtccccgatagtggaacgaacctttaattttgcggtggaccccattattcggcagttggcctacatcctccgttgcaggcaaaatgttgatgaactcttgactagttttgagagtcttgaacttgaaaaagagtccatagatcgtcgatgtgaccaagctcagaataatttacaaaacattgaagccaaagtcaaagaatggtcaaggaaagtagatgagttcaagactgaactagagaagtttaggaacgatgaaggccacacaaagacagggttgtccaatgttttatttttatttccttacttttggaataggcatagacttggcagacaagctaagaagatggcagagattgtcaagaatctaatagatgagtcggccaagttcaatgatgtttcctacacagacaacttaacatttaatgatttcactttgtctaatccgggctacatgggatttgcttctagacattctacagtggaaaaaataattgcaaaacttgaagattcctctgtaagaatgattgggctgcatgggagtggtggcatgggtaagaccactttaatcaaagcaattgctaagaaagctatggagaagaagctgtttaatgtggtggctgtatcagaaatcacagccaatcccaatccacaaaaaatccaggaagacattgcttaccggttaggattgagattggaaggggagggtgagaatgctagagctcatcgtctgatgacgaggttaaagcaagagaaggagaacacccttataatcttggatgacctttgggacagattagacttgaataagttagggattccacttgatggtgatgttgatgataatgatttaaacacgaagacaagcaatgctaaacagggtcccaaagaggtgactaaagaaaaatctcttggtgattataagggctgcaaaattttgctaacttcaagggataaaaacgtattaactgataaaatggaagttaagtcaactttctgtgtagaggaattagatgacgatgatgctctgaggttgtttcggaaggaggctagaatacagggtgaaatgtccaagtggaaacaagaaattgttaagaagtactgtgcagggttacctatggcaatagttacagttggaagggcattaagagacaagagcgactcagagtgggaaaaacttaaaaaccaagacctggtgggaattcagaattctatggagatttctgtaaaaatgagttatgaccgtctagaaaatgaggagctcaagtccattttctttctttgtgctcaaatgggtcatcaatccctaattatggacttggtgaagtattgctttggtttgggaatacttgaaggggtctactcgcttggggaagctcggggcagaatatctacatcaatccaaaagctgaaaaactcaggtttagtattggatggaagttctagtattcatttcaatatgcacgatctggttcgagatgctgctttatctatagcacagaacgagcaaaatgtatttactttgagaaatgggaaacttaatgattggcctgaactcaagaggtgcacttctgtttctatatgcaatagtgatattattgatgagcttcctaatgttatgaactgccctcaacttaaatttttccaaattgacaatgatgatccatctttaaaaatacctgagagtttttttaagagaatgaaaaaactcagagtgttaatattgactggctttcatctatcaagcttaccatcttcaattaagtgcctatcagacctcagattgctttgtttggagcgatgcactttagatcacaacttatccatcatagggaagctgaaaaaattaagaattctcagcttttctggatctcaaattgaaaatttgccagctgagttgaaggacttggataaactacaattactagacatcagcaattgttcagtagtcaagaggattccacctaatcttatatcaaggttaacttcgttggaagagctgtatgtaagaaagtgtttcaaggaagtgtcagaggaaggagagagaaaccaaagtcaaatttcatttatttctgaactaaagcatttgcatcaattgcaagtggtggacttaagcattccatgtgctcaagtttttcccaaggaattgttctttgacaacttaagtgattacaagattgagattgggaacttcaaaacgctttcagctggagatttcagaatgcctaataagtatgaaaagttcaaatctttggcattggagctgaaggatgacactgacaatattcactctcagaaaggaataaagttgttgtttaaaagagttgaaaatttgttgttgggagagctgaatggtgttcaagatgttattaatgagttgaatttggatggatttccacatctgaaacacttatccatcataaacaaccctagcatcaaatatatcatcaactcaaaggatttgttttatcctcaggatgtttttcccaagttggaatctctatgtctttacgaactaagaaagatagagatgatatactttagttcaggtacagagatgatatgctttagtccatttacagattgctcattcaccaaattaaaaaccatcaaggtcgagaagtgtgaccaattgaagaatcttttctccttttgcatggttaaattgcttgcaagtcttgaaacaattggtgtttccaattgtggttctttagaggagatcattaaaatacctgacaattctgataagattgagtttcttaagttattgtctttgtcacttgaatcattatcatcattcactagtttttataccacagtagaggggtcttctacaaacagggatcagatacaaattactgttatagagaatgagcatagtgagatggctcctcctctttttggtgaactggttgaaataccaaacttagagaacttgaatttaatctcaatgaacaagatccagaagatatggagcgaccagcccccgtcaaacttctgctttcaaaacttaataaaattagttgtggatgattgtgataatttgagatatttgtgttcaatgtccgtggccagcagtttgaggaaactgaaaggcctctttgtaagcaagtgtaaaatgatggagaagatttttagcacagaaggaaatagtgcaggcaaggtctgcgtctttcctaagttggaggaaatccacctcgactacatggataagttaacagacatatggcaagctgaagtgagtgctgattccttttctagtctcacttctgtgtacattaagagttgcgataaactagacaaaatttttccgagtcacatggaaggatggtttgcgagtttgaacagcttgaaggtttattcttgtgagtcagtgaaagtgatttttgaaatcaaagattctcagcaagcagatgcatctggtgggatagacacaaatttgcaggtttttgatgtaaggggactcctaaagttggagcaggtgtggagcagggatccaggaggaattcttaacttcagaaaactgcagagcatagagatgtatgattgtaaaagtctgaggaatgtatttccagcttctgtggccaaagatgttccaaagcttgaatacatgtcggtcagatggtgtgatggaattgtggaaattgttgcctgtgaagatggatccgaaacaaacactgaacaattagtgtttcctgaactaaccgacatgtgcttatatgacctatcaagcatccagcatttctacagggggagacatcctatagagtgtccaaaattgaagaagttggaagtaagggaatgtaacaagaagctaaaaacattcggaaccggagaaaggagcaatgaagaagatgaagcagttatgtcagctgaaaagatattccccaatttggagtttttggatattgactttgacgaagcacagaagtggttattgagcaacactgtgaagcatcgaatgcaccgtttaaaagagcttaggttaagccaagttaatgatggtgaacgtctctgtcagattctgtacagaatgccaaatctagaaaagttacagttgtgggaagctgaacatttgcttaaagagtcgtcggagtcacgtttgggaaccgtattacagctgaaggaattggttttgtgggagtcagagataatggatataggatttgaacgagaaccagttctacagagactagaggttttgagcttatatgagtgccacagattgaggaatttggctcctccctcggtatcattggcttacttgacaaatttggaagtaagagattgtgttagattaaggaatttaatggcatcctcaacggcaaaaagcttggttcaacttaagtccatgaagataagcagatgtgatgaattagaggaaatagtaagcgatgagggaaatgaagaagaagagcaaatagtgtttggcaaattgattactatagtacttgaggggctagaaaagctgaaaagtttttgcagttacaagaagtgtgaattcaaattcccgtcattggaagtattgattgtgagagaatgcccaatgatggaaagattcacggagggtggcgcaagagcagcaaagttacaaaacatagttactgcttatgaagaaggaaaagaggaagccaaatggcagtgggaaggagacttgaatgccaccatacaaaatgtttgggaagatcagcttttggagtctgcaagtactgtatcatctcttagtctgctcggagatagcccactacaagtgatatggcttgactcacggcggatcccaaagtcgtgcttcagtaacttgaactctttggctgtggagggatgccaatttttaacagatgttgtcatacccttctatttacttcctttcttaactaatttggaagaattacaagtccgaaagtgtggttctgtgaaaagcatatttgacgtgaaaacaactacgggattgggagcagcagccttccctagacctctccctttttccctcaagaaattgactttagagaggctgccaaaactggagaatgtctggaatgaagatcctcatggaattctaaccatgcaacttctacaacatgttattgttgagaaatgtaaatgccttacaagtgtgtttcccgcatcagtagccaaagatcttgaaatactagttgtcaaagactgtgaggaattgatggaaattgttgcagaggataatgcagatccaagagaagacaatctagagcttacgttcccttgtccctgtgtgaggtcattgaaactacaaggtttgcccaagttcaagtatttttattactgctcactgcagtgtgacatgttccagacacctaacgaagatgaaatgcctacatccaacttgaagtgcctgtcactcggtgaaaaaggactggagatgatcaagcgtggagaatttcagagaaacttcatacacaagttacaagttcttactctgtgctttcataatgggtcggatgtattcccatatgaaattctacaactggcgcccaatatagagaagcttgtggtgtacaatgcttccttcaaggagattaatgtggattacactggactcctattacagctcaaagacctatgcttggagtcccttccagagcttgtttccattgggttagagaactcttccattcagcccttattgggaaatctagaaaccttggaagtaataggttgttctagtttaaaagacttggtaccatctacagtgtctttctccaatctgacatatttggaagtagaaagatgccattgcctgctatatttgttcacatcctccacagcaagaagtttgggtcaactcaaaagaatggagataaaatggtgtgattcaattgaagaggtagtagtctctaaggagggggatgaatcacatgaggagggaataatatttccgcagctcaattgtttgaaacttgaaagaataggaaagctgagaaggttctacagaggaagtttattaagtttcccatcattggaggaattgtcagtaatcaagtgcgagtggatggaaacattatgtccaggtaccctaaaagcagacaagttggttcaagttcaacttgaggagtcatcagatgctatcaaattggaaaatgacctgaactctaccatgcgggaggcatttaggaaaaagttttggcagtctgcagatacggcattcgttattgacctcaaagatagcccactacaagagatatggcttaggcttcactcactgcatatccccccacacttctgcttcatttggttaaacaccttgattgtggacggctgccattttttatcagatgcggtgttacctttctctttacttcctttattacctgatttgaaaacattggaagttcgaaactgtgattttgtgaaaatcatatttgatatgacaactatgggaccactcccttttgccctcaagaatttgattttagagcggctgccaaatctggagaatgtttggaattcaaatgttgagcttacgttcccccaagtcaagtcattggcactatgtgatctgccaaagttaaagtatgacatgttgaagccatttacacatctaaatcaagtctgtattcaaaagcttacacccaacatagagcacctgacactcggtcaacatgaactcaacatgattttgagtggagaattccagggaaaccacttaaacgagttaaaagttcttgctctgttctttcatattgagtccgatgtatttgtacaacgggtgcccaatatagagaagcttgaggtgcttggtggtttcttcagagagattttctgctttgatagtcttaatgtggatgaggcgggattgctttcacagctgaaagtgatatgctcggactcccttccagagcttgtttccattgggtcagagaactctggcattgtgccctttctcagaaatctagaaacattgcaagtaatcagctgtttcagttcaataaatctggtaccatgcacagtgtctttttccaatctgacatatttgaaagtagaaagttgcaagagtctgctatatttgttcacatcctcaacagcaagaagtttgggtcaactcaaaacaatggagataagttggtgtaattcaattgaagagatagtgtcttcaacagaggaaggggatgaatcagatgagaatgagataatatttcagcagctcaattgtttgaaacttgaaggattaagaaagctgagaaggttctacaaagggagtttaagtttcccgtccttggaggaattcacagtatggcgttgcgagaggatggaaagtttgtgtgcaggtacagtcaaaacagacaagctgttacaagtgacattcaaattgttcttagatgatatcccattggaaactgatctgaactctgccatgcaaaaccgataggcatttctggcgagggcaatgactccaatattacagttagaggagattgattcaccaacaaaaagtggttagaggagatgaacaaattaagtggcccggtgcctacccccaaaaaaaaaagtggcccagttttattatttttgtttgtgtgtgaataaagaatggattgtgtgtgtggtctactcagttagtggtaaaatacattgttctattctatttattatgtaatgtgtgattataagtcttaaacgaccctggagaataaaaatgaagtgataacttgtaagtttgtaatactaaaacttaactgtatgttttatgacaaaataaaataaaaatgtgtcgtaaattatgca

SEQ ID NO: 139 - DNA, 2521 bp, Glycine max
tttgttttgcattaaattcagattctttctctagagatattgaaagggctcttggattctttttttttttttatgtggttattcttttgctagcagaaccaggggtgtaagaagaagttgaagtgatggaaccccacgatgaagaagagatccataactgtttgatcaagctgagaagtaatccggaaaggcgaagggataaggtttacattggttgtggagctgggtttggtggtgacaagcccttggctgctcttaagttgcttcaaagagttcaagaactaaattatctggttcttgaatgcttggccgagcgaactcttgctgatcgttatcaaatcatgatgtctggtggtgatggttatgattctcagatttctaactggatgcatatgctgctgcctctggctttggaaagaggaacttgcataattaccaatatgggtgcaatggatcctctgggtgctcaacagaaggtcttagaaatagctaacagcctgggtctcaatgtttctgttgctgtggctcacgaggtgtctgtcactaatatagtaggttcaggattttcaccagcaaaatcatatatcatggagggtggtatcagcacctacttgggagctgctcctattgttcgttgccttgaaaagtaccaaccaaatgtaataattacatcgagaattgctgatgctgctttattcttagcacctatggtttatgagctaggatggaactgggatgaattagaacatctagctcaaggatctttggctggccatcttctagaatgtggttgccaactcacagggggatatttcatgcatccaggagacaagtaccgagatatgtccttccagcaactactggatttatcactgccttatgctgaaatctgttttgatggccaagtatgtgtatcaaagtctgaaggaagtgggggagttttaaattttaatacatgtgctgaacaattactatatgaggttggagaccctggggcttacgtaacccctgatgtggtgattgattttcaggatgtttctttccttccattatcaagctctagagtttgctgtcatggagcaaaaccatctactatttcagttcctgataagcttttgcagttggttccacaggattgtggatggaaaggatggggagagatatcttatggaggttatgaatgtgttaaacgtgctaaagcagcagaatatctggttagatcatggatggaagaaatatttcctggtcttaatcaccgtatactttcttatataattgggtttgatagccttaaagctaccagcgggaatggaaatgagtcatcacagacaactagtgaagataataggctacgcatggatgggctttttgaacagaaagaacaagccatccaatttaccagagaatttatagcattgtatacaaatggaccagctggtggtggtggtatcagtactggatataagaaagagactcttctagagaagcatttggtaaagcgggaagatgttttctggcgaactgggataaagaggagcacaagaagtcagtcaaataaagtagttgatcctgaccacaatctgaggcacatattgacattgccaccgaagctacaagctgaaacagacaaatccttggaatctgtttctcttggtagtagttgctcacctgctccatctggccagaagattccactttacagtgtagcacacagcagagctggagataaaggaaatgacattaatttttccctcatcccacattttcctcctgataatgagaggttgaaactaattattacatctcaatgggtaaaatcagtggtctccaatcttctggatttgtccctttctcctgatttagatgcaaaaattccaagagataaatgggtcaatgaaaatgttaaggtggagatatatgaagtcaagggaatccagtcattaaacattgttgtcaggaacatactggatggtggtgtcaactgttctcgacgaattgatcggcatggaaagaccatttcagatctcattctgtgtcagcaagttgtgttgcctccttgattgtgtgatttactaataaggtggcaatgttctcctgaatggaatgaatagagcattgcaaaacttagaatgatagaatttattgaagcttggaagtgctttaattgaagtaggactcatatggggagggaggaatccattttgtgctctttagcctacacattcttatgataataattagcaaaagctgtgctgtagccacatcatcctttttaaagattatggtgggaagcattttgatctttagattatgttgtttctttttctttgtaatctactacataactagcttctattttattttttaaactttgttctgtagtttgagaactaagttttttggcttagtagaaatttgagaagttagagaaagatggagaaaagacattaagatgtaccaagaagagcaccaacacaagtgagattaactcatacactatacttaaattagtaagattaac

SEQ ID NO: 140 - DNA, 1005 bp, Glycine max
gaaaagagcaaacgttgtttgttggtgtgttagccaccacggaggcatatcatccttatatcatcttcataaaattatatcttttgcgcgcattctcattcaccaatggcgttcaccgtcgccattggcagtggcgtggctataatcccctgcggcaacaccaccaccgcaattccttacacccgtggtggtggtcaccgaacgagaagaaagctccatctccatgtggcgcgcgcgaagaagcccctgaacggcgacggcgtttccatttacactgagctcctcaaaaccgaagtttccgttttcgaaaataagcccctcggcgacaacgatgccgctttgaagttcgtagagaagatagaccgtcaatttcaataccccgatttctgggaaggatcccagtgggactggttaggcatcttcgtcaagttttccccaatcattggcgtcgctgttgcggcatgtcttgctatctacggttgctttacatttcatgaaccaccaaaagaaatgagggaggctgctgaaaggctgtattctgtgcagtccggcgtggagtctagtgcagagtccggtttggagtctagtgcagattccagtgtggagtccggtaaagttattgaagagcctgatacatatgactcagatgtttttgattccaatccaacagaggtagcacctagtttggagtagactctccatagatacactgcaaatataccttatttttagcatttaaacccaggtgaatggattcaaacctttactgcacttaatttttaagacaatgcttctggttacatgtaaaccctcttaaagtgtatcaattttgagacagatcaagggaattagttgtatgtgtaaatgtatggcagttattcgttgcgctgcatctgattactcatatgttgtcgtcaatcttgtatatctgttctagatcagaactactgaaatagaatcttttacatacatacatagttcagggtaaaggttgagttccgatcg

SEQ ID NO: 141 - DNA, 1465 bp, Glycine max
aattctcaagggactaaaaggggcattaattaagatcactcatcaaaagtttgattctgtttccagtttccaactttcctggtatggcattagaggcagttaatgacagaaaagctgaagttcaagcatttgatgattctaaaacgggtgtaaaaggtgtcctagattctggggtaacaaagatccctaccatgttccatgtcaagttagactcaactcacacctcaccaactcactccaacttcaccatcccaatcatagatcttcagaacataaacagcaattcaactctgcatgctgaagtggttgaccagcttaggagtgcatctcagaagtggggatttttccaagtgatcaatcatggcgttcctgtggaggttttggatgagatgatcagtggaatccgcaggtttcatgagcaagatgctgaggcaaggaagcccttttactcgagagatagcagtaagaaagtcaggtatttttctaatgggaagctgttcagagacatggctggtacttggagggacacaattgcatttgatgtgaatcctgatcccccaaacccacaagatataccagcagtgtgtagagatattgtggctgaatattcaaaacaagtaaaagcgttaggtaccacgatctttgagctactgtcagaggctcttggccttgatccttcttaccttgaagaaatggactgcactaaagcactttatgttatgggtcagtactatccaaaatgccctgaaccagaattaactatgggaatttcaaagcacactgattgtgacttcataacaatacttttgcaagatcagattggtggtcttcaagttcttcatgagaatcattgggttaatgctcctccagtgcgaggagctcttgttgtcaacattggagatattctgcagcttatgactaatgacaagttcatcagtgtttatcaccgggtcttgttgaggaatatgggccctagaatttctgtagcaaccttcttcatgaattttaccatatctaaatgtacatcgaagagttatggtccaataaaggaattgttatcagaagaaaaccccccagtctatagggacatgaatatgaaagaaatcttgacaaattattatgcaaaaggccttgatgggagctcctacttgctgcctttaaggttgtgaagcaaataaaagtattagatcgatcttttcttgattctcatggagttggctagtctgcatcaatttatcgtagttaactggtggctggtgcctataggctttatctgagattttcaatgtccataggaatttaaataaactgtacaagttctagaagaataaagttttggcatatttagttcattgtactatagaagagcataactttcaattttctgtattatgacaattgcgtgatatgttcttgtggttgtcaataaatttttcaactttgttgctgtgaattacaaatttgc

SEQ ID NO: 142 - DNA, 1624 bp, Glycine max
gaatcgaagaaaaaaaaaagtacaccatcgcctcctgctaaagacagatctcagattctgtacgctaacatagagagttagagtgagaaagagagagatggcaacgacgacgtcgtcttcaagcgaggaagcaccgaacactaagaagaacaagaaggagcgtttaggttggatagaatggttaagaggttggttctatttggtctacgaaatgctctttcagcgcatcatggcgagccacttgcacaaccctatgcctctccctcctgtaaacgacctcacttgcattgtcaccggctccaccagcggcattggcctcgaaattgctaggcaattggctcagtcaggggcccatgttgttatggctgtgaggaacactaaggcagctcaggagttgatccagaagtggcaggttgattctgaaggattgagtattcctctcaatgttgaggtgatgcaagttgatcttctctcattggattctgtcacaaggtttgctgaagcatggaatgcacgctcagcacccttgcatgttctcatcaataatgctgggattttttctattggagagccacaaaagttttccaaagatggttatgaacagcacttgcaagtgaatcatcttgctcctgccttgctttcgatacttcttttgccatcccttattaggggttctcctagtcgcattgttaatgtgaattccataatgcatcatgttggctttgtagacaccgaagatatgaatgtcacatctggaaaaaggaaattttctagtttggtagggtactcaagcagcaagttagcagagattatgtttagtagtattcttaataaacgactccctgcggaatctggcatcagtgtattgtgtgtatcacctggaattgtccagaccaatgtggcaagagatcttccgaaacttgttcaagctgcgtatcatttgatcccttacttcatctttagtgctcaagaaggtgcaaggagtgctctctttgctgccactgatcctcaagttccggagtattgtgatatgttgaaagcagatgagtggcctgtttgtgcctttatttctcaagattgtcgtccagcaaatccatcggaagaagcgcacaacgttcaaacatcgtatgaagtgtgggagaagacattagagatgattggccttccctcagatgctgtggagaggcttttagatggggaagaagttaaaagccattatagacaagaacagtaatctaatatacaatatctccctaaatctgtaagggcacgtccattatttatagctagcaatgagcattttgattctgaatatgtaggagaagaacccttttatatttttttaacatgatatgtacatccattttgatcatatttgtgcactcaaatgccacttgctcctcctaatgggagaatttagccagctataaacaggtgttttgaccttaaatgtcaccataggagtaagaactaaattagtcagcactatgttgtgatagttgttttgacttttgacccatgccattggtgaccctcctaaataagtgggttccaacaatagtgttgctttcaattttggaatgttaccatgttataatgcaattcttacattctcgagttgtca

SEQ ID NO: 143 - DNA, 1021 bp, Glycine max
aatccttgtggataggacgcaatcaaaagagcaaacgttgtttgttggtgtgttatcataaaattatattttttaggcgcattctcattcaccaatggcgttcaccgtcgccagtggcagtggcgtggctataatcccctgcggcaacaccggcaccgccgcactcttccctcaccgaacgagaagaaacctccacgtggcgcgcgcgaagaagcccctcaacggcgacgacgtttccgtttacgctgagctcctcaaagccgaagtttccgttttggaaaataataagcctctcgacgacaacgatgccgctttgaagttcctagagaagatagaccgtcagtttcaacagcccgatttatgggaaggaccccagtgggactggctcggcatcttcatcaagttttcccccatcattggcatcgctgttgcggcaagtcttgctatctacggttgctttacatttcatgaaccaccaaaaaatgtgagggaggctgctgaaaggctgtattctgtgcagtctggtgtggagtccaatgcagagtccgatgatgtggagtccagtgcagagactgatgtggagtctagtgcagagtccagtagtgaagttttcaaagagcctgatgcatatgactcagatgtgtttgattccaatccaacagaggtagcacctagtttggagtagactctccgtagatactgcaaatataccttatttttagcatttgaaccaggtgaaaggattcaaactttttctccactaaatttgtaaggcaatgcttctgcttacatgtacaccctcttaaagtgtatcaattctgagacagatcaagtggattagttgtacgtgtaaatgtatggttatttgttgcattgcatctgattgctctgatcgttgtagacaatcttttatctatgttatagatcagaactactgtaatggaatcttttacaaacatatatagttcaggtagagtttgagttcaaattgatactggtttttgtggaccagaattatgtg

SEQ ID NO: 144 - DNA, 1152 bp, Glycine max
ggcgcggcagagcaaatacattgcaggttatctttcatctcagaacgtctgatttgagcctctctcagtgacaacagtttctgagtcttactgatcttttcttctctctaatctcttgtgatttttcttctctctaatctcttggttgcgtggcagactaaatgattttgtgtttttggttctcttttaggcttgtacaggttggaaatcttgggcttcagctgccatggtactttctgcaaataattgtcagcgcatggtatttcatatcagtcgtgggtaatttgtttgaaagctatttcatctctttaaagaaatacaagtctcttcattcgggaaaggttcggtaccttgccattgtcatagaaagtgaagaagcttatcagatttccaaagttgttaaactttcgcagtggcttgactctattggtgtaaagaatgtgtgcctttatgacatgaatggagtattgaagaagtctaaggaaaccatgtttcaaaaattgaagaatgcaaaatccattgaggaagttagtgaagtcgtcacactccatgctccagatcacatgactttagaatttctttcttatctggatgggaaggaggcagtggccaaagcagctaacttgatttttgtggaaaactcgaaacgacataacttgggtggagaactagatcttcaaatcttgttagaacctcaaatgaataaagcattgcaaattgttggtagcaaaggccccgagcctgaccttttattggtttatggacctgtgaggagccatcttggttttcctgcatggagacttcgttacacagagatcatacatatgggatcattgaacttcatgagatatggttccttaatgaaagtcattaacaacttcacgaaagtgcaccaaaattatggtacgtagaaaaggaatttggaggtagttaactgcgcaagcacaaagcataggcgtgaagaatagaaacatatctagctaaaatctttgtggaaaaaaggacttactcagtcttaactactggttttacttactttaaatgtgtcagtcatcatgagagatagaattgcaagtcatgacctggttttaccaactgttaatttaaaaaagatttggtaatttaaaagttggatttttatttgataccacc

SEQ ID NO: 145 - DNA, 492 bp, Glycine max
cgcagccctaatcctaaaccctagcaatactaatagtagaacttattcgcgatctcgttctgttctgtacctgcacccagccgcagcagcaagtgatcgaagcgaaaagagagtaatcagcagagaaattcatcgtcgtagttatgggtaaagttcacggatcacttgcacgtgccggtaaggttagaggccaaaccccaaaagtggccaagcaggataagaagaagaagccacgtggccgcgctcacaagaggatgcagtataatcgccgattcgtcaccgccgtggtgggattcggcaagaagaggggacctaactcgtctgagaagtgaggctgaggcttaaagaatatgtcactactctatatttgatttatctttcttgtctttaatttgtatgttttgattgtgttctgtgaacgggttttgttagctttaatatcaaactagaaattttgaatacaattctaattctatttctaagttcatttgc

SEQ ID NO: 146 - DNA, 1824 bp, Glycine max
gtggttggtgtgtaggaagcagagagagatgatggagttgtttctaagttgcatggtcctctttgtgttaactttagcaacacttggcgcacactggatctgggtggtttcatcgagtagagcaggttccaaactcccaccaggccctttccctcttcccataatcggaaaccttcttgcactgggcaaaaagccccaccaatctctggccaaactcgccgagactcacggcccaatcatgactctcaagttcggccaagtaaccaccatagtggtctcttccgccgacatggccaaagaggtgctcctaacccacgaccactccttgtcgtcaaaccgtgtcattccacaggccgtgcaggttcacaaccaccacaaccacagcattaccttcttgcccgtttcacctctctggagagaccttagaaaaatatgcatcgctaatctattctccaacaagactcttgatgcgagccaagatctcaggcgcagcaaactgcatcaactcctccacgatatccaccgaagcagcctagctggtgaagcggtggatgttggaaaagcagttttcaacacttccatgaatttgctttccaacacttttttctctctagatttggtccactcttcttcttctgctgctgctgtagatttcaaggatttggtgctcaaaatcatggaagagagtggtaaaccaaacctcgctgacttcttccctgtactcaaattcatggacccgcagggtatcaagactcgcaccactgtttataccggcaagatcattgacacctttcgcgctttgattcatcagaggttaaagctcagagaaaacaaccatggccatgacaccaacaatgacatgctaaataccttgctcaactgccaagagatggaccaaaccaaaattgaacatttagctctgactttgtttgttgcgggaacggatacgattacatctacggtagaatgggcaatggcagaattgctccaaaatgaaaaggcaatgtcaaaggcaaagcaagagctggaggaaaccattggcagaggaaaagcggtggaggaatcagatattggtaggcttccttatttgcaagcagtgatcaaagaaacctttcgattgcaccctgcagtcccatttttgattcccaggaaagccaatgcagatgtggaaatcagtggtggctacacaatcccaaaagatgcacaagtgtttgtcaatgtgtgggctattggaagaaactcaagcatatggaaaaataatgcaaacgtgttttcaccggagaggttcttgatggattcggaggatattgatgtcaaaggtcacagctttgagcttaccccgttcggtgctgggcgtcggatttgtcttggcttgccgttggccatgaggatgttgtatttggtgttgggttcgctaataaactgttttaactggaaacttgttgaagatgatgatgttatgaacatggaagatagctttgggataactttagcaaaggctcaacccgttatactcattcccgagaaagtgcatggtgtcatcgtgtcatgaatgatgcacatgcacactgatgaataaaataatagtaactgtagtatgcgtatatataggacgtagacacgtagtatataataatagcaactgtagcatgtgcacatgcacatgcacactgttaaatgcagtgctagtttactacagcagccgtatcgtgtcgaaacctccccaacccaagtactgtaataatttggcagattcatgctttgctttaaaagcttggcagattcatgctagtttgaagtaattaattaagctaaggtttgttc

SEQ ID NO: 147 - DNA, 1412 bp, Glycine max
atgaaaaagggagtgcctgataacccataaccgaccgcaccaccgttttcctttgctttgcgttctacaatgtcgaaaacctcagagattattacatgcaaagctgctatttgctggggaataggaaaacctgtgactgtggaagagatacaagtagaccctcccaaagccaccgaagttcgagttaagatgctttgtgccagtatatgctccacagacatctctagcacaaaaggattcccacataccaattttcctatagcacttggacacgaaggagttggtattatagagagtgtcggtgatcaagtaacgaatctgaaagaaggggatgtggtaattccaacatacataggcgagtgccaagaatgtgagaattgtgtttcagaaaaaaccaatttgtgtatgacatacccagtaagatggactggtctaatgccagataacacttcaaggatgtccatccgaggagagaggatataccatattttcagttgtgctacatggtcagaatacatggttagtgatgccaactacgttctcaaagttgatccaaccattgatcgagctcatgccagtttcatctcatgtggcttttcaactggatttggagctgcttggaaggaagccaaggttgaaagtggatccactgtagctgtttttggtcttggggctgttggattaggggctgtaattggatccaaaatgcagggagcaagtaggataattggaattgacacaaacgagaacaagagagcaaaaggagaagcttttggaataactgactttataaatccgggtgattctaataaatctgcttcagaattggtcaaggaactaagtggtggaatgggtgccgactattcttttgagtgtactggagtttccactttactctctgaatccttggaagccacaaaaattggaacaggtaaagcaatagtaataggtgtaggaattgaaattactttgccattgggtctttttgccattctgcttggtagaactttgaaaggttctgtttttggaggactcagggccatttcagacctttccattttagctgacaaaggccacaaaaaggaattccctcttcaagaactcttcacccatgaggtcacattagcagacataaacaaagcatttgagctactaaaacaacccaattgtgtcaaagttgtcatcaacatgccatagtcatattagcgcaattgtaggtaatcttcggcaaagtttgaaaaagattcacgtttcactctttatcaattaccattgtctctctctttgtccttctctatgcatgtgtgtatgtggaacccagatcctctgccacgatcctaccacctacaatagtattttgtccgtttcattgatcctacgactatccaagtaaatctttcagtagttggatt

SEQ ID NO: 148 - DNA, 1050 bp, Glycine max
tacactagtgcggttgtgtgttctgttgttgtctccgttcattacatcgtagctccgatcaccgagaatgcgtagtctcgctgcacctcattccttccgggttttcgtcaactcgcccatctttcgccccattaagcttccttttctcactctcaaccctctctcttcaccttccagaagatctccagcttccgttcaatgcgccgttcaattccgcccctgcatcgacatccacaaggggaaagtgaagcaaattgtggggtcgacccttcaagacttgaaagggggtgacggttcggatcccgtcaccaatttcgagtctgataagtcggctgctgagtatgccgcgctttacaaacaagatggactcactggtggtcatgtcatcatgctcggagccgaccctttgagcaaagcttctgcccttgaagcattacacgcttatcctggcggtttgcaagtcggagggggaataaattctgacaattgtttgagttacattgaggaaggagcaagccatgtcattgtgacatcttatgtattcaataatggacaaatggatcttggacggctaaaagatcttgttcaaattgtaggaaaagacaggcttgtgttggatctcagttgcagaaaaaaggatggtaaatatgcaattgtcactgatagatggcagaagttcagtgatgtttttgttgatcctgatgtaatggaatttcttgccaattttgctgatgagtttctggttcatggtgttgacgttgaagggaagaagttgggaattgatgaagagcttgtggctttgcttggcaaacattcaccgattcctgttacttatgctggtggtgtgactgaaatgtctgatctggagaggataaaaactgccggaatggaccgtgtgaatgttactgtgggcagtgcattggatatttttggggggaacttggcttatgaagaggttgtagcttggcatgcccagcaaaatgcctctgcagtttaattagtatgttttcttttagttgggggctgggactggttagcaaggatttgttt

SEQ ID NO: 149 - DNA, 775 bp, Glycine max
gcaaaatcaatttcaatttcaatgtctctctctcagactctcacgataagtgacaacattagacgttgaattgaattttgatggcgcaacaatcgtcacctccacggcggcaaactcctccgccatcgcagtacctggaggtcaactgcagaagctccggcaagatacggcggtttgcggcgggcaccggcgcggggtttgcggtggcgctgatcaatcggaagctgaagggaacggtggtggctgcgtcgcacatagaagcagtgaaggatgggaaagaagaagaaccaatcgcttttggccccacttcgcttctttctaacttcggcgaaggttggaaactccaaactgttaccctcactgatctttcttcagaagtggggaatggacaatttcaacagatggcaatgcagaaaccaggactagttccaggtgtcccaggtcctgcaagggtgtccaatccaatcagctttgtatatcttgttaaaataatgtttgcttttattttgatttttgtacttgttgcaatttttactttgtttctcgataaccttcctgcattcatattgtttcttaagtcaataacctagtgtctttttgcttgaaatttatatatgcataaataaattgttattaaatatatagcctttctgttaaggactagaattcaaactatggcagacactgaactgtgagagcattgtgtctctcttgaacatttcaatatttcatattttagctgcacacagaatctcatagttgcaagttgaggtat

SEQ ID NO: 150 - DNA, 1966 bp, Glycine max
aaaaaaaaccaacctttttctccctcaatcaacgcaagacgcttaaataacaatccaccctcgttctctctctctctctgacacgcactcctcctcctcctaggtggaattggaattggggatctactagatgggcctaatcagaagcatgagatcgcggtcacagcgtgtggtgcaggagcaagaagctgctgagtgtgtcggtgtcgtcgtcggcgacagcatgcgacagagttgttgggccaacatgccccaagagcttctccgagaggtcctcctccgaatcgaggcctccgaggacacgtggccgccgcggaagagcgtcgtctcctgcgccggcgtctgccgcagctggagacatatcaccaaagacattgtcaaaacgcccgaactctcctccaagatcaccttccccatttctgttaaacagcctggcccaagggagaatctcctacggtgctttataaagcgcaaccggtccacccaaacatactatttgtttctcagtttaaccagtacgctagctgaagatgggaagttccttcttgctgcacgcaaatgcagacgtccaacctgcacagattatatcatctctcttgacgcagatgatatgtcaaagggaagcaactcctatgttgggaaactaagatcaaactttcttggaacaaagttcacaatctatgatagccagctgcctcatacaggagcaaagattatgaaaagtcgctccacaaggctggtgaatctaaagcaagtttcacccaaggttcctacaggcaactatccagtggcccatatttcatatgaattgaatgtgctaggctcaaggggtcctaggagaatgcattgtgtcatggattccattcctgccactgcaattgaacctggaggtgtagcacctacacagactgagttttctcttaacaacatagacatgtttccttcattccccttttttcgatcaaaatcaaatcgtgcggaaaattccatgtctggaccattggttgatcaaaaggatgggatgctagtgttgaaaaacaaggcccctaggtggcatgagcagctgcaatgttggtgcctgaactttcatggacgggtgacaattgcctcagttaaaaactttcagctggtggcttctgcagaaaacggacctgctggaccagaacacgataagatcatcctccaatttggaaaagttgggaaggatttgtttacaatggattaccggtaccctatctcggcatttcaggcatttgcaatctgcctcagcagttttgataccaagattgcttgtgaatgacatgtttaaacagtttcaatccagattatatagctatatctcttgctgcttggagaagtatggcttgaatgtcacttgttgggaagcagaaagatgaaaaatgtttgtcaaggtaaagattggttggatgagcattgaactgaattcgaaaaaaccattcagtttctgggatcacaatttaccagctcttgggaagataacataaaattggaatgttacttgaaactcctccaccatatcccacaaaacaaaacacaaaaacgggaaaaatacatttattcagacccccgtgtacataaattctctatttctttcaacagtttggttgtttattgtaatgtagtagtggttgtttataacatgtccatgcaagacatgttttgttaatgtgactactagctttcaacttatcctttcatgagaacattttgtgttgggggggactcttgcaagaacacaagcagaagcaacttgctatgtgcaactcctttcgttccgtaatccactcttgacttggtctttccaaaacagtaacactgttctaatacagtgcatgtcacgagggataaatgccacttgctgtattattctcttgactaaggaataaaccctccttggctttgtataacagattatgttatatttacaaattataaccactgtctt

SEQ ID NO: 151 - DNA, 2705 bp, Glycine max
cgattcgaaactaactaatttctatcttcttctcttcgcgtagcgcgtcgtcccccgcaacgacgtcgtttcatggtcgcgttgttgttgtgctggttctctatgcgaaaatcttctgagggcttctcggcgatgagtggagtaattcattctctggtgtttgattccgcatttccatttctaaatttctctgtctcccatgtaagaaatgtttgattggaacgacgaagagcttgctaacatagtatggggtgaggtgggtgagggtgatgatcatattgtgccttatccggaggcaagtgaagatcttaatgacaagaaagaatggagtcaggaagcttctgctactaaactgattgaccagaagagaatagaggctaaaactgattttcatcaaggaaagctcggaagcagttccaaacttgatataattgagggacaatctgcctcagaatctggcacaaactcatggcctgatttatctttatccactgcggctaaaactgatcagggttccctgggtgctgctgatgtatctaaaactttagaagagactacacagcttgaaaaggatgtagaaaagcaaggtgattttgtcaactatgcctgggataacataggaagctttgatgatcttgatcgaattttcagcaatgatgacgaccctatatttggccatgtaagtcttgagaattctgatgagctgtggtcttccaaagacgtgagtaacagcacagtacccatactcttggagacaccaaacccaacaagtgctttaaggaacagatctgagcctttggaaattaaagcagaatatgtccaacagaatgatcgatcattttcccccagatttaagaggattggcgattctttatctcatgatattgagaaggctcctgcaaacatattcaatgtaggatatgatagagatagaattgccccggctgataaggagcaacaggattttgggcaaaataatcagttgaaagctcggaaaaaatcacaaggtaaactagagggaaaatcattgaaggagttttatggtagctggtctccttcatcaactacatctggacaatttcagaatcagctggtgtcttcagtcatacagtcttctccctcttcaattcttgggcagtggaatgagcttcaaggacctgagacactataccaggacatcacaaatacatatgtgacatcctctgcatatgggaaccttacaaatacatattcttctatgtcaatgctaccacaggctcagtcaggagttcttatgcgacagcctctgctttctcgctatgaagcatctcttggtgttatgaatcctgtgagcaagtctgtggacttagttaagcctcttacaatgactccccaggaaaaaattgaaaaattgaggaggcggcaacaaatgcaagcaatgcttgctattcagaaacaacagcaagaattcggccatcaagttcctagcactaataaatcaatgaatgaaaaatgtgccatagaaatccatagtcaactctgtgatggggctgatcctgaaattgaagatttaagaacagctctagatccaccaactgagcaagatgattctaatacaatgtctctggcaattgatgatcattttgttgaagacaccatactgtacatgcttcaggatgctatatcaaagttagatgtcaaaataagactatgcattagagatagcttgttccggttggctcaaagtgcaatgcaaaggaattatgctaatgatacaagcagtacaaacaacactagcagagaagaacttaaagttgctgcaagagaagaaagcaatagccaaaacagatatgctaggattgctgatgttgaaaccaagacaaatcccattgatcgaactgtggctcatttgctctttcataggcctttggagttaactgggaattatcctgataagcttgagtcacctatttctgctaagatacaatttgaaagcagagaagctaacatggagaagtttcatatgggatgcttgccagatgaggacttgaaaagtaatcaacaattttctcaccaagggcttgaggcccagcctgaggaccaatttaaaaacagtcgttgcatagacacctcagagaatgcttctaacaatgttctagctgatgctggagatcaggtgcttgaagccttgcaatgaagaaaaagtctcccctggaattggaggctgtctggatcataatcaaggcaaccgttgaagtctatcatcacataactgaacacctgtttctcatgtgtatgttatcattaatatttatgtttcgtctgtcaaaatcttgacagtatatgtatctcagcatatgaacttattcagcttggtgagtgacttatgttaataatgactttgtcagacttgtctagtagtaagtaaatgccaataatgttaaagactacgtcagatttgtgcagtagtaatgccactcatgtcaaatagtcaagtcttcaccagactggtttggaccaagcttaaagttggtgttgtattcctgtactatttaactcgttttagttgccccacatcaatagctaacctgtggactgtcatattgagattgagtcttgatgtcagattgtttttttattaggtttatttatgtttctggtttgagcagttggtcatgggttcaaatagagaagaatctttgcatttgcaagggtatgattgtata

SEQ ID NO: 152 - DNA, 1714 bp, Glycine max
gaagcaaattgaaaatggtaaccatccactgttcccacctggtggttccctccgagcccacgccatcttcaaccctctcactctccctctgcgaccaaatcaagctcccaaaccacggatctcagctctacctctacagcaacaccagcatcacccaccatcatctcatccacactctctcagcctccctcagtaaagcactcactcactactaccccttcgctggccgcctccgccgcatccccggcggccgcttccagctcctctgcaacgccagtggagctgtcctcatagaagccacatgttcaagtcaattcagtttcaaatattttcgcgatttcgctcccgtccacgctgtccccaaaatcaactacgatgatgtccccattgaggatgtccccttgctggtggcgcaggtcacgaggttccccaacggcttcatcacgctcggtctctccctctgtcgcgctctcctcgatggaaattcggctagcagcttcgttaactcgtgggccaagcttgctaaaggagagaacttagattccagcttgattcctttgcttgatcgaaccaagttagattcatttaaactcaataaaccaccacgttttgaacaccctgagtttttgccaccaccccttttgacacaacagcatacccagatggaaggacaacttggttcgaccatattggaactcacaaagggtcaagttgagaaactgaagaagaaagctagtgactttggaagtgggtatggtattaataacggtaatggttccgtacgaccttatactagttttgaggttataactggtcacttgtggaggtgtgtttgcaaggtgcgttacgcgggtggtgatttgggtcaaccaacgaggttgaccactttggttaactgtagaaaccgtttaaggccttctctccccacggcttattttgggaatgcaacgtttcccacggtgacaccaacttgttcctttgatgagatcatgcacaagcctctgagctatgctgtggggaaagtgagggaagcgattgggaagatgagtgatgagtatgtgaggtctgcgcttgattacatagcaagtgtggaggacttcgatttgttcagggacacgttttatggttctggtgatgggaaagggaagtttaagggagatcctaatttgtatatggttggttggacgaattttaagtattttgagacggattttgggtgggggaaaccggtttctttgattcccggaaacattaattctaatggcaaggcttttcttttggagaatgcaagtggtgatggcttcattgtagctgtttgtttgctggaatcgcatgtagatgctctgaggaagttgttttatgaggatatggaggatgctagttccaaattgtgattgatgatgaatcttgcatccatatgaggcttcaatgtgattctgggattttgtgtgactaggatttcagattatcatggacatgaagctaagatgtatgactggtctctcagttttatccttttgatttttctctgttgtttataattgatttgcaattagcaagttcttgatcaaaaccgtgataaattagcagtatattagcggcgtgtctcgttacatgtttatatctagcacgttacctgttacctaatagataacccttccattgaacgccaaaattggacatttagatccgtaggcgaggaagtaagaaggta

SEQ ID NO: 153 - DNA, 2770 bp, Glycine max
aaccaaccactgcaccagagccatagcacccctcctcccagagaaacacactctgctgatgacaagctcatcttccaagttctaatctcaaaatggaagcaattccttattcaatcccctccaccaaattgcactcatctcttcatatttacaccggcgttacacgaattcgatccctccctcttcgccctcccccaatctcaatcaaacctctatattcccccaatttcctcattctccatcgccacagacttcgctgcgtcgctgaatcctccaataatcatcatcatcatgaccacgaccatcaccacggccaccaccaccaccatcatcatcatcaccactcccacggtgctaatctcaccgggcctcaaaaagctgtcatcgctttcgccaaagccaccagatggatggacctggcagacatcctgagggagcacctgcatctttgctgcttctccaccgctctcttcgtcgccgccgcaatttgccctcacaccttgcccaagccactcgtcaagcctcttcaaaactccctcatcttcgtcgccttccctctggttggggtttctgcatcacttgacgctctcatagaaatcagcagcggaaaggtgaacatccatgttctgatggctatggcagcctttgcatcgatattcatgggaaactctttggaaggaggcctgcttcttgccatgtttaacctcgcgcatatcgccgaagagtatttcaccagccggtcgatggttgatgttagggagttgaaagaaaataatccagatttcgcccttgttctggataccaatgatgatgataaactccccaatacgtttgacttggcatacaagagggttcccgtgcatgatgtgactgtaggatcatttattctggttggcaccggcgagtctgtgccagtagattgtgaagtattccaaggcagtgccacaattaccatcgagcacttgacaggggaagtcaaacctttggaagccaaagttggagatagaattcctggtggttcaaggaacttagatgggaggataattgtggaggtaatgaaaacttggaaggaatcaactctcagcagaattgttcagttaactgaagaagcacagtcaaataaacctaaacttgaaaggtggctggatgaatttggtgaacgttatagccaagttgttgtggtgttatcaattgctattgctgttattgggccatttttatttaagtggccattcgttagtacatccgcttgcagaggttcaatttacagagccttagggcttatggtggcagcatccccttgtgccttggctgtggccccattggcatatgctatagcaatcagttcctgtgccagaaaggggatattactcaaaggtgggcatgttctggatgctcttgcttcttgtcatactattgcatttgacaaaacagggacattgaccactggtggactcgtattcaaggcaattgagcccatttatggtcatcatgttagaaacaacgaatcaaatgttccttcgtgttgcattcccacctgtgaaaaagaagctcttgctgttgcttcagcaatggaaaagggtaccactcaccctattggaagggctgtggttgaccatagtgaaggcaaagacctcccatctgtttctgttgaaagtttcgaatactttcctggtagaggccttactgctactgttaacagcattgagtcaggaactggaggtgctaaactattgaaagcatcacttgggtcaatagatttcatcacctctttatgtcaatctgaagatgagtcagaaaagatcaaggaagctgttaatacatcttcttatggaagtgaatatgttcatgctgccctttcagttaatcagaaggtaacattgattcatctagaggataggccacgtcctggggttgttaatgttattcaagaattgcaagatgaagcaaagttacgtgtgatgatgttaactggtgatcatgagtctagtgcaaggcgagttgcaagtggtgtgggcatcaatgagtttcattgcaacctgaagcctgaagataagctgagtcatgtaaaggatatctcaagagatatggggggaggcttaattatggtcggtgaaggcatcaatgatgccccagcactagctgctgcaactgttgggatagttcttgctcaccgagctagtgcaactgccatcgctgttgccgatgtattgttgcttagagaaagcatttctgcagtgccattttgtattgccaagtctcgccaaacaacttcactgattaaacaaaatgtagctttagcattgacgtccattctcatggcttcccttccatcagttttgggatttctgccattgtggttaacggttcttttacatgaaggtggaaccctgcttgtctgtctcaattccgtacgtgctctgaatgaaccatcttggtcctggaagcatgatatattccatttgattagcgagattaaatctagactcctgtctctcaagacaaatatcacgggctcaaacagtatcataacgacgaatttgtaacgtagtgttgtagtgcatgtattgcatatttatagtgtattgagaaaaaatgtcaatatccttcccttgtatatctgtaggcttcttttaatcccagagaattgaacattcccttctatttgagattagtttccctttccgtaattctcgttttcccatttaaatggaataagaaaaatgacattaagggaagaatatgcttatacatcttggatttggctttc

SEQ ID NO: 154 - DNA, 622 bp, Glycine max
gggttttgagagagaagcctccatttataaaacatcgtgtgcgcactctctcttctcctaggtttcactcccatcaacagcaacgatggtgcagaggctcacttatcgcaagcgccatagctatgctaccaaatccaaccagcaccgggttgttaagacccctggtgggaagttggtgtaccagaccactaagaagagagcaagtggacctaagtgccctgtcactggcaagaggatccaagggattccacacttaagacctgctgaatacaagaggtctagattgcctaggaaccgcaggaccgtaaaccgagcctatggaggtgttttatccgggggagctgttagagaaaggattattcgcgctttccttgttgaagagcaaaaaattgtgaaaaaggtattgaagatccagaaggcaaaagaaaagcaggcatcaaagagttaagctgttgagttattcgtgagtgaaaaaaagatcttgttaaaatttgtgctaaagaattttgactttgaatggtgttaactatgaatgtggaaacttaatttgaaatttattttatgattcttgtgccttttggtagcttacattttgaatatgaaaaattttaaatgttccaaa

SEQ ID NO: 155 - DNA, 3171 bp, Glycine max
gggtagacaaagctagggttcacattttgaacttgtttgtctgtttccaatggagcaagggagcacagacactcgtgtggatgcaaacccaagtctttccagtcacgaagaaatacaatctttggatttcgatactgagtgtgagaccaaaatgaccaactctgctggaaatggggcaggaggttcttcctatgttgaagaaggcgtgagaaaaaagcgcggcagaaaaagtaaaaaggagatgggaaagatgttagatgctaccgccatggaaggtggggtttccgagcagagacccagtagaaaaagaaagaaatatgatgaaatggctgaatttgaaatgtctggcactgagaaaaaatatggtcttaggggctgtaaacaagagatggagccaaaagccaacaggagaaaggccaagtgtgatgaagagggccccttaacgtgccatcaatgtaagagaaatgataaaggcagggttgtgaggtgcaaatgctgtaacaagagaagattttgcctattgtgtttacaagcttggtatcctcatttgaaagagaatgatattgctgagaaatgtcctgtgtgccgtggtaattgcaattgcaaagcatgcttgagctgtgatgaacttattaagcaaatgagggagtttgcaaaagctgacaaagaagagaaggttgaactctgtatgtatttgctgcaagtacttcttccatatttacggcagttggatgaagaacagttgattgagaatgagacagaagctaagatacaagccaaagatcactttgcattgaagtctgactgcataagagaaataattatctgttttataatcatggataaaattttcacttttgaactgcctgactgttacgtgttgcaaactatttcttctagttattcccccctcttaccaatgtatgacaactgcaaaacatcaatatttgattaccatagaagctgcacaaaatgctcttttgacctttgtctcatctgttgccgtgagcttcgtggtgggcagcttgtaggtggtgcagatccaatagagttggagtttgtttggcaaggtcgtggttacttgcatgctgaaaaaaaagatgaagaggtaaaacaaaatgcatcagatgatgattgtaagcctgaggttcgtgaatggtcaagatctgggtggctggcacaaagtgatggtagcattccttgtccaaaagtcaatgatgaatgtaaccatggttttcttgaactgagaagcatattgggtcaacattttgtctctgagttagtgtgtaaagcaaaagaactagtgcaagcatacaagcttcaaaatgtagttaagaccgcagacaacttctgttcatgtttgaagcttgatagaaacacagatgttagctatagtaatatgaggaaggctgcttctcgagaagatttgactgacaactatttatactgtcctaaagctgtagatcttcagtacaaggatttaaggcattttcagtggcattgggaaaagggggagcctgtcattgtcagcaatgtgcttgaatgtacatctggtttaagctgggaaccacttgtcatgtggcgtgcattacgtcatgtaactaataccaagcgtggccaacatttggctgagaaaacaattgattgcttagattggactgagggggaaattaatatccaccaattttttactggctatacaaatggtcgtaaggattggcttgcttggccacagatattgaaattaaaagattggcctccttctaatttatttgaggaacaattgcctcgtcattgtgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggacgtggtgattcagtgactaagctccattgtgatatgtctgatgcagtaaatgtgttgactcatattgctgaagtgaaactggattctgatcaacttactatcattgagaagttgaagcaaaagcacctcgagcaagagaaaagggagctacttggtgatgatcaggatggaggaactaatgttgacatgcttaataattcatcttctacaataaatgctttggacaagcaaataaaaataaatcaaggtgatttgttgtttgggggggatgcttcagatggtgctctctgggatatttttcggagacaggatgtccctaagttgcaggaatatctgaagaagcatttcagagagtttaggcatgtccattgctgtcctttaaagcaggttattcatcccatccatgaccagaccttctatctgactatggagcataagaggaagcttaaggaggagtatggaattgagccctggacttttattcagaagttaggagatgctgtttttattccagttggttgtcctcaccaagtcagaaatctgaagtcatgtatcaaggttgcaatggattttgtgtctcctgaaaatgttggggagtgctttcgtttgacggaggaatttcgcacacttccaattaatcacaggtctactgaggacaaattggaggtgaagaaaatgacaatatatgcaatggaagatgtgattggaaagttggagaaagcaaggtccgggttaaccaagggtccagagtaaatatatctgtaacagatagaagccaattggaagtgtacaaaattcgagtcattagcttattaagtgtgatgatgttgggttctatgtatcgtgactgtaagaatggttccatatttggctttgctacccacctggaagaggatttaccgaaacatcatacatgacctgtaacggagtagttgtagttttttttttttagtgtacattggcagttgggaggtttcctcaccgctacgtcgatcctagtggggttaggtgtacatatagttgtcaccccttgtatgccttgggtgtgctgatttcttaggccgaataaagtttgtgggcatatgatgatgtcagcattgtacttttagaacgtctgaatatgtatagatgagattctaacttgcccttattgcattatcgatgtgtttgaattagattcttagtaagaaattattaattttttcatggtgaaggtaaagcaa

SEQ ID NO: 156 - DNA, 2690 bp, Glycine max
gtgacgaatgatgttacacaagacgctcccgttcatcggatttgctagcaggtcacagtgtcacccttttatatttaatattttcaaactgaagtggaatagtcccttcctttttacacactagccgcttcaccaaagttgaaaattttcagaaaccaaaacctctccctccttttcttttttccttcttcgccactctctccattcctccgatgatttccgaaccggcgagttccctgagaaagagcaacttccaagaccggcgcctcagcatcatcgacgtttcctccgccgacgattcgcttctcgatggaaaccctctcagccaccaacgttcagagaaccaagagcaggccgatgtgttgtacacgccgaactcgaagaagttcgaagacgccgccaccaaactccaacaatgggaccacgagcctcactccaacgactcatccggaatcggaaaacctaagaaaaacagcaaatgcaatctgcgcaagagtttagcctgggacagtgcctttttcaccagcgccggggttttggatccggaggagttgactattataattgaaggtgttgagaaggatgagaagcctgaattaccgtctattcaagaggatgtgtacaagtcgtgtgagtccatttctacgttagcgagtgatagcttgacctttgaaagtgtggagatggagggtgatttatttgaggatgtaagagcttcaattcagaaatctagcaaaaagtccagccctgcagcgtcaaacatcaaagtgccatcttccccttcggttccattgttccaaactcatgactcttcgaaaaaggttggcatggtttcttgcaataagatgaaggtcccacctgcttctaagaatccaagtgctggcatgcaaggatttgggaaaatgacgaagaagaataatcctattttcccccaaattccacagaagcatgtggctacaaggagagagtcatctattttaatgcaatcaaaggtacccggaaggtctagtttaagttccacaattccatccaagagagattcacttggcaatccacatgtcaaaagtgaaagggacaaggcaaaacgaatagttggtgatagagtcagttcagtggcaaaagcatctgttgttagaggttctcgaggttctgtgcctaagcccacactaccatccaaatcaccttctggtccgacagtatcaaccaggactaaatcagtgacttccacatcttctgttgtcaaaacaccttcaagggttgcttcaagaaataaagctgaacctgagatttctagtctttcaaggttgatgtctgccacaaagctttcttctagtatttcgcccgctagctctatcagtgactggtcttcatcagagtcatcctcaacaacttctatggctaaacgtgtgtgtaatagttcaaggcccagcattgattgtgggtcaagcagaaaggttttattgaacactgatgcagatcaaggtacacaccctcagactcctctgagtgattcaagcttagaaaggcaagaggctcggcaaagtgggattattagtcagaaggaaaggacagtgcctggagcgacagttcttcctccagtttccaagaaaccttcaggccttcgactgccttcaccaaagattggttattttgatggggtgaagcccttagtgcgcactccacgtgggtctgttgtacctggtggcttgccaaaacatggagctgaaagtccaagagaaggccaaaacaaagcagaacttggaaagctgcaaccatccagatcttttgtttcaattgataatacaaaacccaacaaccagcaacctccacatccaaatccttttcatgaatcattagatgttgcaattaagacatctaatagcgtgcagaatggcaaaagctcttccgacatatccattggtgctgttgaaaatacatcacacttccatgtagtggagaaagctcatcatgatttgccaccacttaagggtgtcaataaccaggaaaatgctcatcatgatgatcaaattgattgtttgagcaaacaagttggacatatggacataaattttgagataggggaaaagtttaatagtgattccctttatttattgcagaatgatatcagcttccaagataaatccaatggtctggatttatctagtcacaaagagcttattgattgtcctaagaaagacgaattatttaatggtttatctactacatacctttatgtctccccaaccagctttgatgtggtagcttcaacaaggagaccctttgcggtcaaagattccttttgtaacatggatggtgttgtctttacagattcaacagtttcagaggctaaatcgaccaacttgcctgtgccggagagcattattatgaaagaaaacgagtgagattgtgtaattaagttgaactatatgtttgttgagtttgctgctttgtgcaaaactgtccaagtcatgaatggatagtctttatcatttttgaaatacttgttatactatttatactttaatttgatgggtcttctagatgtattacccatggattcgttgctgtgaattcgtcttcgatgttttgaacgagaagaacctcgtggtgtcgtgtatccttttggatttcatgttctgtttcccatcgggaatttaaatgcctgagatgcattcgtttgcattttcatt

SEQ ID NO: 157 - DNA, 2888 bp, Glycine max
cccacccacgctttctctctctttttataacaagtctcaaactaacggcatattctctctctctctatatgccgcagcgcatgctttgatcggccaagtcatctctctcgctcccattctccgtatttccaagatcccaacgcactgtcttatcctcccagattccggtgaatccccccttcccttttaatcttaaatatatcaacaaccacaaccaacaaccttaacctttttgtttgtttctaccaaacaccattttttttttctataacagagtaatggtggtgaagatgatgaggtggcggccctggccgcctctcctctcgaagaagttccaagtgaggctgcacgtgcggaggctccagggctgcgatctgctgcagaacgctgcactccaaggttcaagattggtccttgagattcgctggaagggtcctaagttgatccttggctctctgcgatggaactccgtcgccagaaattttactaaagaggcggactttgaactcgacggcggtggcgccgccgtcgttcactgggacgaggagtttcagactatgtgcaatttgaacggttacagagacaatgtctttcacccttgggagatcgctttcactctctttaatggattgaaccagaggccaaaaaacaaggttcctgcaattggaaccgcattattaaatattgctgaatttgcatcttcaactgatcaaaaggattttgatttaaacattccactcacactaaccggaggttctggggagccttctcctttactctgtatatcaataagtttgatggagctaagcgtagctcaagaaagcttggagccagttcagagatctatagtgcctgtgccatcgccctctgccaagtcgggagaaacagccttggcagaaaaagatgagctttctgcaattaaagctggtcttaggaaagtaatgattttgacggagtttgtatctcccaagaaagcaaaaaagggttgtcgtgaggaagaaggcagtgaaggaaggtgctctaggagtgaggatggtgaatacaattatcctttggattctgagtcacttgatgattctgaggaaggtgaaacagatggggggaaggaggattccagtgttaggaagtcattcagttatggaacactggcttctgcaaatgctgggggattttttcattccaatgcgagagtaaattgtaatgatgaagactgggtttattacagccatcgcaagtctgatgttgggtgttcacagagggaggattctactgcttcttcttctcagccttatttagtacaaagttccaagcgcagcatacttccatggaggaagaggaagttgagtttcagatctcctaaagcttataagggagagccattgttaaagaaggtgtatgcagaagaaggtggtgatgacatagactttgatcgccgtcaacttagctctgatgaatccctttctttgacttggtacaagattgaggatgacacgtctgcacatcgatcatcaatctctgatttcggggatgacagttttgctgtagggagttgggagcagaaagaagtcacgagtcgtgatggtcatatgaagcttcagacacaggtcttctttgcttcaattgatcaacgcagtgaacgtgcagcaggtgagagtgcatgtacagctcttgttgctgtgattgctgactggttccaaaataattgtgatcttatgcccataaaatcacagttagatagtctaattagagaaggctcctcagaatggaggaacttatgtgaaaatgatgcctacagagagcggttccctgacaagcattttgacctggaaacagtcattcaagcaaaaatacgtccgcttactgtggctcctgggaagtcctttattggtttttttcatcctgaagggatggatgaaggcagatttgactttctgcatggtgccatgtcttttgataatatttgggatgagattagtcgtgctggacaagagtgccccagcaatggtgaacctcacatttatattgttagttggaatgatcattttttcatccttaaagttgaatatgattgttattacatcattgacactttgggagagagactttatgaagggtgcaaccaggcatatatcttgaaatttgacagcaacacaatgatgtacaaaacgccaaatgttgctcattcatcagacgacaagacatccaatgaccagcaaactgtagcagaaatattagatcctaataatagtcaaacccaacaagtaaatagcaaggaggtggattctgttgcaggggaaaaagaacagttgaggactgagcaagaagaacaagttatatgcagagggaaggaagcatgcaaagagtacattaaaagcttcctagctgcaatccctatcagagaattggaagcagatgccaagaaaggtctcatttcttcagcatccctttaccatagactgctacaaattgagtttcactacacccaactgttaggtgaaacatcaccaatggctgaactaagagaccttagctcttgcaataactaaggcttctacataaccaagctgtaaattgaagaaaatgcacgtctattctaacttattttactactttaaccattgatgttcttctgattttgaagtgaatttaattaacatatggaggctcgtttaagcttttggtgcgagcaatgagtgagctgagcttttatttgtgcagttctgcgtggcacttgccttgttttacctgtatttttccttgggaaggttattctgtaaatggctctgtaatttcctttttcaagtgagtgtatgcttttggcatctgaaatgtaagttctgaacagattctactagtaaatggcaggtaacttagtttttaaagactcc

SEQ ID NO: 158 - DNA, 1926 bp, Glycine max
atcgatcgatattcgacaagctcaagcaagcatgcaccgcaagctctcacctttgaagccccaaattttaaaagatataactggcctgacagaaactgagaggatgaaacgtaatagtgtttatccctctgcacttaactgtgatgacatcttgcatgagatcctacttcgaataccaccaccaactatctccaaattaattatcgtatcaaaaatatggttgcgtgtgatatgcagtccttcatttcgtcaatgctacttgaggcaatggggacaaagttttcgacttttgggtttttttgtttgcaactttttatatcttggaagacctcgtgatggctatcgtcgccctcgttgggagcctgcgctcccaatcttgtccacttgcaaagatggtgatgatttgaaactttctggaatcctcaaacatcttgggtacttcattgatagttccaaaggaattattctttctggtttccatccaaagacatattatgtgtacaatactgtgaccaagcaaaagtatgaactcccagaacctcagcagttctataaagttctgtgcatggcattgattgttgaggaatatcttgatagtgacatatgctacaaggtgatccgtgcaagatgtgaatgcaaacttaaggaacgcaacactgtctcaattgagacttattcatcaaaaactagacaatggaagcaatccactctgatgtgctccacaacttttgcattgtgcccaaggacggcagctatggtggttggaggggttgtacactggtttgcaatgtggggaaaacttgccatttatgatcctcgtcttggagacaggtatatagccttgattaaactaccaacaggtgtgttaacacatgagcatgaggaatctgttcttggggagtcatctgatgggcttttgcagtatggccagagcaataatttgggcctggagatatggatacttgagaaggaatcaggagccaactcatctatttactgcaactgcactcatctgaagtacaagtggattctgaggtggagattaaactttaaagtattatggaagcagatgccgtctttaagcacacattctaaagaaacccagatattgtcattccttcctcagaattctacttctatcttcattaggtcggggtggaatattttgctgtgtgatttggagaccaaaacggtggaaattgtcaattatcagggtcgtggaggaaccatttcatgggaatctagcaaagtagttccttactttctaccagcttggccacacacttcctcggtgtcggtgtcatgacaacatggaacaagggaaaacttgtcgtttttcaatctagaggcacttggtcttttccattctgtttttgatctggatatgatgaaaattaagggtctgttttattttctgtgttcacttttaattacaatcttgttttcaatctaaaagttgttttcactagtttctattcaaatctttgaaaacaggaaatagattgaaaacaaggtataattaaaagtaaaaaccaaaaacattttgtcaaagtaaacggaccctaagcttttagcttctttgttctgttttgaatagccatagtattagtaggaccttcatttctcttacagtttcagtggtgtactgtacatgcctagaggttgctgtgttatcaaaacactgaaaaatattactcttctgattactttctctttagtcttttcgtagaagaattcagaattgcagcctgatacagtcacaacaagctgcatataacggttttcaaagatgaagatgcaagactcttgttttacccgtttttgtttggttttgctaaagtagaatttgaatatagttttgtttgattatggtaactatgtatatgaatttcatacattgaaaactgatgtcctttaatttacagt

SEQ ID NO: 159 - DNA, 1228 bp, Glycine max
tcaatacaataactagaaatctagaatggctttgaagcttgtaaatctagggtttcactcatcgattccgtgttctccgaggcccttgaaagatcggttcgtgcttcggtcttctaaagtggagcaaatatcgtttacggaatctgagaactcactcatcgaagcccttcttggcatccaaggacgcggacgttcttcttctcgtcagcagctcaatgctgttgagcgtgctgttcaagtcctggagcggttagggggtgtacctgatccgacaaaatcaaacttgatcgagggtcgctggcagctaattttcaccacaagaccaggaactgcatcgcccattcaggcagcagcatcaattgaagatggaaaaagaatcctttttaggtttgacagagctgccttttcttttaaatttcttccattcaaagttccgtatccagttccatttaggctgctgggagatgaagcaaagggttggttagacaccacatatttgtcgagttcaggaaaccttcgtatctcaagaggaaataagggaaccacatttgtgttacagaagcaaactgagcctaggcaaaggttattgacagctatttcctcggggaagggcattaaagaggcaatagatgaacttatttccttaaagcagaatactggtcaagaagatccagaactagaagagggtgagtggcagatgatgtggaattcacagactgtgacggatagttggatagagaatgctgtcaatgggctgatgggcaagcagattatcaggaagaatggaagaataaagtttctggttgatatcttgcttgggcttaagttctccatgagtggaaattttgtaaaaactggctccggagtgtatggcgttacaatggatgatgcagccataattggtggcccattcggatatcccttagaactgaaaaacaacttcatattggagcttctatacagtgacgagaagctcagagttagccggggaaacaacagtattcttttcgtacatgttcgtaccgatgcattgaggtgacctagtacatatgtgattgtttagaagaatagacgaaacctttgcgagtgacaattttaaatttgtgttcaattgggtatttaactgtacgacaatgcaaactaaatataaacataacatggacgtactacttgttcagcttccatttcaagttgtggtttattaaatgcttcaattctattttggcaa

SEQ ID NO: 160 - DNA, 1542 bp, Glycine max
aaacaataaaaaaaggcaatacaattttaagcgctgtaacagcaggtttgggaggcttttggggtagccggcgagacacagtggattccttaattctccatggatatggggaagaaagaaggtgaagcccccgtgttgtggttcgaaacctctgactctgtctgttgccaacaccagtttgaacccgatggtcgactctccgtagtgattgttgatgattccaggcccctataccaaaggatggctggatctttcatgaataaatttttcccctcaggatatccgtacagtgtgaatgaaggctatcttagatacacgcagtttcgagctttgcaacatgttaccagtgcagcactatcggtgctatcaactcagtccttgctattcgctgcagggttgcggcccactcctgcgcaagcaactgctgttagttggattttaaaggatggaatgcaacatgtagggaagctaatatgtagcaattggggtgctagaatggattctgaacctaaacgttggagactactagctgatgtgctctatgatataggcattggcttggaagtgctttctccattatgcccgcatctttttcttgaaatggcaggcttaggaaattttgcaaaggggatggctgttgttgcagcaagagcaacaaggttgcctatatattcttcatttgctaaagaaggaaatctcagcgacctatttgctaaaggagaggctttttcaactctctttaatgttgttggaattggagtaggaattcaattagcatctaccatttgtgcatcaatacagggaaagttggttgcgggtcctctcctttcaattatacatttatacagtgtgtctgaagaaatgagagcaactcctatcaatacgttgaatccacgaagaactgcaatggttgtggctgattttctcaaggcaggaattgtatcgagccctgctgatttgagatatcgagataatctgctgttcaatgtgcaagtcaaagaagacactggaaacgtaagagtggggaagaatgtgcacaaggtcattaagccttccaggcttcttgaattaaaacaagtgttccccgaggagaaatttctcttaaattttgggaataaatgcattgacatggtattggaacaagatgctagtggtgaagatgcactgagagggtggctagttgctgcatatgctgcacgaactgagagttcctctcatgagctcagtgctactagtgtcctgcatgaggcttatgagaaaatgaatggtgtctttcctgtattcttaagggaattacagaacaaagggtggcacactgatcggtttttggatggaactgggagccgtttttcattctagtgcttgtataaatttaatgttgctttaaataggttttatccattctctgagaattttttatgagctatgggtggagtaaatccaatggttcacattacctgtgcttaattgtgtattttacctattatttttcaaaaactaatggtagacataccttccaaaaacacgatgaattcttgtagt

SEQ ID NO: 161 - DNA, 1095 bp, Glycine max
acccaaacacttctctttttctctctctacactctattcaacccttcacattttctctcttctttatcttaaattacttttccatggaggaaagcaagaaacgagtccgggacgagtccagctactcacccgagtcccaaactcagctggtcgactctcccgagtctgaaagtcagcgggtcgactcacctgagtctaagattcgtcgagttgactcgtccgagtctcaactcgactcggtccttgactcggaggtgcgtctacaagacgacatttttaacatacttgacgacgccgataatgtgcctgagcgtgactcggtgcagggtcttgactcagtgatcaaaagcttcgaagatgagataaacgctcctggttcggattctggttcgggcgacccgacccaggaaccagactctggggagctacaatctaacttggggtatcttctagaagcctctgacgacgaactggggttgccgccgacggttgttgacggtgaggaaacgggtcgggttggtccggaaatgacggagcttgccaggttaatgggttttgaagatgatatacccagttatgatgcattcgggtttgggtcagggtttgcggcggagagtgacggcggcgccggaggttttgtgacggtggatgggttgtttgactattcggacccggcggcggatgttttgtggcggtcggagtcattacaagctatgtaggtgaccgcggcgagattttgcgatggttttggcagaagggtgcgtaggggtggaaaatgtaaatctaggaaaatattggggttaaaataggaggaggaaaaaaaagggtagggtagcatagaaacgtggtaggtagatgtgaaaagttgtagggtttgttgttttggttttttcgttgaattcaattgaaacaaactggactacttgatgagccgtttcagttttgttttgttgcttcattttcttgcatggtagaacttttttttttatatatttaatttatttatcgttcaaaatcttttacatttaaaggaggagtgcttaatggttcggaaaaaatatcctctttatatataaaataaatactcttttttca

SEQ ID NO: 162 - DNA, 951 bp, Helianthus annuus
gatttcgacacaacaactttcctagcttttttcacaaacccctaaagtgtaaaaccatatatatctgttgtgtagtgttgacccgaccacttattccactgcagcaatgtctggcccagagtgctgccaaaacccaccggcgccctcctccggcggagaatccggtgatcttttacaaatcgcatctctcaattcctatgtttccggcaaccctgattccaaagtcgccgttattcttatttccgatgtttatggttatggagctccgaaactgaggcaacttgcagacaaagttgcagctgctggatattatgtagttgttccggatttcttctacggcgacccgttgactcccggaaccaacatagaagattggctaaaaaaccatgcacccgagcaagcggttgattttgctaaacgagttatacaggctctgaaagagaagggtgtaactaaaattggggctgcgggtttttgttggggcgctaaagtggttgtggagctagcaaaggacggtgaaatacaatttgctgcactcttgcatccttcgtttgtcactttagatgatatcaagggggttaagatcccgatagggatactaggtgccgagatcgacaaacgatctccaccagaactcgtcaaagaattcgaggctgcactagtcgcaaatgaggttaataactttgtaaaaatatatcctggtgtcgcacatggttggaccgttagatataaagacgaggatgcagcagaagtgaaatgtgcagaagaggctcatcaggatcttgtggattggtttgggaagtgtcgtcattagacatatgattaaatctgttaaaccctaatcaatcatatgtaataaaggagggatttggatgtttgagtagttccttaaaaactaaataaagtgtgtttgaagatattaaggtctaatgttgaactctttgcgaaaaa

SEQ ID NO: 163 - DNA, 3085 bp, Solanum lycopersicum
acgtggaatttcttctacttgctcttctctcttattcattttctagcctctaatttatttcctatttattgaaattgaatcaactccgaaaaatactagtggctgagatttttctttgagattttatgggaaatgaaaaacctcttacctgtactagtttagtgcttgctacctctgcctcaaacctgcttccttcctcttcatactttttcttcttcttcaattattgattaatttctacttgtgaaatggttttctccgatctaccattgctgttggatgacttttcacttcatgcatgaccgaaacaacaactagtgtttgtttacaacatggctttcttcgaaggtttaggcatcatgcggttcgttttgtagtgttacattatcaggttcttttgtacaacaccacggatagactatatttgatagtaactgatgttgtggggagaatcggaagaagatttgttctgtatcccctgtttgtccctgaggatttgaagcagagatagctagctttggttcctttattttgatggacccttattcctcaggggaggaacttgttgttaagacaaggaaaccttatacaatcactaagcaacgagagcgatggacggaggaggagcacaataggttcctagaagctttgaaactttatgggcgtgcttggcagcgcatagaagaacacataggaactaaaactgctgtgcagatcagaagtcatgcgcaaaagttttttacaaagttagaaaaggaggctcttacaaagggggtcccaacaagtcaagcacttgacattgaaattcctcctccacgacctaaaaggaaaccaagtaatccttatcctcgtaagacaagcgcagcaggtcactcatcacaggtgggagcaaaagatgggaaatattcgacaactttttcttccatctgtgaggaaaggaacttatttgacctggagaaagaaccgattactgagaaacctggcggaaacgagaagctgggcaatgtaaaagaaacccagaacaagaaaaactgctcccaagggttaactaaggaaggtgcttctgcagcctctatgtcttcaggaaagtccttgcaagcacatgtggcacctacagatgtgtgtgcctttagtgagtctgtgtctgtcaccaaaggagtggttaacaatgataacgcaaataaatcttttctcattgttgaatccaaagaacatcaacagtcagaaatactcgatatcagacagtcctttcaaggtaacagctcctgtaacacctttgacggggggaaatcttgccagtcgagtgaaaagttggcacaaggtgagaaaaaacatccatcgtttcagccaaaccatttgggggaattctcaagaaatgatatgcaagtgctacacaactatccaagacatgtgccagtgcatattcttgatggaacaaatggttctcaaatagccccagatatgtttaatcatgaatctacgagtcagcagataaatggggtcccggggctcccaaatttgtattctaaccctgcttcatccaccacatctgagcaccacagtaacgctccacagtcatccattcatcagtcattttcttgtttccaccccattttcacccctattcgtgatccagatgattaccgatcgttttttcaattatcctccaccttctccagccttattgtttctgctttattgcaaaacccagcagcacatgtcgcagcaagttttgccgctagcttttggccttatgcaaatatggaacgtccaacggattctccaactgataacaccgctagccagattaactcagctcctagtatggcagcaattgctgctgccacagtagcagctgcaactgcatggtgggcagcccatgggctcttaccattgtgctctcaatttcaaagcagttttacctgtgttcctacatcagcaacatcaatgcaagtggatgcctgtcaacctagagtagacaagaacgaaggaagagagggaactcatgattctccccatgttcaggaacctgtcccagaatgctctgaagctttgcaagaacaacaatcaggttctaagttgccaccttctctatcatcagaatcggaggagagtgaaggtaggaagctaaaaactgggttaacggccactgatactgagcaaggagctgcagttactaaaattaatgagccaaacgcagaaaagggcgggaagcaggtagatcgctcttcctgtggatccaacacaccttcaagtagtgaaattgagacagatgctttggagaaggatgagaaaggtaaagaagagccccaagaatctaatattaaccttctagctggagaggctgcgaatcggcgttatagaaatttcatcagtccaaccgaatcttggaaagaagtctccgaagagggacggatagctttccaggctcttttcaccagagaagtgttgcctcaaagtttttctccttcacttgatctgaaaaataagggaaagatcattcttgaaaagttgaagcaaaagccagacgagaaagttcaatgtggaccgcagttagatcttaatgatatggcatccaatatctgttccagtcaccaaacaatggaagacaatgtgttattaattggcaacaaagaagatgtagaaacatgcctaccaatgatagaacttggacaagtaaggttgaaagctcgccgtactggatttaagccttacaagaggtgctcattggaggcaaatgatagcagggtgacaagttctaactgtcaggatgaagaaaaaagctcgaaaagacttcggttggaaggagaagcttctacttagtgttgtatcaatgtgcaattctacgagggaacctgtgttgttgcacggagagctctattctatcctgttattatcttttcccagttacgttgtctagttctaatgtacacgaaacttgtcgtgtaggtgtgtaccatattatttttatgttctcttttaattggacttgtatgcaagggactttgaagtatgaacctaaatgtggatgtcttcaacaatcatagcaaatttaatggaccttgattggaccagttcctcggaa

SEQ ID NO: 164 - DNA, 2743 bp, Solanum lycopersicum
aagtgttaattgatacatagtatagtgcttttcaccattaattttcttcatcagatctggtggtctcttttatgtatgtatctccttcatctttgtctgctcagtgcttttggttcctcgttttatcttgcttctagctcgaattttcttccgtgaatcttctttgtgttttattactgattttgggttctttggaggcccttattttttgggggtctaaagctgctttaggttgagccgcatgagcaatttgtgtttaagttaataaattgaggaacttgatgattgatcactaataatattaggtaaggtctccatttatttcattgggtatgttgctgttgtacataatcaaagtccatgtactgctgcttgataagatatttgagattgcttgtgaattgtgatataaccaagttatttattattacaagttgataatccgtccgaacttatgtgattttgctctctaagtagaagattagtttgtaattatacttctgaattttagatggaagaaacttctctcgatagtgagcaaaatgttgctgggcaaggcagtgggagatttcaagaaatagagtcagatgatcagaacagtgagaaaattgagtcagatgaattatttgtacaaaatggtgtgcaaatagaggcaaatggtttagatgatcacaattgtgttactgaggatgggcagaaggaatttgttgccccagcagttggaatggagtttgaatcgtatgatgatgcttataactattataattgttattccagggaggttggttttcgtgttagggtaaaaaattcttggttcaaaagaaatagcagggagaagtatggtgcagtactatgctgtagtagtcagggtttcaagaggattaaagatgtaaaccggctgcgcaaggaaactagaactggttgtcctgcaatgatgaggatgagaatggtggactctaaaagatggagagtactcgaagttactcttgaacacaatcattccttaggtacaaaagcatacaagactatcatgaaaacaggtactggaaacaagaagaagttggattcaaactgtaacgctgaagtgcaaacgattaagttataccgggcactagtgattgatgcaggtgcaactaggaatgccaattttagtgcaaggaggtgccaaacttcatctgattgccatgataagctgaacttaagaaaaggagacacacaagccatgtataattatttctgccgcatgcaattgacaaatccaaacttcttttacttgatggatctgaacgatgaagggcagttgaggaacgtgttctggattgatgccaggtcaagggcggcatatgcttactttgttgatgtgatctatatcgataattcatatttgtccaacaaatatgagatccctcttgtggcatttgtgggaacaaatcaccatggtcaatcaatgttgctgggctgtggcctgcttgctggtgagactaaggcctcttatgtttggatgtttaaagcttggctcacctgctctcttggacgtttccctcaaacaattattacagaaaggtgcaaggttttggagactgcaattcatgaggtattcccgaggtctcttcatcgttttgctttatcacacatcctgaggaaagttccagaaaagttgggaggattgcgtaactatgatgttattcggaaggcattgtttaaaacaatatatgagggtctaaagccatttgattttgaagcagcatggagagttatgatccaaagatctggagtgggtgatcacgagtggctttgttcattgtacaatgaccgagctaaatgggctccagtttatctgaaagatactttctttgctggaatggccactgccagatccaatgaaacattgactgctttttttgacaaatatgtgcacaagcaaacgcctctaaaagagtttcttgacaaatatgaattagctttacagaaaaagttcaaggaagaagctcttgcagatatggagtcgagaagctcaaaccctgaactcaaaacaaggtgttcgtttgagctgcagctttcaaaagtgtacactagagagatctttaaaagatttcagttagaggtagaagagatgtattcttgttttagtacaacaaagttacatgttgatgggcaggtggtaatatttttggtgaaggagcgtgttttggaagaggggaataggagagagatacgggactatgaagttctgtacaacagagaagcagcagaagttcgttgcatttgtagctgcttcaacttctatggatatttgtgcaggcacgcattgtgtgtgctgaacttcaatggtgtggaagagatcccgtcaaagtacattttatcacggtggaaaaaggattacaaaaggttatgtgcattagatgttgaatctagttttaccgagtccactgaacaggttcaatggtatagccagttgtatataagtgcattacaagttgtggaagaaggggtgatttccctagatcattataaagtagccctaaatgcatttgaagagtctctgtccagagttcaccacattgaagaaaaaaccaaataaaaatttgttgtatttagcatatctactatctgttcttgttatcgaagggtgcctaaaaatctcttcttgtgtataatgataatagaacaagtacatctgtaaaacccttgtcttcctatgcataaatgtgtgaatgtaatgctcccagaagctttggacctg

SEQ ID NO: 165 - DNA, 1632 bp, Solanum lycopersicum
gagaaaacaagaatggtagatctacaattgtaagcgctttatatcacattttgaaggaagagatctactttattccctccatagcatttctttcaatttccctaccgctgataaacttaacagaaacgagacccattattctaaagaatgatcgcttcaactgtgcgaaagcccctctttggcgttactctattcaccttatctctctttctcattctcttcttcttcgcacctttttctttcttctccgacccttcggttaccttcaattcttcacggcgtgcaagacccgagatatggagcatacgaagattagctgagtggcgaccttgcaattggtggctccaaccaccaactaatgctcttcctgctaaagctaatgggtatattcgagtggattgctatggtgggctcaatcagatgaggagagatttgtgtgatggtgttggaatagctcgtttgctgaatgctactcttgttttgccgaagtttgaagtagctgcatactggaacgagtcgagtggttttgaagatgtatttgatgtagacttcttcatccaacaaatgaagggctttgttaatgtggtaaaagagcttccaattgagattgcaacaaaagatcctgttagagttgattgcagcaaacgcaaaggccaatttgactatgttgagagtgttcttccttccctgctgaagcatggatatatctcgatcacccctgcaatgagtcaaagaagggataggtaccctctttatgcaaaagcagcactttgccagggttgttatagtgcgttgcgccttacaagcacattggagaagaaagcacttgagcttctagaagctataccaaaacccttcttatcgcttcaccttcgctttgaacctgacatggtagcttatagtcaatgcgagtactctggtctttctcttgcttctgcaaaagccatagatgctgcacgggttgacaggaaaccttggactggggaaacagctcgtatttggagaaaccgtggaaagtgtccacttacccccaatgaaactgcattcgtacttgaagctttagccatacccaccaatacgacaatttatttggcagctggtgatggcctgatggaacttgagggacttacatctgtgtatacccatgttgttactaaatctagtcttcttagcggagaggacttcacaaccatgcatgggaatacaaaagctgcactggattattatgtgtctattaacagcgattcttacatggctacttattttgggaacatggataagatggttgcagcaatgcgagctttcagggggttgtataagacaattttcttgaataggaaagcctttgcattgcttacctctcaagggtttaaagggaaggaactaacagaagccctgtggaaggttcatagagatgattttataatgggtagaggatctgccttacctgactgtttttgtgaattcaatgtatgaacttatgttttcctcttcagtttattcgttacttgatgttttggttatagccggagcaatttattcgaaaagatgtctcgtgtttgatgtaggtgtcattcacaaaattatgtaggtgacatttaattcatgtatttaaagtgtatgtagcttatg

SEQ ID NO: 166 - DNA, 1071 bp, Solanum lycopersicum
actttccttatagtagagtaaacgaacacttattattactgaactgttactatcaaaatttggcttatctaaaacatgtatacacctcctctatcacacatttcacactccaatttagaagaaaattcaacagagagacgattcaatttgcagagatgaacggcgctatgaatatgcacggagatatggcgccgccggtaccacatgccgccgtgaacaaccacaacatgatgatgcacatgacgtttttctggggaaaaaacgctgaaattctcttctccggttggccgggatacgacaacatcggtatgtacgttttcgcacttatcgtcgtttttctacttgctttcttcgtcgagttgctatcgcactcaaattacatcaaagagagtgcaaatcatgtgacggccgggttgattcaaacggcgttgtacggagttagaattggtttggcttatctggttatgctttctgttatgtccttcaatggcggaatttttctggcggcgatttccggtcatacgttagggtttttggttttcgggagtagagtttttaagaaatcgccgttgacggcttatgctaaagcctccgatcttccttctatgccttgtaattgttaatgaaaattgaaagctttaaaatcgaattgtaatcgataattcaaaataaaaaaaatgttaattgaattatagatatcgaaacctcaactcaattatcgaggaataattatacaaaaatggagatgaattgaaataatgttcgattttgttcgttagcatccccgtgatagataaatgtcgacaacaaaagggacaattttcgtgaagtctgtgtcacaccgcctgccaactgtattctccgttgacagtaccaacaacgttcaatgtgatggattcattcgatctttttattaagagtttcatatttttgcgagttttgtgaataatgttattttttatttcattttatgtattttacattttgagattcaaataagtttatctttaacagtaagtttttcatagatgtttttaatattttgaattatcaattattgtgatttatagt

SEQ ID NO: 167 - DNA, 2419 bp, Solanum lycopersicum
agggtattttgtttgttcaagtgtgctattggttaatactgtgcttctcaccattagcgttttacatcgcctccatcaaacttggctgtgtgtttttataggattaattagatgggcaagctagggaagaaagcgaggaagtttgccaagaagaatcttccgtcagtgcttcgagatcgccggaagaagaaagctttattcaaaaagagatattcatccaaaaatgtgcagagtaatgttgaagaccaagccaaagtaatagaccactctaatgaaagaaacaccgaagttgaagcttttgaagacttgcctcttgaggcaccattcatggaaaatgattgtgatggtgttgttgattcttcagacagtgatggatatctttcggaggatataaactatgaaaatggaacagaaagtgaacctgaaaaacttttagaaggtgacaaatgtactagtgaattgatgatgcagaacataaaaattcaagaaaatcttgctatacaaaagagaaagctagaaaggttgaagaggaaggatccaagtttctcaaagttcttagaaaagcacaaggacattgaagcaatgcaaaatggagtagtgttctcagatgaggatgagatgagtaatcatggaagagactcggcgactgaagacaaccaaggtaaagacgagggaagagttttgacagtatctgccattagttcttggtgtcgactgatcaaagaagagcacaaggaggaagtatttgtttgtttattaaatgcttatcgagctgcatgccactatggtgctgaatccattggcctaaggtttcagaatgctgagacattctgcagcttagtaatgtctgttctttccgaagcagataatatacttcggggacttttggggctatcatccttcagttacaagaaagaagcagtactagaactgaaggataccccacaatgggttaatgtgaaacctctcatcaaatcatacttgagaagtacattatctctgttggatcaggttactgattcagaaattctggctttcgctttgactcggctcagggattctttaccattctttgatgcttttccatatctcttgcagaggcttattaagacgacaatacatttgtgggctacaggtggtgggatgctatcatcatcatctttttcgatattactggatgtggcctctctatttacaactgattggtttgacaattgcttagcaaaagcttttgtggcttatcttgctcagtcgagagctatggatattgtcaataacaagcatttgcagttcttaagaaattccttagttgacttatgctccctagatgttcaaaaatcattgtctaaagccaccgtgtctgtccgtcagcttgcaaaagtattacagtggggtttgcatacaaagaaaaaggaagctcttcaaaggatctgcagttgggagtatgccaattgtataaatctctgggttggttttatagcacgcaatgtacgggattatgatcttcaggcctttttcttcactatggttcaacttataaatggagtggtgcgcctgtttcctggaccgagatatttccctttaagactcaattgcattcaatggcttaatgatctgtctaattctactggagttttcatccctattgcttcatttgtattggatgttttggaatataaaacagtcggagagcgtggaaaacctggacctgctctcttctttcagtctgttctaaagttgccaaagagttgcttgaagtctcagacattccaagatgaatgcattacatctgcaattgaacaactatcatcacactttttacaatggagctaccacatttctttccctgatctagcaactgttccactcatccgtctgaaaaagtttaatgagtcaaagacaaaagaaagtcaatgtcgtgtggtaaaacatttgattgagcaggtggagaaaaatgttgattctgtgcaaaagaaaagaaatgaggttgccttttcaccaaatgatcatcaatctgttgaaacattccttcagtttgagaagtccagtctcagttctccatttactcagtactgcagaagtgtacttgacaaggctgctctgaggggctcacataagaacgaaaagattagtttgccaacacgagataaatcaaagcgtaaaagagatgacagttcgattaacgtttttggccacaaggatgtggatactgttaatggatcaaagaagcgggtcaaaagatgagctccgaaagcataattgtcgtaccatttttttgtttgctataggttttgataattttctgattggccttaccagtttggaaattttgagctgggtaaacatgttgtgataattctttaggttggtaaaaattcaatcttcttgttgcttatttttcaaaacagaaaatagaaaa

SEQ ID NO: 168 - DNA, 1185 bp, Solanum lycopersicum
gaaaattgttaccttttaaggattaaatcccagaaataccatatagatttgtccaaaaaaaataaaattcaaatcattatctgattttttgtattggggcacaaaccagaagagttgttgattagatcaaaaataaaaataaaaatggtggaattaaagtttcttggaatggactttggttgtgcacttggatctctaagtaatggtcaattcccagaaaaagattgtttgcttcccttaatttcaaagcttcttggttatgcaattgttgctgcctccaccactgttaaacttcctcagatacttaaaattttgcaacacaaaagtgttagagggcttagtgttgtggccttcgaactcgaactaatcggttacaccattgctttgtcatattgtcttcacaaagggttaccgttttcagcttttggcgagtacctttttcttttgatccaagctataattttggttgcaattatctactatttttctcaacctttgggaatgaagacatggatgaaaggcttattatattgtgctgtagccccaactgttttggcaggtcaaattaatcctgttcttttcgaggccttatatgcttcccaacatgcaatctttctttgtgcaaggattccgcagatatggaagaactttaagggcaaaagtactggtgaactgagctttttgaccttcttcatgaacttcgccggttccatggttagagtttttaccagcctccaggaaaaagctcccatgagtgttgccttgggatctgtgatcggtgtactgatgaacggtaccatcttgagtcaaattatcatataccaaaagccaacacctccgaaagggaagaagaaagattagaaagtttcagcacgccgtgctgcacctggagctccatgatcgtcgagcacataattcatccatatactatataccctgagaatctgtcatagttttcgcttattttcaaattttagattgatccatcagttccagaatttcattttaacatttaccatagtctcagtatggtatttctttttttttaaacctaaagtatgttaacaacagttgttacaatttctttttggtaaaaacatcctcattaggggacttcttgtgttgaagtcaccaattttatttttctagtcatcatctgttatagttgtgcaatagtttgagggt

SEQ ID NO: 169 - DNA, 1835 bp, Solanum lycopersicum
gagtaaacaaatttaagattctgataattcacacaactctatatatatacatatacccttgttgtgttattacaagccaaaaactgaaaaagggtgttttttttagtactattttgcctatttctgatctgaaatttcagattttccggcgagaaaatggcgacggatatggaggtgcagcagaacgggaaggagacggtggcggtggttaatgggtgttgcaaaaaaggacctggttatgcttctccacttgcagccatggatggtcctaaagaatctttaatttatgtcacctgcatatatactggaatgggaaggggcaaacccgactatctggctacagtagatgtagatcctaattcaccatcttattcaaaagtgatccacaggctgcctatgccttatgagggtgatgaacttcatcattctggatggaattcctgcagttcttgttatggagatccatcagctgctcgacgatatctcgtcctgccttcactaatatcaggacgcatttatgcagttgacacacaaaaggatccaaaggctcccagtttgtataaagttgttcagccagatgatgtcgtcaagaagacaggattagcattcccgcacactgctcactgccttgcttctggtgagataatgttgtcatgtctcggagataaagatggaaatgctgaggggaatggatttcttcttctcgattcagatttcaacgtgaaaggaagatgggagaaaccaggtcatggtcccctctttggctatgacttctggtaccagcctcgacacaacaccatgatcagttccacctggggagctccatctgctttcaccaaaggtttcaacctgcaggatgttgctgatgggcattatggtcgacatttgcatgtctacacatggcccggtggtgaacttaaacagacattggatcttgggaacactgggctccttcctctagagataaggttcttgcataatccatctgaagcaattgggtatgtgggctgtgctttgaccagtaacatggtgcgatttttcaagaatccagatgactcgtggggacatgaggtagctatctcagtaaaaccagtgaaagtgcagaactggattcttcctgaaatgcctggtcttattactgattttctgatctctctcgatgatcgttttctatacctggcaaactggctacatggtgacattcgacagtacaatattgaggaccctgccaatcctaagttaactggccaagtatttgttggaggagtatttcaaaaaggaaacgctgtactcgctgaggctgaagatggttccacataccaggttgatgtcccagaagtccagggacatcggttgagaggagggcctcagatgatacaactgagtctagacggaaaacgtttgtatgtcacaaactcattgttcagtacatgggaccgtcaattctaccccgaaatgatagagaaaggaggtcacatgttacaaatcgacgttgacagtgagaaaggtggacttgctattaacccaagatttttcgttgatttcggagctgaacctgatggtccatctttggctcatgaaatgaggtatcctggtggtgactgcacttctgatatttggatatgagtgtctaaaatctcataaagaataaagtctggtgactctggtcccattgtattgcatttgtttattgcaaatcctcctcaaactcccatgtaccttaaaactacaccatttcagtgtctccttagctttgtcttgatttcagtactctggttatcccttctttatattagctctttgttaaataaagtctttttttttatttctcgtgc

SEQ ID NO: 170 - DNA, 3117 bp, Solanum lycopersicum
cattcattccacgttcttcgctccaccgtgaaaaacccgtctccggcgccaaatcatgtccggcaaatcccgaaacttccgccgtcgtggcggtgacgacggcgacgatgatgaaaccgccactaagtccaccaacggtaccgctgctaaacctacgaccaccgcttccgcttccgccgccaaacccaaaaagaaaagtctacttagtttcgccgacgacgaagagtccgacgatactcccttcgttcggccttcctccaaaccctcatctgcttcttcgcgaatcacgaaaccctcttcgtcatcttctgcgcacaagcttacttctggaaaagaccgaattacccctaaacctacttcattcacctccaatgtacaacctcaagctgggacttacaccaaggaagctctccttgagctccagaagaacactagaaccttagttggttctcgctcttcccaacccaaaccagaacccaggcctgggcccgttgagccagttatagttttgaaagggcttgtgaaaccgccatttagtgtgagtgcccaaactcagcaaaatgggaaagagagtgaagatgacgaaatggatgttgatcaatttggtggtactgttaataggttgggttcaatggcattggagaaggattcgaggaagaaagatgatgttgggtcagtaatacctgataagatgactattgatgcaataagggctaagagggagaggctacgtcaagctaggcctgcggctcaggactttatagcattggatgaaggaggtaatcatggtgaagctgaggggttgagtgatgaggagccggagtttcagcagagaattgggttctatggggagaagattggtagtgggagaaagggtgtgtttgaggattttgacgataaggcactgcagaaagatggtggatttcgtagcgatgatgatgaggaagatgaggaggacaaaatgtgggaggaagagcaggttagaaaggggttaggaaaaaggttggatgatgggtctaacagaggggtgatgagtagtgttgtaagcagtgcagctgcagttcagaatgctcagaaggcgaattttggaagttcagccgtaggagctagtgtatattcctcagtacaaagtattgatgtttctgatggtcctactattagaggaggagtggttggaggcttgcccagtttggatgcattatcaatttctaagaaggctgaggttgctaagaaagccttgtatgagagcatgggaagactcaaagaatcccatggccgaactgtgacatcattgcacaagactgaagaaaatttgtctgcctcattgtcgaaagtcactacgctggaaaattctttgtctgctgctggtgagaagtacatgtttatgcaaaagcttcgcgactttgtttctgttatttgtgcgcttttgcaggataaaggtccttacattgaggaacttgaagaccagatgcagaaacttcatgaagaacgagcagccgctatcttagaaaggagagctgctgataatgatgatgagatgaaggaacttgaagctgctgtaagtgctgcaagacaagttctaagcagaggtgggagcaatgcagcaacaatagaagctgccacagctgctgctcagacgtcaacagcagcaatgaggaaaggaggagacttacctgtagagctagatgaatttggtagagataagaacctgcagaaacggatggatacaacaagaagggcagaggctcggaagcgaaggagaatgaaaaatgatgttaaaagaatgtcagctataaaatgtgatagctcttatcagaaaatagaaggagaatctagcaccgacgaaagtgactctgagagtacggcatatcaatcaaaccgtgatcaattgcttcaggtttccgagcagatttttggtgatgcacacgaggaatactctcaactgtctgtggttgttgaaaagtttgacagatggaagaaagattatgcctcaagctatcgtgatgcgtatatgtcacttagtatacctgttattttttcaccctatgtgagactagagcttctgaagtgggatccactgcatgaaaacacagattttatggatatgaattggcacaattctctattcagttatggaatttccccagaaggtgaaaccgaaataagtgctgatgatactgatgtcaatcttattcctcagttggtggagaagcttgcaatacccattcttcataaccagttagctaattgctgggatatgcttagcaccagtgaaacagtgtgtgctgtctctgccatgcgattggtgttgagatacggccccttttctggctcagccctcagcaatctgattgctgtacttcgtgatcgtcttgctgatgcggtggctaatttgaaggtgccaacttgggacacccttgttatgagggctgtacctgatgcagcacgagttgctgcttataggtttggcatgtctattcgtttgatcaggaacatatgcttgttccatgaaatttttgccatgcctgtcctggaagagctggttcttgatcaactcttaagtggaaagattgtacctcatcttcgaagcattcagtcaaacattcatgatgctgtaacaagaactgaaagagttgtcacttcactacacggtgtctgggctggccccaaagccacaggagactgcagtccaaagctacgaccgttggtggattacttgctctcacttgccagggtgctcgaaaagaagcactcatcaagcagcggagagatagagacatctaaatttgctcgtcggttgaagaagatgctcgtagaattgaatcaatatgattatgccagggacatatcaagaaccttcaacatcaaggaggccttgtgatctatctacttggtccccattgtcttaaaaaactcatgggatgttctcagttttagcagtcttctacaattttgaatttcatgtcattagtttttcttttagtgtagttacaaaaataacaaattttgatgatacaaatgaagcttaaacgaagaaccgaaggatttcatatagtcgaccctaatttgtttgggcacaaagtgtagtttgttgtattgtagtcccagattacccta

SEQ ID NO: 171 - DNA, 1611 bp, Solanum lycopersicum
tcacatcttgaaggattgatcatcttactaaattccctagtggggtaattaaaaaaattgaatcttgaaattttctgtattcatttgattgatttggtgtgtgttttgggtttttcatattatgcccaacaagtgtttgttgtaagttgtagctgaagaaatttgtaaaaaatggaagaaggtgaaacagggttgttgttgcagagtaacaaagaaatggtttcttcaggtttttcaacaaatgaaagttctgaagaaatcaagaagattaaatcagctctgacatgggtttttcttgatcaatcaaatctatggagggctggtctttcttggtcatttttttccattcttacaattggggttccattagtatctcactttatgtttgcttgtttaacctgtgatactatgcatcagagaccttttgatgctcttgttcaagtttctttatcactttttgcaactttatcatttgttagtctttctagctttgctcgaaaatacgggatacggaagtttctgtttcttgataaattgtatgaagatagtgaaaaggtgcaacaaggatacactgaacagctacataggtcgatgaagatcctctcatcttttgtcctcccttcttttattgttgagagtatttacaagatatggtggttttcctccgggggaacacaaattccttacctgtacaatgctgctttgagcaatatcttcgtatgcatactgttaataagctcctggctttaccggatatcaatttccttccttgtatgtgtcctattccggttaatatgctccctgcagatccttagactggaagagtttgctcaagttttcgagaaagaaactgatgtctcatcgatcatgatggaacatcttcgaatcagaagaaatcttcgtgtcattagtcatcggttcagagttttcattttgtcaactctcatactagttaccataagccagtttcttgcgctgcttcttactactgagcctagctccacagtgaacatctttacagcaggtgaacttgcgttgagctcaattactctggtaactggacttttcatgtgcttacgtagtgcagcaaagatcacacacaaagcacaagctgttacatcacttgctgccaaatggcatgcttgtgcaacaatcagcagcttagatgacatgactgaggaaactcccatggctcggtccgtggcacctcaggtggtataccctatcaattccagttgggacacagacgaggaaggagacggagacgatgtgttggacaacacaaatatggtacctattcatgccagtacaatatcctaccaaaagagacaagcactagtaacatactttgagcataacaaagctggaatcaccgtgtatggtttcatgttagatcggacatggcttcatacaattttcgcgattcagctgtctcttacactctggatactcaataaaacaattggtatttcgtaaatcccagtcaacgacaaggtttttactgtgtgttggtagttgtacagaaatctgtgctatcgatacgtagagaaactactatatacagtatatatgtatatcctaaatgtcaaaattttgctgattttcttccta

SEQ ID NO: 172 - DNA, 2250 bp, Solanum lycopersicum
attccgtaattttatgaaactcgaaaccctatgttactgagtcaactcctatatataccttcgtctccgaccaaactctttttctttcttcccaaaaattccgatctatttctctacctctccggcgaaaaaggataatcatggaagataaatccattccattcgaatcaagtcactccgtatcaaacaatgataacaatcacggatggcaaaaggtgacatatgtgaagaagcagaaaaaaaagcagcaaaaaatctcggattcaggcaaggtaatcgccaatggatctgctatttccggcgccgataatgtgtataagtcgcttgagaagcactccgatgaacgccgcaagagaattgcagctcagacggctgcgatgtacggtgttggcgatgctccggttagatcggcgatgaaacaccggtcggacgatgaagacgaggattactatgctgaaggtggtgctgagaatggtgcggttggggagaagaagaaggagaaggtaaaaaaaccgaagaagccaaaagttactgtggctgaagctgctgcgaagattgatgcagctgatctagatgcttttctcgctgatataactgtttcctatgaatctcagcaagaaatacaattgatgcgttttgctgattactttggacggtcatttgcggcagtggctgggtcacaatttccgtggttgaaattgttcagggagtccgcgatcagtaaaatcgcagatgttcctgtttcacatcttcctgaaccagtttataaaacatcggttgattggatcaaccaacgttctttcgaggctcttggatcgtttgtgctgtggggactagacagtattcttgtggacttaacagcccaattagcaggttctaagggctccaagaaaggtggccaacaaacatcgtcaaaatctcaggttgccatgtttttagttttggcaatggtactacggcgaaagcctgatgttttaatcaccgtactcccgacgattcgggaaagtccaaagtatcaagggcaagacaaacttatagttattgcatggatgatagtccaggcctgtcagggcgatctctgcgttggattgtacttgtgggcacatcataccttgcctttagttggaggaaaatcaggttccaatccgcagacaagggacttgattttgcaggtggtagaaaggatcctctctgcaccaaaagctcgaacaattttagtaaatggggctgttaggaagggagagcgtctgatgtcaccttcatcccttgacctgcttctacgggtgacttttcccgctccttctgtgcgagttaaggcaactgaaaggtttgaggcagtatatcccactcttaaggaggttgcgcttgctggttcccctggaagcaaagcaatgaagcaagtttctcaacagatacttctactagctgtaaaggccgttggaggaggcaatccagaactatctcgagaggcaacaaacatattcaattggtgtttgacccagagcgctgactgttacaagcagtgggacaagatttacctggataacatagaagcaagtgctgctgtgttgagaaagctcaacgaggagtggaaggagttatcgaggagacagtcctctactgaggccttgaaggagactctcaagagcttcagagagaagaatgagaaatcattaactggtggagcggatgctcatcagtcacacttcagagatgcagataagtactgtaaaatgttgttagcaaggctgtctcgtggacatggatgtgtgaaaggatttgttgttgttcttttggctatggcggtgggaggtgctattgtgtcacagaacttggaggattgggattggaacaagtttttggctttacttgatatcccacagacctcctaagtaatctggaccagatgagcaatgttcttttttaacagttgatggtctcagcagcagttgtttcagaaaacataaaaataactttttggagaaacaggtagcggaacttggagatatcgggatggatgcttatattttcatgaaagaatgagtcatgtttaatttatcagtcttgttttgatctgtctgttagtttaagtttaagtggtagtatgcatgttagctgttaccaagttttcaacatcttttttcagtttaagtaaattgattgtcattaccagaatacagatgtaatttcaacgggtaagaaagaatccaaaaaggatttaataattggtaggttgagtatttcaactta

SEQ ID NO: 173 - DNA, 2301 bp, Solanum lycopersicum
aattcgtgattctccaaccaccacatgctttgacaaagatcaatgattagtgatttttgacacatcaccatatcttcttcatcatacaaaaaaaacaaaacaaaaaaaaaatcatagtgtactatgaacattcactatattttccttaaaagttcagtacctttctgcaattctcagaggactaaaatcaacacttttgagaccccttttagtagaaatggatgtagtaacttttggcataataataggaataataatactatttttctgtgctgtttgtgtaatcaccatagaaggcacttgcaagaaccgctcttcttgattcctaataccctttatccaaacacgcccttatcatctcacccttccataaatttagggtttttagctgattttgttcttgcccaaattgacaaaatgtcgaaaaaaattgatgctttggtgaaacagatctgcttcttcttgattgtttctacttctttatggctagtgatttttgggtcttctgtagaagcgaaggctctagaagatcccaagcaggaatttcatcagtgtagccatggtcatggtcatcatggccatgaggggcatcaccatgatcatgatcatgggtcgagtggagttgagcagaggaagcttctagaggaattggctgaagaggaggatctgaaactgtatggatttgggtctcatgctagtatggatgaacatcatcatcatcatcatcatgatggacatggagtcaaggatcttactggtcttggtctatgggtcaatgcaatgggttgctcactattagtgagcttggcttcccttatctgcctgattcttttgcctttaatatttatacacgggaagccgtcaaaagcagttgtagattctttagcattatttggggcaggagccatgctgggggatgctttccttcaccaattgccacatgcttttggtggtgggcactcccactcccatgatgaccatcttcatgatcactctggtcattcacacgcccattcattggaggatctttctgttggattgtccattttggctggaattgtgctctttcttattgttgagaagcttgtgaggtatgttgaagagttttctggaggagtcaatgagcggagtcatggtcatcatcaccatcatcatatgcactacacaaagttgaaggatgataatgatgctgatgataatctccgggaactgtctcaggagaaagatggaagttcatcagaaaaggtagctggagggagtagagtggatggagtgtctactgactctcccaatggggagaaaccaaatggaggagctattctacggaagaggaatactggctccagtgctgctgaagacaatactgctttagatgctgcaaattgctctaccaattctacatcaactggagaggaacaggctaaatcacgttcaagccttgtctttggttatctcaacctcttttctgatggtgttcacaattttactgatgggatggctttgggaagtgcattcctccttcatggatcagttggtgggtggtcaagaactttgtttcttctggcacatgagctccctcaagagataggtgattttggaatcttggtaaggtctgggttcagcgtctccaaagctctcttctttaacttcttatctgcactagtggccctagccggaactgcactggcattgacattgggacaagattctggtcattcgtcattgattgagggattcactgctggcggcttcatctacatttcagttgccggagtgttggctgaaatgaacaatactggcaggacgacgttagtgaatacagtaatccaacttatctcactggtatcagggatggctgttgctctttgcatctctctcattgaatgacggtatacgctacttcttgtgttcgtagagaggagagacggttgtcgtctccccccacagggacgagaacagccttcaggcgttgaccgtttacgacacatccagccagacaacgcttgtattaagattagtgttagacatcttgaatatttatatagaaatctacaggcaggtggaaaaaatttactccttctgtgacatgtattattttggtccatctaatatgaggggaatttcataaatatgagtggaagcatagaatattttataatcatcatatatattactaaaagcatgaataaaaaagttagaaagttgaattacgatttttccctttttataaactaaattgttataaaatatttaaatatttgattgtataaattcaattaaatgtcaatgactacttattca

SEQ ID NO: 174 - DNA, 3214 bp, Solanum lycopersicum
attcgtaccgatttgcctgatccagaaaaaggtgaaattgttgtgtttattcagctgtcaacgatttgctcaacaacgaacagtcatggtgttcatcaatcttccgaatcacaaaaccctaaccctagaaattaatccttttgtaacttctcttcaaaccctaaccctagcaatccatcaaaagttccatattccaatcactcaacaacgactctactcatcctgccggcgtctcctcgatgtggaagcactgttatccgatctagggatttcccctaattccactctaactctacacgttcctcttttcggaggtatgcaagcacccggggcaccgaaagcccggcttgaatttcttaacacgagacctcctccgaattatgttgctgggttgggtcgtggtgctaccggtttcacgacccgttctgatattggtccggctcgtgctgctcctgacctccctgatcggtcagctgttgggggtgcaccggcgactggagttggacgtggacgtggaaagggtgctggagaggaagacgaagaggaggatgcggaggagaaagggtatgatgagaatcagaaatttgatgaatttgaaggaaatgatgtggggttgtttgcgtctgctgagtatgatgaagatgataaagaagctgatgcgatttgggaatctattgatcagaggatggattctaggaggaaagataggagagaagctaggttaaagcaagaaattgaaaagtatagagcttcgaatccgaagattactgaacagtttgctgatttgaagaggaaattgtatacattgtcaagtgatgagtgggatagtatacctgaaataggggattattcgttacgaaacaagaagaagaggtttgagagttttgtgcctgtacctgatactcttttggagaaggctaggcaggaaaaagagcacgtaactgcattggatccgaggagcaggatggttggtggcatggagacgccctcttcacagacgccagttgcagatttgactgctgtgggtgaagggagaggaactgtgttgtcagtgaggttggataggattttggattctgttactgggcaaaccgtcgtggatcctaagggatacttgactgatttgaagagtatgaaaattactagtgatgctgagatttccgatataaagaaggctagattgttgcttaagtcggttactcagaccaatccaaagcatcctcctggttggatagcagctgctagactggaggaggttgctgggaagatgcaggtagcaagacagttgataaagaaagggtgtgaagagtgtcctaagaatgaggatgtttggttggaggcatgccgtttggcgagcccccttgaggctaaggcagtgattgctcaaggtgttaaagcaaatcccaattcagtcaagttgtggatgcaggcttcaaagttggaggatgatacagcaaacaagagccgtgtgttgaggaaaggtctagagcatatccctgattcagtgaggttgtggaaagctgttgtggagctggccaatgaagaagatgctagacttttgctacagagggctgtggaatgctgtccattgcatgtggagctgtggcttgctcttgccaagttggagacttatgaaaatgctaagaaagtacttaacaaggctagagaaaagctgcctaaagagcctgccatctggatcactgcagctaggcttgaagaggctgatgggaatactgcttcagttgggaaaattattgaaagggcaataagggctttgcagagagaaggtttggagattgacagggaggcttggatgaaggaggctgaaggatgtgagagagctggttctcttgggacttgccaagctataataaacaacactgttggggttggtgttgaggaagaagataggaagaggacctgggttgctgatgctgaggagtgcaagaaaaggggttctattgaaacagcgaaatacatttatgcacatgctcttactgtatttagaactaagaaaagcatctggcttaaagctgcacagctcgagaaaagtcatggcacgagggaatcacttgatgcagtgcttcgaaaagcagttacctacattccaaaggctgaggttctatggttgatgggtgccaaagagaagtggcttgctggtgatgttcctgctgctcgagcaattctggaggaagcatttgctgcaattcctgattccgaggagatatggcttgctgctttcaagctcgagtttgagaactgtgagacagagagggcaaggaagcttcttgctaaggcacgtgaaaggggaggcttggagcgggtttggatgaagtcagtcattgtggagagagaacttggaaatgtggatgaggagaggagattactggatgaagcattgaggcgcttcccctcatttttcaaactttggttgatgctgggacagttggaagaaagacttggtaattctaacaaggcgaaggatgcatttgaatctggcattaagaattgccccaattgtatacccctttggctatcccttgcctctctagaggagaaaatgaatgggctaagcaaagctcgagcagttcttactatggccaggaagaggaatcctcaaaaccctgagttatggcttgcagctgtgcgggctgaagctaggcatggctacaaaagggaagctgatgttatgatggctaaagcattgcaggagtgccccaacagtggcattctttgggctgcttcaattgaaatggcgcctcgacctcaaagaaaaaccaagagctctgacgctttaaagaagtgtgatcatgatcctcatgttattgctgctgtagctaagctcttttggcaggagaggaaagtagataaagcaagaaattggttcaatagggcagtgacccttgcaccagatattggtgatttctgggcattgtatttcaaatttgaacagcagcatggagcagaagagcagaggagcgatgtgctgaagcgatgtgttgctgcagagccaaagcatggtgaaaaatggcaagctacatcaaaggccgtagagaactctcatgaaccaactgaaagcatattgaagaaggtggtagccacactaaagaaggaggagaatttggctgaaaataaccacaactaatctgctgtagtgcatgagtcaatgtacttgataatctagagagatttataggttaggagacagtagtta

SEQ ID NO: 175 - DNA, 917 bp, Solanum lycopersicum
aaaaatatatatataaaaaatcaaatctttgatggatgattctccaaaaaagtggtaaattttccattcccagaaaatctcaagaaccaaaaagcaaatggggcagaatactggtgcaagtggcaaagggaagaaagaagcagaaacggaaaaggaaacagtggtagaagaagaagaagaggaagttgaagaaggtggagaagaagctgaacaagatggaatgtctgttcattctccttgtaaacctgcatcttctgctcttcgtaaggaacaatcacaggtggaattggagataagattgttggaggctcttgaaatctatccccctgccaaattgagaggcatccatcgtcattttgtcctatacggcttaacagagcatctgcgtagaagcttcaataggcaatttgctcctgatgatgttttgaagctgctggatcgcttctacaacttggatatggtgaaaccagaggacgaggactctgaaatcctaaatcaagaggaagagttttgcctacctcacagttatttctcgagggacgaaccttgaactaagttggaatcgatatggatattgaacttctacatatggcagtttttgtatagtagtatctgggtggttcaatttttttttttttgatgccataagagattctgcatctattaatcttactgaaaagtttgtatgcatgctgatatttcagctctccttatatatacagtagacagttggatctttttacaatttttctcatagagatttgatatattgtgaagcatcaacatccactgtgtcaagagatgctgtctacaccatactccttgggtgccacccttccacagacgcactgcgtaaacatgagatattttgtgcatcgagctgtccttttgaatctggttgataaatcattatggaa

SEQ ID NO: 176 - DNA, 1347 bp, Triticum aestivum
gtggggttcgaatagatagacacgcggtgcgaactaccctctgtgatcacttccgaggcagtttatccagcgaagctagcaggcagcagcaatggcggccgagcccgagatctgcgtgctctccaatggcaggatcacggcgaacatcgccagctggggcgccaccatcacctccctcctcgtccccgacgcgcaaggggatctcgcggatgtcgttcttgggttcgacacactggagccgtacttgaaaggcatggcaccttattttggttgcatagttggccgagttgcaaataggatcaagaatgggaagtttgatctgaacggagtcgagtattcattgcctatcaacaatgggccgaacagccttcatggtggattgaaggggtttgacaaggttgtgtgggatgttgtagagcgtaaagatggcgagtacccatcaataacctttcaatatgagagcaaagatggcgaagaaggttaccctggcgatgtaaccgtccgagcaacgtattctcttccggaggccaccactctaagacttgatatggaagctataccagctaacaaagccactcctatcagcttggcacagcatacttactggaaccttgcaggccacaactctggcagcatcttggatcattcgatccagatctgggcaaaacacgtcactccagtcaatgaaaacacgattcctaccggagaaataatgcccgtccaggacacgccttttgatttcaccacggagcacaagattggagaccgcatcagcgatgttcctggagggtacgaccataactatgtgttggactcgggtgatgagaagaatggcttgaagcacgcagccaagctgaaggacccatcgagctcacgaactctggacctctggaccgatgcgcctggcatgcagttctatactgccaactatgtgaatggcatcacgggcaaaggtggagctgtttacggtaagcatgccggagtatgcttggaaacccaggggttccccaatgccatcaaccagcccaatttcccgtctgtggtggtgcagcctggtgcgaagtataagcacgccatgttgtttgagttctcggcatgattagatatgctgccggcagcttaaatggctgcaactgcaatagttatagagtggaataaaacgaccagaagaaaaaaagtcaaattgtagtaccaaacaaaaataaaaagggtgtagtgaccagaactgagcgacatgatctcattcggaaaatcatgttcaagggtgtcttatattttggttgtgtatactggactgagaagaatttgttcacatgcttgccaaaatattggagttcgtttgcctga

SEQ ID NO: 177 - DNA, 1724 bp, Brassica juncea
atttctttcacccaacaaaacaaaacaaaacaaaacataatcttcgtctcctcctagctctccgagggtctcttctctctcgctctttggttgctagggttttggtaaagaagggaggaaggaaaagatgttcgggcgaggaccctcgaagaagagtgacaacaccaaatcctacgagatcttaggtgttcccaagagcgcatcccctgaagatctcaagaaggcttacaagaaagcagccatcaagaaccatcccgacaagggtggagatcccgagaagttcaaagagctagctcaggcttatgaagtacttagtgacccggagaagcgagagatttatgatcagtatggagaggacgctctcaaggaaggaatgggtggtggcggtggtggaggacatgatccctttgatatcttctcttccttctttggcggcagcccctttggaggtggtggtagcagccgcggaaggaggcagaggcgtggtgaagatgttgttcacccccttaaggtctcccttgaggacctctaccttggtactaccaagaagctctccctttctaggaatgctctctgctcaaagtgtaacggaaagggttcaaaatcaggagcctccatgaaatgtggtgggtgtcagggtacaggtatgaaggtgacaatgaggcagcttggccctggaatgatccagcagatgcagcatgcctgtaacgaatgcaaaggcactggtgagaccatcaacgatcgggacaggtgtccacaatgcaaaggagataaggtcatccccgagaagaaggtgcttgaagtgaatgtcgagaaaggaatgcaacacagtcagaagatcacattcgaaggacaagctgatgaagcgcctgacactgtcactggggatatagtcttcgtcatccagcagaaagagcatccaaagctcaaaagaaagggagaagacctctttgtagagcacacactttctctgactgaagctctttgtggcttttcattcgtcctcacccacttggatggcagaaatcttctcatcaaatctaatcccggggaggtcgtgaaacctgattcatacaaggccattagcgatgagggaatgccgatataccagaggccattcatgaagggtaagctctacatccacttcactgtggagttcccggactcactgagccctgaccagaccaaagcactcgaagctgttctgcataagccttcaactactcagctgagcgacatggagatcgatgagtgcgaggaaactacgctacacgatgtcaacattgaagatgagatgagaaggaaagcacaagctcaaagggaggcttatgatgatgaagacgacgatgatgaccatcctggaggcgcgcaaagggtgcaatgtgcccagcagtaagtaaccttagagagagagagagaggctttggtcacatggttttggttcaaagatgctcctcttccttttcttattttcaagtgtattttggagtcttatggcttatggaattcggtttggtttagaccttgcccacttcggtggaacttgttttccgttctcacgtaagctaattccgtattacaattttgtattttcttattttgaatttgtagtaatttaatatattcaagaagtattttgtgtcttcatttctaaagttgttaactaacgggggcttgagtgatttattctatgttaagactaagtaaaagattggaatttcaaa

SEQ ID NO: 178 - DNA, 940 bp, Brassica juncea
gaggtagaagagatcgaagtgtggtttcttcatagccggtgaattaagcaagatcctcaagtaaccatgatgaatcggctgttcgggaaaccaaagcaggagacgaatgctctccagacattagacaagcttaacgagacacttgagatgctagagaagaaggagaaggtactcttgaagaaggctggtcaagaggttgagaaggccaaagaatacactcgtgctaagaacaaacgcgcggctatacaatgtttgaaaaggaagaggttatatgagcaacaagtcgaacagcttggcaatttccagctccgtattcatgatcaaatgattatgttggaaggcgcaaaagcaacaactgaaactgttgatgcgttgaggagtggagcttctgcaatgaaagcaatgcagaaagctactaatatcgatgatgtagacaagaccatggatgagatcaatgagcagacagagaacatgaaacagatccaagaagcattgtctactcctatcggggcagcagctgacttcgatgaggatgagctagaagcagagcttgaagaactagaaggtgcagagcttgaagagcagcttcttcagccgacaacagcattgccttcagttcctgcagggcgtcaacaagtacgtcctactccgaaacgtaccgcagaggaggaagaacttgctgcattgcaggctgagatggccctctaaggtttattcacgaaccggagcagccctgtatgcattgaacaggcgatgtatataaggatctcaatgtcaaaattataaatctgagcgaaacttaataataatcctcgtcgtgcaatgttattttatcaacatttgactgtttcttcttcacatatactttttatcttttgtatttgatttggtaatctgatgggttacttactacgtacgtacttgctcgtcctatctacaa

SEQ ID NO: 179 - DNA, 633 bp, Brassica juncea
aaagatgtcattagcttcgccgattcaatgcatcagaattataaatccatcatcttcttcttcatcttctttgacgacttggtcgtctttgagattctcaacgagtaagccatgtgtattcatcatcagatgttctcaggcggaaggacccttgagaaggccctctgctcctcctactctccgggagcctacacctccccaaaaacctgttactcctacgccgtcttcttcccctccaccaccgcagaaagctgtggctgttgacggtaagagcgtagtaacaaccgtggagtttcagaggcagaaagctaaagagcttcaggattactttaagcagaagaagcttgaagctgctggtcaaggccccttttttggtttccaacccaaaaacgagatctccaatggaaggtgggctatgtttggttttgcggtggggatgctgacagagtatgcaacaggatcagaccttgtcgaccaagttaaaatccttctctccaatttcggcattctagacttggaataataataataataaaaaaaaaaagagtgttgttggtgtatatgatcctttctctgattccttatgttcaatcttcttctccttgtttattcttcctcctgtatatgcatcta

SEQ ID NO: 180 - DNA, 1519 bp, Brassica juncea
accaacttaagttcctgtcctaaataccatttggtcttttttttcttttactcctctagatctgtactgtccgttgattcatcatggcttcacataattactagttctgttctgtctgtgtgataattttggtaaggaaagaaaaaacgagggctgtaatcaattagattgatttgaagatatggcaactttgaacccttttgatctgttgggtgacgacgcagaggatccgagccagatcgccgtctccatcgctgctgataagcccaagaaacctgcacctgtttccgctaagtcatctgctccgtcgaggcagcttcctcaacctgtgagagaggctaggagtgatgctccacgcggcggcggacgtggtggtggtggagaccgaggatctagccgtggtcgtggtggttacaaccgtgattttagaggcggtgatggtaacagtggaggatacaataagccctctgaggaaggaggcatttcaaagcctttctatgagaaacgtagtgtatatggcggtgctcctcgtggtggtggtcgacgtggtgaagctggtgaaggtgaacgtcctcgaaggacattcgagcgtcgtagtggaactggccgagggggtgacttcaaaagggaaggagctggtcgtggaaattggggaacaccaggagaagaagttcttgttgtggagactgaagaagttgctggtgttgagactgagaagcctgctggtgatgaggtcgctgctgatgctaagaaggagaacgctgctgaagtcgaggagcagaaagagcctgaagataaggagatgactctggatgagtatgagaaaatactcgaggaaaagaaaaagtctcttcagtctcagaccacctctgagaggaaagttgatacgaaagtgtttgaatcaatgcaacaactctcaaacaagaagaagtctaacgatgaaatcttcatcaagctgggttctgataaggacaaacgcaaagatgacaaagaagagaaggctaagaaggctgtgagcattaatgagtttctgaaaccagctgagggtgagaactactaccgaggaggaggccgtggtggtggtcgtggaaggggacgtggtggtcgtgaccgtggagttgtttctggtggtggatttgatggttaccgtagtgaagctgcgcctgccatcggagatactgctcagttcccatctcttgggggaaagtaagatccatccatgaacacgtctgaaacacacacacactcatgcgggagtttcatgcgagagtcgtactgtttgcatgtatgttgtcagttgtaaatttttagttgtctgtcagtttttagattttctgcaaacttatgcctgaccgttttttttttcgttttttaattacttttgaaacattactcgcttttagtttaccacttctttgtcgttgttttgttgtttatgaaaacttgtcagacaggcaagtctaatgttatcggttttgtgtcttctttgaattcactctctcatctctttcctcatgtt

SEQ ID NO: 181 - DNA, 1515 bp, Brassica juncea
ctctctgtcttcatcaaccaaaaagctcctccttctccttctccactcaccctctctcatctctacacagaggacaatcaatcatacacagacgaaccccccatagagagagagagatcgacacaagtctcagtttaagcacgttctggagatttgaccggaactaaaagctttgaggaagagaagaatcatgcggaggtggatctgttgtggtgggcatagatcaggagattctgatatatcaaatgatgagaaacatctgaaaactcaatggcagcaacctgatgcaaataataagcagccaagaccacaagctgttgcaaaaactgaggcgcccaaggaagcgcttcccattgaagttcctctcttgtctgtggaagaggttgaagaaaagactgacaattttggatcaaagtcactcattggtgaaggatcttatggaagggtgtattacgcaactcttagtgatggtaaagcagttgcgttgaagaaactcgatgttgcccctgaagctgaaacaaacaccgagttcttgagtcaggtttccatggtttcaagattgaagcatgagaatttcattcagctggcgggttattgcgtcgatgagaacctccgtgttcttgcttatgagtttgcaacgatgggatcactccacgacgttctacatggtaggaagggagtacaaggtgcacagccaggtccaacacttgactggataacgagggtgaagatagccgttgaggcagctaggggtttagaataccttcatgagaaggttcagcctcctgtaatacacagagacgtgagatcaagcaatgtgcttctgtttgaagactatcaagcaaaagtggctgatttcaatctctccaatcaagctcctgacaatgcggctcgtcttcactctacaagagtcttgggcacctttggctatcacgctccagaatatgctatgacgggacagttgacacagaagagtgatgtgtatagctttggggttgtacttctagagcttttgacagggaggaaacctgtggatcacacaatgccacgtggccaacaaagtcttgtaacctgggctacaccgagactcagtgaagataaagtgaagcagtgtgttgatccaaagctaaaaggagaatatcctcctaaatcagtagctaagctagcagcggtggcagcactgtgtgtgcaatatgaatcagagtttagaccgaatatgagtatagttgtgaaagctttgcagccacttctcaaacctccagcaccagcccctgtacctgagtcctgagttagttcgtaaaagagttggattctttgttcatacaaagtttagtttgtattttggtgtgaaagggagggatacttttgatattttgcatttgttattgtctggattggaacaacaaagatgtattgcgtttgctgttcttttgacatttcctttgaatatttggtctctgactatattgacaactcctttcaaggttaatctgattctctaccattttactactt

SEQ ID NO: 182 - DNA, 606 bp, Gossypium hirsutum
acctcataccctcttccttcattacatcacatttccctttcacttccttccttgctttgtagcaattaagccaatggcaaaacttgtggctgctttcttcttggctctcattgccatctccatgcttcaagttatggtcttggcatcgcatggacatggaggtcatcattatgatcaaaaacattacggccctggaagcctcaagagttaccaatgtccatcacagtgctcgaggagatgcagaaaaacccaataccataaaccatgcatgttcttctgtcagaaatgttgcaacaaatgcctctgtgtgccccctggttattatgggaacaaagctgtttgcccttgctacaacaattggaagaccaaagaaggaggacccaagtgcccttaaaaattcttatttcataatttatgcctaatgcttattgctaaaaaacatatgtttgttgttctaattatatagttattattaccgtcagtttttttttggaaatgtgatgggttttgtctcaatttgtcactccattgagggaccataccctctaagtgagagtggctaaacaaaattttattaatgaaggtgttatttacttgattgtctac

SEQ ID NO: 183 - DNA, 836 bp, Zea mays
ggggaatcgaccgtggcgccctgcgcaccggctggggataatccgcgcggcatgcaatttgaggccattgcacccttggctcctactcactctctctccccatccgcgccagtccaaccaagtcagcacccgcgcgcggcaaggagttcacgcccatggcgagcaccaacatggcgtcggccacctcgcggttcatgctggccgcgggcgtgcccaccgccagtagcggcagcggccgcgtcagcttcgcctcggcgcccaaccggcttggcaggaggcttgtggtccgggccgatgaggagtccccggcagagccggcgcccacggcggaaggggagggcgccgtggccaccaagcccaaggccgagaagccgccgccgatcgggcccaagagaggcgccaaggtgaagatcctgaggcgggagtcctactggtacaacgggatcggcaacgtcgtcaccgtcgatcaggatcctaacacccgttacccggtggtggtgcggttcaacaaggtgaactacgccggcgtgtctaccaacaactacgccttggacgagatcctcgaggtgaaatgagtgaggccagtctgctcaaggaccccatgctcctgtgtgatttgtagttgtgaagtgaggctgctgcctagctgctacgttagctgctagcgtcacaacatcaatcttgtaatagcttaatctccacaatcatcatgtaatttattgcatgcttcattcaccgtggactcaataatctctcttgctctaaaatcgatgtattcgtttttcttgtgattttgtacatgcacataaatttctctctggaaacattgtttgtgc

SEQ ID NO: 184 - DNA, 1381 bp, Medicago truncatula
gataaatgacactataaaatgtaacaaaagccaaagtttagttagtgatcacatattttcttccatagttaaaaatttgagagagaaaggaaaacttgattaatcaagctaattaactatcactccaatggccaccattgttgttcatagccaaacatctccagttcaagatgctgaggctcttcgacttgctttcaaaggatggggggctgataacaaggccattattgcaattttgggtcatagaaatgttcatcagaggcaacagattagaaaagcttatgaggagcttttcgaagaggatctcatcaaacgtcttgagtcagaaatctccggtgactttgagagggccgtgtaccggtggatgttggaccctgcagaccgtgacgctgttttgatcaatgtagcaatcaggaatggcaataaagactatcatgtggttgctgaaattgcttctgtgctatcaactgaagagctcttggcagtgaggcgtgcctatcataaccgctacaagcgttccatcgaagaagacgtgtctgctcacactaccggtcatcttcgccagcttttggttggattggtgagctcatttaggtatgagggagatgagatcaatgcaaaattggcacaaactgaggctaatattattcatgaaagtgtcaaggaaaagaaaggcaacaatgaagaagtcattaggattcttaccacaaggagcaagactcaacttgtggcaactttcaaccgttatagggatgaacatggcatctccattagtaagaaattgcttgatcaaacatctgatgacttccagaagacattgcacacagctattcgttgcatcaatgaccacaaaaagtactatgagaaggttttgcgcaatgcgatcaagaaatttggaaccgatgaagatggactgagccgcgtgattgtcacaagggctgaaaaggatttgagggacatcaaagagctgtactacaagagaaacagtgttcatcttgaagatgaagtttccaaggaaacctcaggggactacaagaagttcatcctcactcttttggggaaacatgattaaagtaattgagttaagggcatatctataatgagtttgggttatgatggcttatgattatgtgtttgcattaagttattttcttaataaagtatgttttgttaagtattgtatcattatgttggttgctttggacaacttgaacttttatgctgtattgtttcctttgggatatgctcttatgttgtttatttaggctaatgggaagttattaatatcaaaattatattggggtatgcttgtatgatatttttacttcactatgttcactgattatgtgtttaatttagtattcaaatctttagtacatgc

SEQ ID NO: 185 - DNA, 1187 bp, Medicago truncatula
taggaagttaaacttcaactatttaagcatcatagttaggaaaataaatcaattatggctacccttattgctcccatcaaccattctcctgttgctgatgcagaagctcttcatggagctttcaaaggatgggggactgatgagaagagtgttatcacaatattaggtcatagaaatgtttatcagagacaacaaatcagaaaatcttatcaggaaatttaccaagaggatatcctcaaacgccttgaatctgaactctctggtgactttgagagagctgtgtaccgttggatgctggaacctgcggatcgcgatgctgttttggccaatgtagccatcaaggatggaagcaaaagttaccatgtgattattgaaattgtttctgttctttcacctgaagaagtgttggcaatgagacgtgcttatcataaccgttacaagcattctttagaagaagatttagctgctcataccaccggtcatcttcgccagctgttggttggattggtgacctcgtttagatatggcggtgctgagataaatccgaaattggcaaaaactgaagctgacattcttcatgaatcaatcaaagagaaaaaaggaaatcatgaagaagccattagaatccttactacaaggagcaagactcagcttttggcaactttcaaccgctacagagatgaccatggcatttccataactaagaaactgttggataatgcatctgatgattttcacaaggcattgcacactacgattcgatgcatcaatgaccataagaagtactatgaaaagattctacgcggtgcgttgaaaagggttggaaccgatgaggatggactgactcgtgtggtcgtgacaagagccgagaaagatctgaaggacatcaaagagctgtattataagagaaacagtgttcaccttgaggatgcagtggcaaaggaaatttcaggagactacaagaagttcatccttaccttgttggggaagcaagattgaagtaattgatcttgttaaggcatatatatttgtaataatgggatttggatatgttggtttctttcttgtggtttggtttggttaatttgtctatttatatcatgttttcatgagtctcatggctgtgtgagagatattttgtacttctattttaataaattactagttgaatgaatggtggaattaca

SEQ ID NO: 186 - DNA, 1160 bp, Medicago truncatula
gccaccgccttcaaaacccctcttttcttttcttttcttttcttcctccgctagggttagggttttactcaatttcaagattcgatctcgatccatggatatgcgcaagagaggaagacccgaacatggattcaacaacaatgggggattcaagaaatccagacatgaaatggagtccttatcaactggtgtaggaagcaaatcgaagccatgtaccaagtttttcagcacttctggctgcccatttggtgagagctgccacttcttgcaccatgttcctggcggttataatgctgtttcccagatgatgaatctaacacctgcagcacctcctgcacccagaaatgttccagccccacgaaatgcacatgcacccaatgggtctgcaccatctgctgttaaaagccgcatatgcagcaagtttaatactgctgaaggctgcaaatttggtgacaaatgccatttcgcacacggagaatgggaacttggtaagcctgttgctccatcatttgatgatcaccgtcacaatgaccaccgtcacatgggaccccccaatgctggccgttttggcggtcatcggatggagcctcctcctgttccagctagctttggtgccaatgccactgccaagatcagtgttgaagcctccctggctggagctatcattggtaagggtggtgtgaactcaaaacagatctgtcgtcaaactggtgccaaacttgcaattcgagagcatgaagacccaaatctgaaaaacattgaacttgtgggaacatttgaacaaattaaggatgcaagcaacatggtgaaggatttactgttgaccctgcaaatgtctgcaccacctaaatcaaaccaaggcccccctggccatcatggcgcccctggccatcatggaaacaacttgaaaacaaagctgtgtgagaattttgcaaaaggatcttgcacttttggagatagatgtcattttgcacatggagctgttgaattgcgtaaatgaaaattttacctcaatgaggcggtgcactgtcgtgtcagacaggactatatttttatttttaatattgttgtgcattgctccttagggtactgacaggacttatgatgttaagagttttgttgtttgattcctttaaatagcaacattagcttttcaattt

SEQ ID NO: 187 - DNA, 1152 bp, Sorghum bicolor
tcggcaacgcagctaacctctcctcgcatcgcaaacagatcgactccacaaagccaggcaggggcagacccgaccccgggtcacccgaatcgccgccgccgccgtcgtcgtcgttgagaagagacttgcaaagtggaggagtaggccatgtccaacgtgcccacctccctccgcgactcctccctcaccgtcttccgcctcgccatctccagctccgacccctggcccttctcttcctgcctctaaccaccaccagcccccctcggccggccagcttcagtcctccttcctgatcaagcaaccaggcaagcaagctaaggaacgccgagcgatcgaccatcatgcccggcaagcaccaccagcagatggcggcagcggcggcgggggcggtggcgcccaaggggtgcgtgacggtgcgcgtggggctggagggggaggagcagcgccggttcgcggtgccgctgggccacctcaagcacccgctcttcggcgcgctgctggaggaggccgagcgcgagtacggcttccgccaccagggcgccatcgccatcccctgccgcgtcgaccgcttcgtccacgtcgagcgcctcatcggccaggacctccacggcacctccccctgcgcccaccacctcgtcgacctcgacggcggcgccctggcggcaacagccggcgccggcgccgcgcaccaccaccatcaccaccacgtccacctgcacctcccgcgcttcgtcggctgcttccgcgcctgacgacgacgggcccggccgtcgaggtggttgattagcttttaatttggtttgctcatcctccctccctccctccctctctcgcgttgttttgctttgtgagggttctcatcgatagtagaacacgattggtttgaagctttgtggcgagagacatggatgcatggatgggaggacgcgcgatgcatctagctagctagttgttgacgatgatgacgaaaaatttgtgatgatggtcgatctcaagtgtaaagatctatagagaggatgatgttcatctttagctttagcttttctttttcctttgcttatacgtcaatatatactttgctaatacaactatatatatactctgcgaaagtactattgtagttctgttcctgtaaattacctttttttttgc

SEQ ID NO: 188 - DNA, 1486 bp, Sorghum bicolor
ctcggcgttctcgcccgtatttccccaaactcccaatccccaccccacccaccccaaccccaccccaaaacccttgcgtcgtcgcactcacactagcaaccaaccccaggaccatactctccggcggcggccggcgcgcgcgcgagggagatggaccgccctgtcggcgcatcgtaccagcgcttcccccgcgttcggatccgcgacctcaaggacgactacgccaagttcgagctccgcgacaccgacgccagcatggccaacgccctccgccgcgtcatgatcgccgaggtcccaaccgtcgccatcgatctcgtcgagatcgaggttaactcctccgtcctcaacgacgagttcatcgcccaccgcctggggctcatcccgctcacctccgccgccgccatgcaaatgcgcttctctcgggactgcgacgcttgcgacggcgacggctcctgcgagtactgctccgtcgagtttcacctcgccgcgcgcgccaccgactccgaccagacgctcgaggtcacatccaacgacctgaggtccatggatcctaaggtctgcccagtcgaccaagcacgcgcctaccagcaggcgctcggtggcaccgacccctttggagccaatacctcaaacgaaaataggggcatacttattgtaaagctgcgtcgggggcaagaactaaggcttcgtgccattgctaggaaaggaattggcaaggaccatgccaaatggtcaccagctgctaccgtgactttcatgtatgagcctgacatacgtatcaatgaagaactaatggaaacattgacagtggaagagagaagaaggttgattgaaagcagccctacaaaagtatttaagcttgattctgctaatcaggtggtggtggacaatgctgaggcatacacctatgatgatgaggtgatcaagcacgctgaggccttgggaaagccaggcttagttgaaatcaacgcgaaggaggacagcttcatcttcactgtagaaacaactggcgccatcacggcctacgagctgatcatgaacgcaatcacggtcctgaggcagaagctggatgctgtccgcctccaggacgatgatggtgaccttggcgagctcggtgcccaccttggcgggccttaggatctttgcaacaagaattgcccttggtgtcttcctccaccgcctatgtagtaggcctatctaactgccatgctagtcgaacattctgataaccctacggtgtctaagccccagattatggatttccaagtatccagtactgaattccagtctccgcgtccaccttgctttgtatcatcgatttagttatgctcgttatcgaacctgttgtttaattataggaggtggtactgtttggccgtgatgttttctttgcgtctgattgatgtcccactgttttttgtgacgtgaatgcagagttatttgcaggttccccaactctgtttgctaggatgataagtcatggctg

SEQ ID NO: 189 - DNA, 2014 bp, Sorghum bicolor
aaactgctacgcccacacgcctccccagtcaacacacctcagctcgcgagctctcctcatctacacacagtccccgacgcccgcccgcccgcaccgctgcgactgcgacgccccgaccaccccccaccttccctgcctgccttcttcctcctcccgtccgatcggtttcactttcaccattcaccgtacgcgcgctccacccgccgcaatcgtactggcgcgttggacagggagctaggcggccggggttgattgcaattgggggaggcgggggtgggtgatgtacggcgcgccggtgcccaaggacctgaacctgccagcagcagccctgccgcagccgaccaccagggccggtgcgagaacgccaccgcaccagcagcagcagatgagctccccgggactgctgcggtacaggtcggcgccgagcacgctgctcggcgaggtcatgtgcggggatcaggacttccccgcggctgcggctgcggctggcggcgcaggggcagggcacggaccaccaccggaccacgccgccgccgcggacaacgtcctcgcgcgctttctcgccgggcaccaccactgctccgaggcccgggactgcaagcctccccgccccgccgcgtccgctcatcacttcatggacgaagccgccgccgccgccgcgtccatggccgcctcacagcagcagcagctcatgtaccagtcgtcgcagcagcagatggccgccatggaggggttgtaccgcaacgtcagctccggcggcacggagcacggtgcggccgttggcggcgccggtaacaacagcctgatccgccagagcagctcccccgccggcttcctcagccacctgaacatggacaacgggtacgggagcatgctccgggcgggcatggccggcggcgggttcaggacgaacggcgccgtcagcgacgcgcggctcaaggggcagctgagcttctcgtcccggcaggggtcggtgatgtcgcagatctcggaggtgggcagcgaggagctcgacggcggcagcagccccgagacggcggccggcagcaacggcagcggcgcgccgcgcggctacagcggcatcccagggtacacgatgggcgtctcgcccggcgcctggacggacgagccgtcgccgtcgccgacgtccggcgcgaagcgcccccgcgactttgctgggcccgtgccgcagaacgtgcatcagcagccgctggcgccgcagctcagtctgcccagcggcaacaacggcggcggcaagccggcggcggcctcggcggagatggcggcgatcgagaagttcctgcagttccaggacgccgtcccctgcaaaatccgcgccaagcgcgggtgcgccacccacccgcgcagcatcgccgagcgggtgaggaggacgaagatcagcgagcggatacggaagctgcaggaactcgtgcccaacatggaaaagcaaaccaacactgccgacatgctggatctggctgtggactacatcaaggatcttcagaagcaggtcaaggtgctgaacgacggccgcgccaactgcacctgctccgccggcaagctgctgcaggaccagttcaccagttagccgccgccttttctcggtgcgatgcgatgcgatgcaatgcgtggccatggccgcaaggcctgactgacgcctccgcgccggcagctcgctttctcctcctcgttgaagttgaaatagtaccagtgtactacttggttattacatatagttttacatgaggaggtaagcatcgtaaacaaggatggatattatatggaattgaaatgagagtagtctgtacatgcaagttcattagcaggcagagcaggacccgcaatgttatagtgatagctgcaagctcaattagagttggttcttggtacaacacaaggcgtggtgacagtgtgtctttgtcttgccccgtcgttacaccgcgtacgtactaccagcacatgcatgcacccaatccaatccgatgcattgcgactattgtgtctgtctggctgc

SEQ ID NO: 190 - DNA, 850 bp, Sorghum bicolor
acgggtccacgggccacctccgtcgttccccacccgtctccctcgcgttcctctcgtccgtacgccgccgctgccgcctggctcgcaccgccgccttacgccaggtgccgaggccctcgccgatctcttagccggcaaagagtggccactagatccgctcctgatggacaacgtcgagtctgcccctgactcgccggcgcaggcgccgccgtcatccgcctcttctctccccaaggaacaatcgcaggtggagttggagctgaggctgcttcaggctctcgagttctaccctccatcaaaactcaaaggcattcatcggcactttgttctctatggcctcatggaatttttgcgaaaaagccttgatcggcaattctctcctgatgaagttttacaactcttggaccgcttctttaacctagaaatgctgaaaccagaggacgatgaaaaggacaacttcagtcagggggaagaattttccttgccagagagttttctcaacaaggaagaataatagcaagtagtagcttggtaatttcataggaggtactttgggcgtcgtctggaagagagatcagaacgctggtttcccactttttctagtagcattgtcgtccagaacatcggttgcgaggagacactgaacactgaagtaaaaaaacacatttcctaagctgtggttgtgtttactggctgtacatcttttgttcacttctagtgtaatcgatgggcctgttcagttcctcatttgaggcaaaaaaaaaaaaagtttgggttttggtcccaccattttgcaaaatggaactaaacagcatccattttggtaaaatggttgctttttttgcattct

SEQ ID NO: 191 - DNA, 480 bp, Glycine max
gtctctcccacgcatacgccacgcacaacacaacacaattctcagcttcttcagcgttcttttttttttctctctctctctcttccttacgcacccaagagagagaaggagaaagagaatcgatcgacgctgctagagaagtagaagaagatggcgggtggtgctcccaaacaattgttcggattcggagttgtggcgttgcttgccactctcattcttcctctctttatgcccgccgctgttcaggctcaatccgcagcccctgcacctgcccctactagcgacgggtcctcccttgatcaagggatagcttatgtgttgatgttgctggctctggtactcacatacatcatccactcggcctaaatttcctccaccttctgaacttatagagcagaaaagggttatgggtgtttgaagggggtgttgtgtttgttatgattaacaagtttcgtacattgtgtagcaagcagtgggaaa

SEQ ID NO: 192 - DNA, 436 bp, Glycine max
agtctggtctcgtgcaagtgtaacccaaaaccctagcggcgcctgctttcttcgttcgtcttttgcatcagccatcaggatggagtctcaggtgaagcatgctcttgttgtcaaagttatgggtcgtactggatccagaggacaggtgactcaggttagagtgaagtttttggatgatcagaaccgtcatatcatgaggaatgttaaaggaccagtgagagaaggagacattctcaccctactcgagtctgaaagggaagcaagaaggttgcgctagagggtatttttttcttgatctttatggtagttagttggtgctaaaggttatagcaccctgtcttgttgtcttggatctattttcattcaaattatgggttgaattttggatgtttggagtttaatatatgattttgaattatggcttaaattttggatt

SEQ ID NO: 193 - DNA, 707 bp, Glycine max
atcgtataaaacctcaaatctaaaccctaaaattcccaccgccgttctcatctctcttcccagttctcacctcaccgctgcatcttcacgtcgtctctaacgagggaaaatgagtcgaggaggtgcagcagcagcgaagggaaagaagaagggtgctacattcaccattgactgtgcaaagccagtagaagacaagatcatggacattgcttctctcgagaagtttcttcaagagaggatcaaggttggtggcaaagctggtgctcttggtgactctgttaccgttacacgtgagaagactaagattattctcacctctgactgtaacttttccaaacggtatttgaagtacttgacgaagaagtacttgaagaaacacaatgtgcgagactggctcagagtgattgcttcaaacaaggatagaagtgtttacgaactgaggtacttcaacattgctgagaatgagggagaggaagaagattagttgtctgatagccttatttgcttaagtgttttgtttacccttttcctatacctagcttcctttttggcaaatattgcttgagatacgatgctttgttttgatcggttgcaatttaacggttttgatcatttaagaattgcggtactattggtgttgaattgggaacagagtttacaaattattctctgttgtttcagtttttaaattgcattatgtttctttc

SEQ ID NO: 194 - DNA, 1417 bp, Glycine max
ttcttctccctcaattctctctcaccaaaaccctttgcacccaataccctcaaactcaacttcaattgctaatttttataaagctagccggagatgatggttcaaaaggaagatttgggtttgagtttaagtctcaatttccctcatcacagtaccccaaatcctcaacatctgagtctcatgtcatcctctactcattcctcttccccttctggtttcaaccctcaaaaaccctcttggaacgaggctttcgcttcttcggatccagatcgaaactccgacacatgcagaggcgaaacacggtcgttcctgcggggaatcgacgtgaaccggttaccttccgccgtggacgccgaggaggaagcgggagtttcgtctccaaacagcaccgtctcgtgcgtgagcggaaaacgaagcgagagagaacccaacggcgaagaacacgacatggacagagcctgttcccgcggaatcagcgacgaagaagacgctgaaacctcaaggaaaaaacttagactctccaaagaccaatccgctatcctcgaagaaagcttcaaagaacacaacaccctcaaccccaagcaaaaattggcactggcaaaacagctagggcttcgacctagacaagtggaggtgtggttccagaacagaagggcaaggactaagctgaagcaaactgaggtggactgcgaagtattgaaaaggtgctgtgagaatctgacggaggaaaatagaaggttacagaaggaggttcaggagcttagagcactgaaactttccccccagttttacatgcaaatgagcccacccacgacgctcactatgtgcccctcttgcgagcgtgtggctgtttcgtcctccgccgttggttctgccacgcgtcatcatcccatggcccatgcccatgcccatgctcggcccatgcccaatggcccgtgggcttccgcagctcccattccacaccggccgtttgatgctttccaccaatgatcttgagggtgttttggtcattgtgaattattattatttacaattatgggcctacttgtaccaccgtgaatgtgtgtaccccaaaagagagaaaatattgggagaaacagtgagggagcggttgaaacagcatgctgtggaattgtgcgtgttccaaagtgcggtgcggtctaaggatatggtcattagaagaagggatttggtgggtctccaatgttttgtaccagtttgacccatcaacttttgttttgttgggtatgacctatattagttaggagtttttcagtttttagtattacttaaattttctcctcaacagagactttgtgtaaagtgcaattttctagttaaatttcacttaattgggtttgggataattatttattagttagttttttgcgaaaatattatcacacccattgaaaca

SEQ ID NO: 195 - DNA, 465 bp, Glycine max
gctcgcaaataaatcaatctcaagagacagatcatataattttttttagcaaaatccatggcagatcttcaagaaaaactggatgctctgaagggtcttgttggtgtgctaaataacatggatgagggtgaaactcacaacaacaatgcaacctcctcacccaataattcccatagtcctgctcctatgcctggaaggaatcgctctgttggaaaatataacaacagtggcactcagaagattaaaggtctgagtaaccaaaccggcttcaccgaaggcaacgctaacggagccatcaactttggcaatttacatgcctaaataaatcaatgtaccaagatcttgaaatccataaataataatgtgacgtacaaattaaaataagagcttcacagtttgagtgtggatccaatattttcagctttttattatatataaatatatgacttcttagattaacgtgca

SEQ ID NO: 196 - DNA, 1272 bp, Glycine max
atagtagttgacattgtttttgccccttaatttccagcaaaatcgttctctgtcttttgaagcagctgttgcccattgtgaagtatttgttctccgtcatctcgcgtcgttagttcattgaactcactgcattgagtggatttggtccaagttgagtttagaaatggatggccatcatcagaagcaaaaaaacaagtacagtataattgttcctacatataatgagcgtctcaacattggtctcattgtttacctcatcttcaagcaccttggggatgctgattttgaaattattattgtggatgatggcagtcctgatggtactcaggatgttgtaaaacagctgcagcaagtttatggagaagatcggattctgttaagagcacgacctaggaagctgggtttaggaactgcttatattcatggcatgaagcatgcatctggaaattttgttgtcatcatggatgctgatctatcacaccatccaaaatatttgccaagcttcattagaaagcagtcggagactggtgctgatatagttacagggactcgttatgttaaaggtggtggtgtgcatggatggaatcttatgcgtaaactaactagcaggggggcaaatgttcttgcacaaacacttttatggcctggtgtctcagatttgacaggatcttttagactttataggaaatcagtgcttgaagatatcattagttgctgtgttagtaaaggatatgtctttcaaatggaaatgatagtacgagcatccagaaaagggtaccatatcgaagaggttccaatcacatttgttgatagagtatttggaagttcaaagcttggtggatcagagattgttgaatacctaaaaggcctagcatatcttttggtaacaacataaaagataaatcataacaactgatatatgtcttacattttggggaaaaaaaactagatataaatcttgttgatcaactacctgtttattgggggtacatcagcttggctgatagaatctccataacttgctttttcaatttagcaggaagcatctgtatgtttctgtgtctataattgtgtgaaacttgataattaattgttttagattttatgaacttgtgacttaggctgaggtcttctctgtttcgccccttctaggcgccaagacgccaactgtaaaattctgctccaactattgatttaagtctcaaagtctttgtagatgaccatactaaagcttgacttgtaaaattctacaggagatttcaactacttcag

SEQ ID NO: 197 - DNA, 766 bp, Glycine max
cacatattgtgcggcaagtgtctcatcacgtctcgcgatctcttcaaaggcgaaggggaaggcttcaggggtttgaaaaaggttgatattgaagccatggttcttgactccattctgacttctcctcgtctcaagtctccatctttcaggaggcagtttacaaaggatgaactgggtagttggtccacactttttcagaggcatcgcttcctcttatctgctcttgttctgctaactctcctctgcactgtttatctttactttgctgtcactttaggggccagtggcacctgttccgggttgactggagcccagaaagcttcatgccatatggagcttgttaaggattctgtggccaagggtaaactgaagattctttgatatttcaaaatattattacaagaaaatttttttctttattttgtgcctgagtataggtgacatgaaatccaaatatagtctctggctacagtatcagtgtgactgtgatttgtatacatactatttatcttggtatttgtgggccaaaatgtagaatacatgtagaaagcaatttgttagatacatcatgttaattttagtgattgcttcattgagataaatttttgggcatcttagttgctaaatgaagtttgagtctctgcttatgtgtaaattatgggcggctccaagccttatatttgttatattcatctgatggtctaatacgacctggggaccttttctattcttttctgaatttatattgtattgtgtattgctgatt

SEQ ID NO: 198 - DNA, 1576 bp, Glycine max
atttgtcactctgacccaggtcataattaactctgcaccatccattcactatattttgctgtgtctatatatatttatagttccatcaatcagtttcccctgcactgcaaaaaaaagtgaaaggctgttacacactgccaccaaagaccaacccttttttcctccattttgccttgccccaaatcagagttttttttccccaaacacacactcacaattggtggttgagtgcttcttctcaaaatgggtgagaaagatgatgagtttgggttgagtttgagtttgagtttggggggagtgaatcaacaacaacaacccccttctttgaatcatatgcaccagcctcaacaacaacaacctgttcccatgaatcacaataagactctctttggtgatttgtttcagttaccagatcggagctccgatatggtacgaggaatcgacgttaattcggcggcggagtacgatggcgtttcctcgccgaacagcgccgtctcgagcgtgagcggcggcggcaagcagagcgagagggacgacgataatgccgccgccgtggctggtgagaggacctcgtgctcgcgagggagcgacgacgatgacggtggtggcagcgacgccgcgaggaagaagctgaggctgacgaaagaacagtccatggtgttggaagaaacgttcaaggagcacaacaccctgaatccgaaacggaagcaagcgttggcagaggagttgaatctgaagcccagacaagtagaggtgtggtttcagaacagaagagcaaggactaagctgaagcaaactgaagtggattgtgaatacttaaagaaatgctgtgagaatttaactgaagagaatagaaggttgcacaaggaggttcaagagcttagggcactgaaattatccccacaaatgtacatgcatatgaaccctcccaccactcttacaatgtgcccttcttgtgagcgtactcactcctctgcatcctcctcccctgctaccatccactcaacagtggcggcagccacctctagcaattgcaaactgcttggtgcaaacatccggcggccggtgcccgtcaacacttggccatttgaaggcccaattccccggccataattggttgagggcaatgtgatatttataatgatgtctagacatttttagttactagacatgtatgcatgaaaagaaaaaaacaaattacaacggaacactaatttgtggtttttgtttggaatcaaggatatgagtttggatttggttaactcttcaatgaagggttgttctattttgtgtatgctataagctctagctagtcaacttcaagatttgtgtagggtagatatgttaccggtggggtaaggtttcaaatgccgaatagtacaagcatttattggtttagactttaaaatgaagagaaagaggatccgaatctgtgatgttctcgtcaaattgggataccacttcctagggaaaaaaggttgggtggtggatagagggtttaacatgaaggaatgattgtgatttctcaattggagatttttgtctaactttgcgtatatgtcctaatactacaaat

SEQ ID NO: 199 - DNA, 1614 bp, Glycine max
aagcttgtcagcatcgcagttacagagaaaaagagagagagagagagagagaaagtgtaatggcaatggcaacaatgggagagagtccacgaagcccagaagcgaagttggggatgcgagtggaggatctttgggacgttcaggagccacagttgagtcccactgagaagctcaacgcttgttttgaaagcatccctgtctctgcttttcctttggatccttcaaacacagaaattgagattaaatcagacgcgaccctagcagatgctgttaagatattggcgcgacacaacgtattcagcgcacctgtggtggatgttgaggcgcctgaagatgctagttggatggatagatacatcggaattgttgagtttgctggaattgttgtatggattttgcatcagtctgaacctacatctcctaggtgtccatccactccatccagtgcaagggctattgcagctgcagctaatggagcggcttttgctctagaacttgaagccttaggcctcggatctgctgcaacaactgcaggaaacttttttgaggatctcacttcttctgaactttataagaataccaaggttcgtgatatttcagggacattccgctgggcgccgtttcttgctttagagagatcaaactcatttctaaccatgctcttgctgctttctaagtacaagatgaagagtgttcctgtgttggatttaggctctggtacaattgataacattattacacaatctgctgtgattcatatgctggcagaatgcgctggacttcagtggttcgaaagttggggaaccaagaagctatctgaagttggtcttcccctggtgacaggaaatcaaatcatcaaggtttatgaggatgaaccagtcctccaagcatttaaagtaatgaggaaaaagagggttggaggggtgcctgtaatcgaaagagagaccaaaaaggcagttggtaatataagtttgcgagacgttcaattcttgctaactgcaccagaaatctatcatgattatagaggtattacagtaaagaacttcctgactgaggttagaagctacttggagaagaataaaaatgcatccccaatgttaagtgaatatgtcacatgcaaaaaggactgcacaatcaaagaattgattcagctgcttgatcaagagaagattcatagagtctatgtagtggaggatgatggggatctgcaaggactaatcacactaagagatatcatctcaaggctagtacacgaaccgcgtggctattttggtgatttctttgatggcgttctaccgctgcctgcaaacaccagagtttaacaggcaaggttacaagggagaataacctgctggtgcagctttttcttttttgtttttgaaatatttttttcaagtaaaaagggaaaaaaaatacaaatagatctatgtgcttctcttcagggttgaagacgagtggttggatctttatataacgtgtaggcagtttgcaagttaattgcatcacttttattaagtgttagagtgagatttgtgtgtactgtaaattctggtgtaagtgtaagtaaccataagttttgttaacttttgaaatgcattttcttttcccttcact

SEQ ID NO: 200 - DNA, 646 bp, Glycine max
aatctcttcacagaagaaaaaagagaagaagatgggtttgaagaacaacatggtggtgctaaaggtgtgtttggtgctacttttccttgtggggggtactactagtgccaacttgaggctgagtaagcttggcctgctcatgaaaagtgatcatcatcaacactcaaatgatgatgagtcttcaaaaccatgctgtgatcaatgcgcatgcacaaagtcaaaccctcctcaatgccgctgttcagatatgaggctgaattcgtgccattcagcttgcaaatcttgtatttgcgcattatcgtatcctgcacagtgtttttgtgttgacataaccgatttctgctatgaaccttgcaaacccagtgaggatgacaaggaaaactactaatgaacaagtgttatgcatgtaagctctctctccaacggacaaagccccctttatgctttgtttgttatgtaaggaatgactaaataaacttggaataaaacttcctctcttttcgtggcccataatttgctttctgcaaatctgggtcttcttcattccaatgttaattaatttggccaattttaatttatagtttttcgtttgcatttggttctatgatttcaggatttataaataaaaaaatgtataagttaacca

SEQ ID NO: 201 - DNA, 1049 bp, Arabidopsis thaliana
gggtttttgttgctctctctctcttctcaccttgatatttttcagagagggagagatgatttccgatcattgctatgtcgtccggatttcttcgtcaaggccgtccggtttgtcaaccggcttcagcccgacatccatatgcctcttgtgatgtggtttgtcggttactttcccggaatcttctggctcctttagcagaattgtccggtgtcgccgtcctccatcggttggttcctctaccaacggtggttggctcttgtctagcttctccgtcgtccctctccggcggtttaggctagcttttggccggatttcttttccggttttgttttatgttctcgttttctatagatccagtttgattttgctcctttgtgttctaactcttagagggctcaattccttgaacctcctttgtttaaagggctcaatttgtttttcaagcttatcgatttcaattatataagaacaaattagagttgtggattggggttttctctagtgcctttgagttgggttttatgcaattgagtcaattgtcatattggtttttggaaacgagtgtttttattttacttttaggtgttcatggaagttccattggcttaagttctacgctgatgtcgtttgaagatcatgatatgactacccaggggagattttcctttgcgaattcgaagatgaagaagattgatgggattctctgaatttggtgttgctccatcggacaagcttgaagtcttggtggttcctggtagttttggagttccctgcgatgactaaccaaatcggcggtggccgtgataacaaatgtttcttctgcccacgtgcttcaacctcgcttgataacttacatgtggttttgcgttggactacatcaattacttcctaaaagggtttcttatttcaactgggctttcttttagttgggcttttatctttattttgtttttgtctgcagtctgaaagttgagtttccactcttgtaacctttacaatctttggtttaaataatagccaacacttatgagaaaaaaaaaagattctac

SEQ ID NO: 202 - DNA, 1513 bp, Arabidopsis thaliana
ctgttatagctttatctttttatctttactttcataaaatcaaagttaaagacttggcaatcagcaaacactaaaattacataactttaccctccactatcaaaagttacattgagccacccaactactttataatctcgtcgtttacacccctacaattgttaaaattcattaataaaatccctcagattgatactaaaacttcatcataactcactaattcccttaaagcttcaagaacgaaaaaatgtacgtgacgagaacattgtcgcagttcagaaaatatcagaagacgctctcggaagagtcaccggaaggtccgttctccggcgttttggttatcacagatgaagaagctgaaacagaggatacgttctgtttcgggatgtgtacgaggacaaaaatagagaagcttccgttacctcaggacaagatcttatcagttgttcacttagacagttctggtaacagagagacttcggttaagaaggtcttgttcataccggctctcgatcaacctttgtcttccaatcggtattacgttgttcacgctagaggcagacacaaagggaaagtttccgtgtgttctagagagatagagaaaggggtatgttgttttccagatatcttgcatgacaagaaacctaaacctctggatccaagaaacatatatcagacggttaagatcaaccggcatcacgaccggacattctatgcaaaatctgtggcgccagacggtacaccgccaacatttctcaagaagaaaggatgggagctacgaacctcgaggagcctacatccgaggagacctagagaagctcttggcctagacgaggaactaagagctcgtctcccagcatttggatttccagtttctacaattcggtcaggaagtgtgatagttggagaatggtattgcccttttatgtttgtgaaggagaattgtagtgtaagtcaacaaatgaggaagtcaatgttctataggatcacactatcccaatactgggaacgaatttaccattgcggaaacaatgatcttgatgaaaacaatgatgaaaacgaagaagaagttgtgagagtagaggctaacgtcgtgagagaggccaactatgtgaagggtatggaggcggttaagggagagaaagaagggcatggagggttttattggtataggcaggttcaaggtccacggggaccgggggagaggaggaggaagacgggtttaaggtctccggtggggctgagttttgtggtggtagaaaggatgagaagggtaatggaggaaggagggtgggtgggaggaggaaggaaagtggtgagggtggagagagatgaaccaatcagggtttgtagaagagatggtaggaatatgaatggtaacaatgatagaaattggaggagatttgggtgttatgtgttggtggagagttttgggctgagaagagcagatggagttttgttggttaaatgtgtatttagacatactaatagattgagatgtaactgggagtga

SEQ ID NO: 203 - DNA, 1083 bp, Arabidopsis thaliana
ataattagaaacttacgcatgcatcagcttccgtaaatctcctacatctctctctctcctctctgctttttaccttctagggtttttgatcatctctcaggtgaatacgttttggtataatctcataccaatgtctgcgaattccaagtcggagaggtctgcttctcaatcggcggagacggtggctgtttctaaccgtgtcgtggcgtcacggtcaagtcgtcagccgcgtctctctttctcctcctttgctccctcatcagagcacgataacctgaagaagctgaaatccgatgagatttctcccgcgagagaggaagtgccggtgtcggtgaaggagagagaagaaacggaggaggaggaagcgaagaggacgtggaatcttcgtccgaggaaggcttatggtggttcgaagaaaggaaacggcgtgttcacggcggaggtttgcggtggcggcggaggaggaggttcggaggtgaagaatcagaaatcaggcgcaggaattgagccgaaatcgaacaggcagagaggaatcccggcggaatcacccggattaggcggtggtgaggttgcaaacgagaatcataggctttgggttgctctagctcgagacgagatcgaagaagatttgttcagcatgagtgggaacaggtcatctcgccggccaaggaagagggcaaaagctatgcagaaacatctcgatgtcattttccctggattgggtctcgttgggatgaatgctgattgcttcagagtagccacttctccggctaagtgatgatcgatgcaaaggagtcttttggtgaaggaaaaagataggtatgctggtgatcgagaatccagatacatcacagtagaagctaggaagaagatatctcaagagacatgttcttgtctcatatcaaacttagtagtaactaaactataagtaaatatcggtaaggtcatataattatagatatatataaagagagagagcgagaggggtttgtttttgagttagtaattaagatgcgtctaagtttaatggcagaggaaaacaacataatctatgtttaaaaagggttttttgaaaccatttat

SEQ ID NO: 204 - DNA, 1608 bp, Arabidopsis thaliana
atgttcctttcccgcgtgaaccccacgcgcttccctccattcgtagcttctcgtcgtctcttctccgcctccgcctccgccgcttctcttcagcaatactgcacggagaagccaccgatcaaaccgtggccgcagaggctattcccgaagcgattagtctccatgatcacccaacagcagaacatcgatctcgctctccaaatatttctctacgccggtaaatctcatcccggtttcactcataattacgatacttaccactcaattctcttcaaactatcccgtgctcgtgctttcgatcccgtggagtctctcatggcggatcttcggaactcataccctccgatcaaatgcggcgagaatctcttcatcgacttgcttcgaaactacggtctcgcaggtcgttacgaatcttcaatgaggatctttcttcgaatccctgatttcggtgttaaacgctccgttagatcgttaaacacactcttaaacgttttaatccagaatcagagatttgatttggttcatgccatgtttaagaacagtaaggagtcttttggaattacgccgaacatcttcacttgtaatctactagtcaaagctctctgcaagaaaaatgatattgaaagtgcatataaagtgctcgacgaaattccttcgatgggattagtgccaaatttggtgacttacactacgattctaggtgggtatgttgctagaggtgatatggaatcggctaagagggttttggaagagatgttggatcgtgggtggtatccggatgcgacgacttacactgttctcatggatggttactgtaagttagggagattctctgaggcagctacggtgatggatgatatggaaaagaatgagattgagcctaatgaagtaacttatggtgttatgatcagagctttatgtaaggagaagaaatctggggaagcacgtaacatgttcgatgaaatgcttgagagaagttttatgccagattcttctctttgttgtaaagttattgatgcgttgtgtgaagaccataaggtagatgaagcatgtggtctgtggagaaaaatgttgaagaacaattgtatgcctgataatgcccttctgagcactctcatccattggctttgtaaagaagggagagttactgaagcgaggaaattgtttgatgagtttgagaaaggctcgatccctagtctcttgacgtataacacgttgattgctggaatgtgcgagaagggagagttgacagaggcgggtagattatgggacgatatgtatgagaggaaatgtaagccgaatgctttcacgtataacgttttgattgaagggttgtccaagaatgggaatgttaaagaaggagtcagggtacttgaagagatgctggagattggttgctttcctaacaaaacaacgttcctgatattgtttgaggggttgcagaagttagggaaagaagaggatgcgatgaagattgtttccatggctgttatgaatgggaaagttgataaagagtcttgggaacttttcttgaagaaatttgctggtgaactagataaaggggtcttgcctcttaaagaattgttgcatgaaatttctgtctcttga

SEQ ID NO: 205 - DNA, 755 bp, Brassica juncea
ggtcgtccgggagtgcatcctatgactccggcgaacatggcctctacacgggtgttgagattgaccggttctgatgctccgagctctgctccgggctctgctccgggctctgctccaggctctgttccagggtctgctcaagggccgaccactcctggtgcctcgaccactccaggacaggcgggaggtccagagaacgcgggttcgatgtcgaccagcgtaaatttcggggttaattttggaattttggttatgttggctactattttcatcttttgagtatgatttcatcatctttacattacttttttttttgctcaataatggagacatatactgttgtttatctttttagtctttagagtcatttactcttttttgttttccacctatctcccctctcacccacattattattctgagttattattggatttgtatggaccattactatattatcatcttgtctgcttaaaataactgcgtttgcatcccccttcagtagtggactattgccattagattcacatagatatttattttgtccttcagcttttattttcaaaatggaatttaaaaaaagctttaggataaacaaagcaatattcacatagatatttgttttgtccaacattgtttttttgtgtgttctccatttcatttgaaaagttatcaattgttttgttttgttgttgtcaatctggtgcttaaataatgatttaaagaataaaccaataaaccgtcttaccaacgtt

SEQ ID NO: 206 - DNA, 385 bp, Brassica juncea
tacaaccaagtcgtcaacggggagtggaacgtcgctggcattgcctatagagcgtacgatctggaaggcaagacggtgggaactgtaggagctggtagaatcggaaagcttttgctgcagaggttgaagccgttcgggtgcaacttgttgtaccatgacaggctccagatgggaccggagatggagaaagaaactggtgctaagtatgttgagagtcttgatgagatgctccctaaatgcgacgttgtagtagtcaacacccctctcacggagaagacaagaggaatgttcaatagcgagatgatagggaaaatgaagaaaggtgttttgattgtcaacaacgcaagaggagccatcatggataggcaagcggtggtggaggcgg

SEQ ID NO: 207 - DNA, 242 bp, Brassica juncea
gggaccttcggtttatctggttatagaaggaacagggaaactgcagactggttcatctcaattgttggttaaccgaggagatgttttgtttgttccggctcataacgagattcacttaactggagaaagtgatgtgatgaagctttacagagctggagtcagcagcaggttcttccagacactgtagacaaaagtataaacacatttaacattggatttttactctaaatataacaatatgg

SEQ ID NO: 208 - DNA, 750 bp, Brassica juncea
atggataggagagaagtgtatgtgcttacaattttcgtggctctctctgttagatgcgtcggctgtgttgctaattacaacaggaacgatttccctactgacttcgcttttggatctggcacttctgcttatcagtgggaaggagcttatgatgaagatggaaaaaagcctagcgtctgggacacttacgttcactctcgtaacatggagaacggagacatagcttgtgatgggtatcacaagtacaaggaagatgttcagctaatggttgaaactggcttagaggcattcagattctccatctcttggtctaggcttatacccaatggaagaggtcctgtcaacccaaagggtttagagttctacaaaaacttcatccttgaacttgtaacccatggaattgaaccacatgttacactttaccactacgatcatccccagtatctcgaggatgaatatagaggatggctcaaccgcagaatcataaaagactttacagcttacgcagatgtttgcttcagagagtttgggaagcatgtaaaattctggaccacaataaacgaggctaatatattcactgttggaggttacgacggtgggaatacaccgcctggtcgttgttctacctgcatgtcaggtaactcttccactgaaccatatatcgtagcccataacttgcttcttgcccacgcctctgcttcaaggctatacaaacaaaagtacaaggatacacaaggaggttctgttggc

SEQ ID NO: 209 - DNA, 1274 bp, Brassica juncea
tgttctgagagaagctgaagatagaagtgtttcacctattcctgtttgggacataccaatctggaaagatatttccccacgtcagaggaaagttgctacttctctcaagttgatcaatgacaccctcaatgatttgatcgcaacatgcaagagaatggtagaggaagaggagcttcagtttcacgaggagtatatgaacgaaagagatccaagcatccttcactttctcttggcttcaggagacgatgtatctagcaagcagctacgtgatgacttgatgacaatgcttatagctggacatgaaacatcagctgcggttttaacatggaccttttatctcctaacaacgaatcccaacgtagtggccaaacttcaagaagaggttgattctgttattggagatagattcccaaccctagaagatatgaagaagctgaaatacacaacccgagtcatgaatgagtcattgagattatatccacaaccaccagtactgatccgtcgttctctagagaacgatacgcttggaccgtatcccataaaaagaggagaggatatcttcatttctgtttggaatctacatcgaagtccccttcattgggatgacgcggaagagttcaatccagagagatggcctcttgatggaccaaacccaaatgagacaaaccaaaacttcagttacttgccgtttggtggaggaccgcggaaatgcataggcgacatgtttgcttcatttgagaatgtggtagcaatcgcaatgcttattcgaagatttaactttcagactgcaccaggagctcctccggtgaaaatgactacaggagctacaatacacactacagaaggactgaaattgactgtaacaaagagaacaccacctctctctgttcctatccttccaatggaagctcctcgagatgaagtttcctctgctctgtcttgagtcttcttcatctttgcagaactgaagaaataaacaagctcaaagaagactaagaagaagaacaacaacaaatgcttctaattgtttctctgcgttatattatgcagacaagtagaatgtaaagaaaattattattctttgaaaaaagatatacaagtttcaaatattttctaggacatacacacgaagctcgaagttgtctatgatctaggaaagatctctgctcgtgtttggtatgcgcaacatcgagtactataaaacaaatctttcatcggtctgaaaccctcgggttgttaatgttccatgtctatggattctggagggtaacatc

SEQ ID NO: 210 - DNA, 1033 bp, Brassica juncea
tgattgattcagttgctataattgctgcaaatgctattggggccataccttacttcagctctggtttgaaaggtgttgcaaggagcatgccgacctcagctgctctagatgttgttgcaaaaagcttgaatttgaagttctttgaggttccaacaggctggaagttttttggtaatctgatggatgctggaatgtgttctgtttgtggggaagaaagttttggaactggctctgatcatatccgtgagaaagatgggatttgggcagttcttgcgtggatgtccatacttgctcacaagaacaaggaaaatcttgagggtgacgctaaattggtgacggttgaagacattgttcgcaaacactgggctacctatggccgtcactactatactcgttacgactatgagaatgtagacgcaggtaaagctaaggaactgatggagcatttggtcaaattgcaatcttcaatccctgaagtcaacaagatggtgaaaggaattcgttcggacgtggctaatgtatccagtgccgatgaattcgagtacaaagatccagttgatggctccatctctaagcaccagggaatccgttacttgtttgaagatggatctcgacttgttttccgtctgtctggaactggctcggaaggagcaaccatccgactctacattgaacagtacgagaaggatgcttctaaaaccggacgagagtcccaggaagctctgtctcctctggtggacatagctctgaagctgtccaagatggaggagttcaccggccgatcagctcccaccgtcataacataagaagacgggtcaaatgcaaccatctataaatcagacccttttccttgtctgcgtctttgggatgctttgtttcttctcatttaaatgaaactatgaataattaagagtctcggggaggctttcatatttcatgagttatcgtgaagcttatacttggatttgtctttctcggttttgttattttacatgtattacgtacatgattaagatttgttattgcagttcaa

SEQ ID NO: 211 - DNA, 933 bp, Brassica juncea
ccgtgtacttctctctcttcagctacaggtaactctggaagctgctcagcttcgacgtgcgtctacggtattcaatacggcgatcaatccttctccgtggggtttctcgccaaggagaagttcacgctaacgagctccaacgtattcgacggcgtttacttcggctgcggcgagaacaaccaaggactcttcaccggcgtcgccggacttctcggactcggccgtgacaagctctccttcccgtcgcagactgcaacaacatacaacaagatcttctcctactgcctcccttcttccgccagctacaccggtcacctcaccttcggatccgccggagtctccagatccgttaaattcactccgatctccacgatcacagacggcacatccttctacggtctcgacatcgtcggaatctccgtcggcggtcagaaactggcgattcctccgacggtgttctctactccgggagctctgatcgattccggaaccgtcatctcccgcctcccgccgaaagcctacgcggcgatgcgaagcgcgttcaaggcgaggatgtcgcagtataagaatgcgtcggccgtctcgatcctggacacgtgttttgatctcaccgggtttaagacggtgacgatcccgacggtgtcgttttacttcagcggtggcgccgtcgtggagcttggctcgaaagggattctgtacgcgtttaagatgtcgcaggtttgtttggcgtttgcggggaatagcgatgataacaacgctgccatcttcgggaacgttcagcagcaaacgctagaagttgtgtacgacggagcgggcgggcgggtcgggtttgctccgaatgggtgtagttaatgaaaaccatatgggtaaattttatttacggatttggcgccaaattagcttcatccttaatcaagtgtgtaatttgtgtga

SEQ ID NO: 212 - DNA, 800 bp, Brassica juncea
tatacaagatctgcctccgggtcttcgaagagatatcaagcgatatctttgcgttgatctcattaacaaggtaccattgttcaggggtatggacgatttgatccttgacaacatttgcgatcgtgctaagcctcgtgtctactctaaagacgaaaagatcatccgcgaaggagatcctgtacagagaatgatattcatcatgcgtgggagagtgaaacgtaaccagagcctaagcaaaggcgttgtagccactagtacgctcgaaccaggcggctacttaggcgacgagctactctcgtggtgcctacgtcgtccatttatcgaccgtcttcctccttcctccgcaacatttgtctgtctagacaacatcgaggcgttctctctcggatccgaagatcttaggtacataaccgatcatttccgctataaattcgcaaacgagcgccttaagaggacggcaagatactactcctcaaactggaggacgtgggctgcggtgaatatacaaatgtcgtggcgccggtacaggaagagaacctgttcgatgagtcctgtgtcggaacatagcgttgaaggtaacagtgaacgccgtttgcttcagtatgcagcaatgttcatgtccatccgaccgcatgatcatctcgagtaaaaccaaaaaaaaagttgctaaatttatcggtcgaaataattgtttgtatccattgttcgtcctcaattgtttttgttctctttgtgtaaaataaaacctctctttcgattatgtgtatttgagtttaaaactagcattagaagtttctctt

SEQ ID NO: 213 - DNA, 733 bp, Brassica juncea
ggatggaagtgagattgtgtgtgagggtccaagatgcagtcttcgtagtaaaaaggtttacagtgatctcgccgtagattattttaaaatgttcttgttgaatgtaccagcaaccgttgttgctctcggactattcttcttccttgatgaccttacgggctttgaaatcacgtacttgctcgagcttccggaaccattcagtttcattttcacatggttcgctgcggtgcctgcaattgtgtatctggcgctatcactcaccaagctgatcataagagactccttgatcttgaagggcccttgtccaaactgtggaacagagaatacatccttctttggaacaatactatccatctccaatgacagttccaccaacaatgttaaatgctccggctgtggaacggcgatggtctatgattcaagtactcgtttgatcacattaccagaaggaggcaatgcttaaaccctatgggccaaggtttcattttcaggatatgtaaaattgatactaatagatgaaggtggagaaattaagcaaaagagttgtgtttgtgtgctgttttctatagtcctcagatgtttccatgtagctctcgttgacttgtattgtgtgttgtaagtaaatgtgaggtgaaatcagagaaagaacaccatgtgattacttctttgaggaatttcgctctcactagaaaataaaatggaaaaaatggcacgacaaattacctgcatttgt

SEQ ID NO: 214 - DNA, 560 bp, Brassica juncea
ttacgacccggtgaaggagacgctatagcacagtacgttcagcaagggaaacgtatcccacgtagaggagaagtgggtcttaacgctgatgagattcagaggtttgaggatcttgggtatgtgatgagtgggagtaggcatcaaaggatgaatgctattcgtatcaggaaggagaaccaggtttatagtgctgaagacaaacgggcgttggccatgtttaactatgaggagaaggctaagcgtgaggctaaggttatgtctgatctttcgaggcttgtgcagcgtcatatgggagaagagttgggtccgaatcatgacccttttggtgctggaaagactgatggagctgatgattgattttctttgctttcttctgctgtttatgtgggtacttatcttatgcttttgttcttgtaaactcttccttattgcatcatagttactgtttgtttgctacttgcccgtttatgagtttcatagtttatgctttaatttgctatggtgtatcatattattgcgtttgtgtcttaaagatgaaagactcgactttagggatctgc

SEQ ID NO: 215 - DNA, 1253 bp, Brassica juncea
ctgggaagctccataacaaggtctctgtcacatgctccagacgagaatagtcatcatccccacacagttgcaggcgatcatcagtcgtttcccgaccatattatgtcaagccttttacagacaccagctctatacacagctgcaagtttcgcctcaacgttttggcctcctgatactagtgttggcccacaagggaacaacttaactccgaatctggctgccatggcttcagccactgttgcagctgcaagtgcttggtgggctgccaatggactgctacctctatgtgctccttttagctcaggtggtttgacctctcaccctccaactattacttatggaccttcttccggtgaagtagacgtcacaaaaacaacggatcaagaacactctgaggcgtcaaaagctcggtcttcattggactcagaggagactaaaaatgggagtaaaccagattgtcatgagcatcatccttgtgcagcaactgagactgatgcaaagggatcagacggagcaagagagagaaaacaagttgaccggtcttcttgtggctcaaacactccttcgagcagtgatgatgttgaagctgatgctttggagaggcaagagaatggtggtaacaatgatgatgaagtgaaagaagtgaatgcagacactactaacaacaatccacaaactacttcagagtcaaatgcaagacgcagtagaatcagctccaacttagctgatccatggaagtctgtttcagatgagggtcgaattgcttttcgagctctctttgcaagagaagttttgccacaaagttttacatatcagagagaggagggtcaacaacaacaacaaagatatccaatggagcttgatcttaactcagcagctgatgatcaagaagagaacagaaacatagcgtttttgggtgcttcaaagcagcagcagctaagtagaggaaggacaggtttcaagccttacaaaagatgttcaatggaagctaaagaaagtagagtcatcagcaacaccaatcctatcatcagtgttgaacagaaagatcctaagcggattaggttggaaacacaaacttcaacatgaaaaaaagttgtaactctattattatatctgttgtttctctattttcattcaagtttcaaagatcactgatacattttcttctgtttttgagggcctgtgtattttgtccatagtcttcttgtaacgtttgactctgtattatcaaacaaatcataatctgtttaatt

SEQ ID NO: 216 - DNA, 741 bp, Brassica juncea
cttgatgattgtaactttcatgagtctgttcgtcttgatagcttcgactcggatagaactttgtccctggttccaccagatggtgagtttccagtaatgaactaccgtatgacccaggagttcaagcctccttttcatgttaataccttgattgaagaggccggacgccttaaggctgaagtgattattaagatacgagctgaattcccttctgacgtagttgcaaacacgattactattcagatgccattgccaaattatacttccagggctagttttgagttagaacttggtgcggctggacagaagacagatttcaaggaaaccagcaaaatgcttgaatggagttttaaaaagattgttggcggggctgaacatacactgcgtgcgaagctgacattttcacaagaatttcatggtaacatcacaaaggaagctgggcctgtcagcatgacgttcacgattccgatgtacaatgtttctaaacttcaggtcaaatacttgcagatagcaaagaactcaagtagtaacaatccatatcgttgggtgagatatgtgacgcaggccaattcgtacgtggctcggatatgacctactttcatattatgctgcttcgtcacttttgtatgtccccaagtgacttttctcttacccttctcgacaatgtttgttcggattctggtcatacttgttctatgaagttgttgacaagatgcttcacagcacgtgtctgaatgttaa

SEQ ID NO: 217 - DNA, 805 bp, Brassica juncea
ggagagagggttgcgttgttgggttatggctcagcggttcagagctgtttaggagcagcagcgatgctccaagaacgtggactgaacataaccgtggcagatgcacggttctgcaagccgttggaccgtgctcttattcgcagtttagctaagtcccacgaggtactgatcacggttgaagaaggttccattggcgggtttggatcccacgttgttcagtttcttgctcttgatggtcttctcgatgggaagctcaagtggagaccaatggtgttgcctgatcggtacatcgaccacggctcaccagctgaccaaatggctgaagctggactcatgccatctcatatcgcagcaactgcacttaacttaatcggagcaccatgggaagctctgtactgagagtagatatgcaacaattctaagcggattagagggtttgttttaagtaaaatgataaatgttcccgccgaaaagaagcaacagaaaagttctttggttgttatatgataactgagaaggtgaagagaaactgagaagggtaaaggcgatgtgtgcaaaagaaaagattagtaagtagtatatgtttttttttttttgtgtgatgtgactttatttaggggtgtgaatgtgtgattgagatcgagctgtacaaccatctaacatctttgtaaaatcaagtacatttcttcgtctactttgtatacccttttgtgtgagacttggaaacatttcgacaccgacaccaattatcactacatctgggaacaagtggctctcggatttaacatagactcggcatattcct

SEQ ID NO: 218 - DNA, 539 bp, Brassica juncea
acatcaacgccctcgctaagtacacgcagggattcagtggtgctgacatcactgagatttgccagagggcttgcaaatacgccatcagagaaaacatcgagaaggacattgagaaggagaagaggaggagcgagaacccagaagccatggaggaagatggagtggatgaagtatcagagatcaaagctgcacactttgaggagtcgatgaagtacgcacgcaggagtgtgagtgatgcagacatcaggaaataccaagcctttgctcagacgctgcagcagtcaagagggttcggttccgagttcaggttcgagactaatgctggttcaggtgcaaccactggagtcgctgatccttttgccacgtctgcagctgctgctgcggacgatgatgatctctacaattagtgatcaagtttatcagactctgttatttaagttttcattcggattctctctacttctggataccttgtgttttcttttaagttatcagaattatgttggtccttttaatcaatgttctcaattgactcctct

SEQ ID NO: 219 - DNA, 355 bp, Brassica juncea
gggtgttgtcagttggatatccagttctcaaaccttgaggagctgcaagtaaattacaacaacgatcgatctagggattatacaaatccaaacctgccatcagagcaaaaaggccgtttacctcaccctggctacggtgatgcaggagtggcatatcctcagatggcaaacacatctgcgattgcagctgcctttggcggtggcttgcctccgggtataactggcacaaatgataggtgtacaatccttgtctctaatcttaatactgatagtgttgatgaggataagctgttcaatctgttttctctttacgggaacattgtgaggataaagcttcttcgaaacaacctgacca

SEQ ID NO: 220 - DNA, 471 bp, Brassica juncea
cattgtacacaatacggacgtggtcaatgacggttttggagaacgtgaactcactagttgggaaaacagcaacgccagagtatctgcagaaactgacttacttgtgttggaaccaccataaagccataaggcatattgacacagtgagggcttacacgtttgggtctcattactttgtggaggttgatatcgttctccctgctgatatgcctctgcaagtggctcacgacattggggaatcgctgcaagagaagctggagctgctgcaggagatagaaagggcctttgtgcatcttgattatgagtatacgcacaaacctgagcatgctagatcccactgttagctggattattcttctatccctacgtctaaaaattcttagagctaaagaatcttcaccatattgtttagtagacaaaaaaaatacctttgtaatctagttttgttaaaactataattttaagtctaaa

SEQ ID NO: 221 - DNA, 522 bp, Brassica juncea
ggagagacacaagccctgctctataatgtgtaaacgcaccagcaacctctacttaggattcataacaatcttgggaatctccacggtgctcgtctcgctcttaccggtcttccagagccctgagtttcgtgttgtgagggcctctctcttctttggaatggggttctctggagctgcgccgatactgcacaagctgatcatcttttgggaccagcctgaggcgcttcacacgacggggtatgaggttttgatggggttgctttatgggttgggagctttggtttatgcgactaggattcctgagaggtggatgcctggtaagtttgatatagctggacatagtcatcagttgtttcatgttttggtggttgctggtgcgtttacacattatagagcagggcttgtgtatctcaagtggagagacattgaaggatgttgatgatttgatgtaacctttgatgttttgaatcattttcttttgtagcttcacgaaaaaagttggattgtgaatcattttcttaa

SEQ ID NO: 222 - DNA, 540 bp, Brassica juncea
cttgtgtggttgtgttctcattacagatgagagtgtggtagctttagctgattggtgcgtccacttgaggtcactggggctatactactgcagaaacataacggacagagccatgtactcgctagctcaaagcggggtgaagaacaaaccaggggggcaatggaaatcatcagctaagaagagcaaattcgacgaagaagggctgcgaagtctcaacatcagccaatgcactgcgcttacaccttcggctgttcaagcggtctgcgatacgtttcctgctcttcacacgtgttcgggaagacattcgcttgtgatgagcgggtgtttgaacttgacgtctgtgcactgtgcttgtatccttcaggctcatcgctcggttcctcactcggctcactgaaagagagaggaatgggtaatgtttgtatatagatgcttaatatgttgatgaagagattagatgccaaactctaaaattgcttttgagttggtttctttacgttgtcttgaaggatcttttgtaagaactctttgttactactt

SEQ ID NO: 223 - DNA, 334 bp, Brassica juncea
tgttattgatcttcaagagagctacaagtcacgttcctttgaagattctatcgatagaagacggcacagttctcaagtccttcaatcatttgcttcaccgaaacaagaaagttgatttcattgaacaatttaatgagaaacttcttgttaagcaagagaatgagaatctccaaattcttgacgtcagaaacgctgaactaatggaagttagtagagctgagttcatgacaccctctgcgttcatatttctgtatgagaaccagttgtttctaacattcaggaaccggaacgtatctgtgtggaacttccgaggagagctcgtgacttctttcga

SEQ ID NO: 224 - DNA, 1970 bp, Hordeum vulgare
agatactttgtcacctgaagagtattctgatgaaggttggcaagcagctactttgaaagggagatcttcaaatgtgcggaagaaaagcatccgcagaagaccatctctcactaaattattggttgatcgtacagaagatggtcgcactccttctgctcataggagtggtgtacaaccacaagcaaaagagcataaagaagaagctgtaaactcccctagccaactatcatttggcaactttataagaagcgacaagttgaatggggatcctgtgattaccgaagacaagtcttctaagggcacatctaaatcagaatggaaggtaaagcctacaggaagtaagaggccaactaccatagcttcaaagttggtatcatacaaagatgtggcagtgtcaccgcctggcacagtgtggaaaccaattttggaacagaaggaagcaaaggagaaggataatgaacaagatactgatgcagcaccttcatccgaggaaggagatagaaagcttatagatgaagagaaggagaagtcaagtgatgagagcatcaaagagattgtctcaattcagccagaggaaagcagtcccacagagccagagaaagcttctgacagcaatagtgacggaagctcatctccgggcaagaaaacaagtggaagcaaactttcagcctcagcacctccattcaaacctggatcactcttatcagtgtcccatccttacagcacagtggcaatatatgatgctagcgttgtgcttcagccgattccaagtcaagcaatggagattctccctcatgctgtcgatactagagtaccccgtggccctcggtccaccttgtactatcgtactgggcattctttccaaaggaaacaaggttatacgcagagccagagcactattctgagaggcagcacctcccccccaaccatgaatccccatgctgctgagtttgtgcctggaaagactgtgcaacaagctgatttggctacagaggaacaagctaattctgtgactgatccagcaggtcagcagttggcatcacatgcttcagatgaagtgaaagtcgatgttcgtgaggctgacaaggcaggtcaagtggagaagacaactccaggtaaagggaaggaacgagcgaaagacgcgatgagagattcatacaaagcagaactcgcaaggcagattctgctcagcttcattgtcaagtcggtccatgacagcttaggttcgactcgacctcaaccggacagaaaaccaagcgggtcagatgaagctagtaacgaacagagcagcaacataaccaagaccgccttaagtccaaaagagttcgacaaacaaccgaaggccaccgaggcgcccaaaagcgagaaggatacagagggatttacagtggtttcaaagcgcagaaaaagcaagcagcatttcgtgaatcccataaacggtctctactcccagcagtcaatctgcacttcggtcagctgaggttgctgcacttcctgagatctgcaagcagtgcaacgtgttggaagatggtattgcttactttgctcttttaggcgcttggtagcagagttttgccctatattcagatgaacgagcatgttgtcaaactgtacaaagttttccgccgccccccctttccaatatttttttcgtaatttgaggtagcagaataaaatggtttcccccctccttcctatggatgtactatgttattatgacagaattataggatatagtagcaaacattcatttcctcccaacactccaatgatgctcctgaatttgctttgatgatttgcactcgtcaagtaccgctgcagaacgtagttttgccctatccagatgactgagcatgtagccaaactgtacaaatatttccccaattccattttctaatattttttgtaatttgggttggcagcagtgctgaataaaatgttttccccttcctgtgtactagtagttatta

SEQ ID NO: 225 - DNA, 2657 bp, Brassica napus
aaatcacctttcaatggcggcttcttcctcttcttcttctccctcgtctctcctcttaccgaacatcagtttccattccacaaccactcgttccgtttcaatccccggaatcttcctgcctagaaatcgcttgagacacagtcacactctcccgcttcgaatcagagcttccagagacgataatgtcgcagtggaagatcgtgaaaacgcagtgatcaacggaaacggaagcgtacgtctgaacggcaacggagctgcgagaaaatccatcaacggagatttaaacggaaacgtccctttaaacggcaacggtagtttggtgaagtacgtgaacggaagcgtaacggaggaagtctcgaagaagagagaagaagaaaagaggcagaagagagtagaagacatcggtcaagaggatgcttggtttaagaaaactcaacagaaacaacaagtcgaggtttctgttgcacctggtggtcgatggagtaggttcaagacttactcgaccatacaaagaacattggagatttgggggtttgttataacgtttatcttcaggacatggttgagcggtcagaagttttcatacaaagggggaatgactgaggagaagaaggttttgagaaggaaggttttggctaagtggttgaaggaaaacatattgaggttaggtcctacgttcattaaaattgggcagcagttctctaccagagtggacattcttcctcaagaatacgttgatcaattgtcagaacttcaggatcaagttcctcctttctcttctgctacggctttatcaattgttgaagaggagcttggagcatctgttgatgacattttcgaccgttttgattatgaacctatagctgctgctagtcttggccaagttcaccgtgcaagattgaagggtcaagaggttgtcattaaagtacagagacccggtctcaaggatctctttgatattgatcttaaaaacttgagggtgattgctgagtatctccaaaaggtggatccaaaatcagatggtgcaaagagagattgggttgcaatttatgatgaatgtgccagtgtattgtaccaggaaattgattacacaaaggaagcagctaattcggaactttttgctaataacttcaaaaacttagaatatgtaaaggttccatccatctactgggagtacaccacgcctcaggtcctgacaatggagtatgtccctggaattaaaattaacaaaatacaagccttagatcagttaggtgttgatcgaaaaaggctagggagatatgctgttgaatcttaccttgagcagatcttgtctcatggattctttcatgccgaccctcaccctgggaacattgctgttgatgatgtcaacggcgggcggctgatattttacgactttggaatgatgggaagtatcagcccaaatattagagaaggtttactggaggccttctatggtgtttatgagaaggaccccgataaggtcattcaagcaatggttcaaatgggtgtgcttgtacctactggtgatttgacatcgatcagaagaacagcactgttttttctcaacagtttcgaagagcggcttgctgcacaaagaaaggagaaagaagaactagcagcagcagaagagcttgggttcaagaagccactaaccaaagaggagaagcaagagaaaaagaagcaacggttggctgcaatcggagaagacttattagccatttcagctgaccaacctttccggttccctgccacattcacatttgttgttagagccttttcagtattggatggcatcggcaaaggtcttgaccctcgctttgatataacggagattgcaaaaccatatgctttggaattgctacggttccgggaagctggagtagaagttgtagtgaaggacctgagaaagagatgggacagacaatcacaagcattctacaatgtatttagacaagctgatagagttgaaaagctagctgtaatcatccaacgacttgagcaaggtgatttgaagcttagagtccgagcattggagtctgagagggcgtttcaacgtgtagcagctgttcaaaaaacagtaggaagtgctgttgctgcaggaagcttagtcaatctcgcaacgattttgtatctgaattctttaaaaacaccagctactatagcatacacagtatgtgctttcttcagcctccaggttctgattggagttataaaagtcaagaagttcgaccaacgtgaaaaactgatcactgggacagcttaaaagaaatcttgtttgatgtattaaaaaaacttcttcttcagtctccataaaatcttttgtgctaagaagccacaaagatttctcccataaagctttccgtaggagtgatgatgatctcttgttctgccatagaaaaaatcttatggaagctttagaggctagatatgttaaaaccagtgaacgaccagactcatctctctctttttatttctttctgaaagtttttgattattgggcattttatcaacagagccacttgtaatggtgtgtagagatgtagacattaggtcaactttttcgtcaaaatatatgtatatataaaaaaaaaaaaaaaagggcggccgcgtgagagtatccaaacttacgtacgcggcatggctcacttcagtta

SEQ ID NO: 226 - DNA, 1137 bp, Brassica napus
gcacgaggcaaatgtgtgttgcgtgcaattctcttcatattccaatcatttattggcatttgggtcagctgattacaaggtctattgctatgatcttcgttacgtcaaaactccttggtgcacattggctggccacgagaaagctgttagctacgttaaattcatggattcagagaccatcgtcactgcttccactgataactctctcaagctttggaatctcaacaagacaaattccactggtttgtctactggtgcttgttcaatgacgtataaaggacatacaaatcaaaagaactttgtcggattatcggtcttggatggatacatagcctgtggttcagagaccaatgaggtatatagttactatagatccttaccgatgccaatgacttcatacaagtttggatcggtggatcccatatctgggaacgaatactttgatgacaatggacagtttgtgtcgagcgtctgttggagaaaaaaatcgaatatgcttgtagctgcgaattctaccggaaacatgaagctactaaaactggtttgacatttgtgggcgagtgagttcttttggaaaacaaatctctcaagtctgtatctaagacaacagtttgacttgaacctacgtttttgtcctggaaaacgttgatccctatatgaccgtgacaggttatggttggcaaccaaatctcagagaagttgaagcaaaaaaaaaaagctgtctatgtctttgataatatatgattcttcttcatatgtaactgtatatgagatgaaagttctcagattcttcggaaagtgactaagatttggtcttgcacaaacaagttcggctcaatgtgtaatgattagaggtatataatctgtacaagtgtgttcgcatagcttatttatgtaattgttgttgttggaaattacatgctagaacatcatatggccgagaaaagagggcttctgggtttccttactaacaaggaacacctcgggaatgccgttgaacgcacaatctttttaacgggtgggttttttcctttaatggcgaaccattgtagcttgttggaaccggggcacccgtttacttcacaaaaggggccaatctagaaatttccagcctgcgcgaaaataaaacaacaaccc

SEQ ID NO: 227 - DNA, 1324 bp, Brassica napus
cgggacgtgcgcatcgtatagtaccggtccggatttgccggatcgacccacgcggccggcaacagcatgaaggattctgaatccagtgggcgatgtgtggaggaatcagagaggagagtgatttggggtctgtgattggactctctttctctagtcatgtttgattgggacgacgaagagcttactaatatgatatggggtgacgagggagagacagacgaccatattgtgccttttaaagtaagaaacaggaaggaacaaggcgatgaatctaataaggcagttaagccagctgaaagtaaaactcaccttcatgatagtaagctgggggggagcagttcagggcaaaatattgagtgtatgagctcatggcctgactcatcagtatctaatgctagaaaagctgatccaggaccagattcgagtgagccagctagatatgattcaacaagaagtgagaaagcgtctgaacttgcgaaaggccctgatatttttcatagcactgatgagagtaaagagcaaggtgatttcgatgagtatggatgggctaacattggtagctttgatgatcttgatcgaatgttcagtagtgatgtccctatatttggcgatggcactctcagcggtgcagatgagttatggtcttcttctaaagatgcatccaagccgttaccatccattttggactctcaagatctaggattggatattagaactgagtttgagcaacaagagaaccagcagtttccattgactggagaaaccaatggtccatcatcccaaagtgcgcctagagttcgtgtaaccccaaaagctgagcaatatcatgagcataagagacaatcctcagttgatgaccagccatatcaacaaaacaaaatgatgaagttctcggaaatgttggggacttgtgaggcaggatcatttcaagatccgtacggtcagaggactctgtccaggagaaaatttgcaaaccagttgggaccgtcacgatcatctatgatgggtgttaatctgcagagtgagtctcaagggtctgggacatcacattatccacatatgccaaaccaatacatggctacttctggttttggtaatccatattctgctgtgcctgtagtttcagccttccaacgtcctgatgttaacaagaatcagctgatgcatccttcctacaatcctgctactgccatctctgcaaacatggtaacggatgctgcctctgcacgaccttcaacaatgacgccgcaggaaaaactagaaaaacttaggcgcagacagcaaatgcaggcgatgcttgctattcagagacaacagcagcaat

SEQ ID NO: 228 - DNA, 633 bp, Brassica napus
caagccgcagactgataggtgggtgttccccgacaccaagtcaggcatcattgtgctagctgagggtcgtttgatgaacttgggatgcgccactggacacccgagtttcgtgatgtcgtgctcgttcaccaaccaggtgattgcgcagcttgagctatggaacgagaagtcgagcgggaagtatgagaagaaagtatatgttttgcctaagcacttggacgagaaggttgctgcgcttcacttgggcaagctcggtgctagactcaccaagctcaccaaggaccaatctgactatgtcagcatacccattgaaggtccctacaagcctggtcattacaggtactgagagaacaaaggactgagcgttcttcgtgtggtttttatgattaggccatttgagtcggttttgggtttgctctggttgaggaatgtgagatattggtcttctgaggaggttgaccaaatatttgtatgaataaggaattgttgttcttggttttgagaggcttgttttttgttttatattttctcaagataaattagtttttgttttacactgttgttaggcttacttatgcgatgttctgtttaccagttaacttttcgaacaagtgatcaaacaagatatgtaaa

SEQ ID NO: 229 - DNA, 747 bp, Brassica napus
caacaacaacaacaatggctatatcaagaacattcatgtcctttaatctcttcatcttcttcctcgttattgctacaaccaatggtcaggctccagctccaaccccttcaggtccaaccaacataaccgcagtcctagaaaaagccggtcaatacacaatgttcataagactcctcaagagcacccaagcagcagaccaaatcaacactcagctaaattcttcctcgagccaaggcctaaccgtgtttgccccgaccgataacgcctttagcagcctcaaatccggaaccttaaactcattatccgaccagcaaaaagttcagcttgttcagttccatgtccttcctacactcttaaccatgcctcagtttcaaactgttagtaaccccttacgcacgcaagctggtgatggacaaaacggtaagttccctcttaacatcacgagctccggtaaccaagtcaacatcaccaccggagttgtgagcgccaccgtggctaactccgtctacagcgataagcagctcgccgtgtaccaagtggatcaagttttgctgccattagcaatgtttggttcaagctcggcggctcctgctccggcgcctgagaaaggcggctcggttacgactggttcagcttccggtagcgacggtggaggagattctactgattcatctgatgcagagaggatcagatacgggataatcgccaccgtggcagccattgctgcttcttctctgtggatataac

SEQ ID NO: 230 - DNA, 3272 bp, Gossypium hirsutum
gcctctgcattgcatcactctgctatttttgattttcagctttcgatcctactgctcgttacttatcacgccgtatcatctcatcttttctctctctgtttactttggtgagaagcagatatttgttttaaagctatccgtttagcggaaatagataacgttatcgccgctattttccgttacaccgcctattgagatctttatagcggcggacggtgccgatattgcaaaatagcgacccgcggcatcgatatttgaaacactgccaatacgatggcagttaaaaagcggaaagagagagccgttggcggtgaatccggaaacagcaagaagttcaaaaagtattccaactccaaaggaccgatgaagaaaaacaagaacgatacgagaaagaaggggaaaggtcctcgcttgccttctgcgctacgaacggagcttgatcgcctggaccctaaaatagcttccgatagcgatgacggtatcgatttagatgttggaaacgatgtttatgagtatgaggaagaagttccacaagaagagtcccggaagaaccgccgtttcgatcctgtcgagaactatgagtatgagctacctgaggattttgaggatgagaatgtaccatcagatgacgacgacgatgatggtgactttggtgttggtgggaacaagggtagtctaaatgatgatgttgatgcgagtgatggggatgaagaggaagatgatgaaaggcacttgaggatgttgcaaggggtcactggaatgtcaactgatgcctttggaggcaagaagaagaggaatagtgtggttatatccgaggcacatcctgagtcagaatacaaccctactcgtgatgttcttgagggtgacagccacattacacttcaagatcttttggatcctattcaaggaaaagcggggtatagcaaacttagaaaaagagtgcaacacatggacagaaagtctacatctgttcaagctccattgccgaaggtagatagagagaaattggagaggatggcagtttatgaacattcaaagaaagatattactaagtgggagcatctggtcaaaaggaatagagaagctcctactgttttttttggtggagatgtagacttggggttttcaactgtaggggcaatagcttctgaatttgagcctagaactgagtttgagaagaaaattgcttctttggtttatgatgacaaagttatggaagctcacaaagcagatggttccaaacttctggagttaaataagatatctgaggaagattatatgaagcaccaggatcatgttgctaaaatgcgcggccttcttttccgccatgaaatgaagcagaagcgcataaaaaagatcaagtccaaaacctatcatcgtttaaagaataaggataaactgaaagtggaatctgcagaaatgctgatggatccagaggcagccaaagagcaggctaggaagcaagagttcaaacgagctgaggagcgaatgactttgaagcacaaaaataagtcaaagtgggcaaggcgtatcttagaacgaggtttgaatgcccaggatgaaggtactcgagcagctatggctgaacagcttcaccaacatgctcttttgacaagaaaaattaacactgttaaagacagtagtagtagcagtgatagtagtagtgatgatgatgatgaggtttcaaacgaggatagggcatctgagttgctagaaaaagcaaaagagaaaacgctgaaagtattagaagacgatgaagaattgcctaattctggagttctttccttacctttcatggttcgtggactgaagaaaagaagggaagaagcgattgaagaagctaagcttgctcttcaagagtatgagcaattggagggtacaaatgatgcagaaaattcaaaaccagccactgcaagtggtagaagggtctttggcagggctaataatgaagttccagattctaacaagaagaccaaaactgataataagatgaaaatggataattattatggtaatagtgatagtgaagacgatttgaaagccaaagagaatgttaacattgagggcggcaaaagaaatgatgttgagaaggatgttggccctaattatgatcgtaaagaagcagctgatgtttccatattcaagaattttgatgacaatggagaccctggttcaaaaacgacatatgaagttgctatttttgcttccgactcgcggagaaagatgaaaagtgagaatggaattgataaaaatgcgaaaaagttgcaacaagtgaaggaagctattgtgcatgataaagacatggaggagggagaagaggatagtgattcggagagcaaacaaatggtggatgggattttgtcctcggcccccaaggaatcatatgaactcccttctcagtctgaactcattcgacatgcttttgctggggactatgtggaagaagaatttgaaaaggataagcaggaaatcctgaatgaggaaaaccctgaaccggataaacctgttttgctccctggttggggccaatggactcatgtacagcaaaaaaaggtttgccttggtggatgcttaaggaacacgaagactctaagcggaagagggaagaaagtcttaagaaaaggaaggatgcacagctcaagcatgtcattatatccgaaaaggtggataaaaaagctgagaaattgcagacaaaatctttgccctacccgttcacatccaaggaactttttgaacaaagtatgcgaatgcctattggatcagaatctaacccggagacagcaatcagaagtcttaatcgaccagaagtggtgaagaaacctggggtaattataaaaccaataaagtttgtggagatgcatcatcacgaaaaatccgaggataacaaacggagtgggcagaaacagaagaaaaataaaagcaaaggtgccagtggcaagaacaagaaacagagcaactaaatctcataaattttggctgaaattaggtgtagaaaatttggctgtaccaccttgttaagtggtgtaaggaagcaaaacaaactgcttttccaggcaaaggtaattgagaaaggcagtttaaacagccgccgtacgttcctacacttttggaggcaattttacgatgcgagtttatatttatataagttatattttgctattagtttattcaatttgatcttagtttttgtattctaaaattttgaaatatcaattttgattctaatgaattttaattgtggaattttatacataaaatattattttaatttg

SEQ ID NO: 231 - DNA, 3435 bp, Gossypium hirsutum
ttgatggtcgtacgctaactgacttcatgcatttaaggggattacagatgcactctttgggtcgtgtggtgaggaaactctcaaaaaatcggtcctcttgaatccttttgtgaaagtgattattggttatcttaaatcctttcttattggcactaggatagttttcaagtaatactctctaacttcctaataaatgtagttttattcatgaaaaattacataaagtacatgcttagaagtacggttccttgtttttgtttactcttattatcattgtacaagtcaggttgaactttctgagaagcttcctcacatacaatcactttgcatccatgagatgattactcgagctttcaagcaagtagtgaaagcagttgtggcatcagttgagaaaattgaggatttacctgtggttatagcttcaaccctgaatttcttacttggaagttgcgaagtggatgttaatgccccaagtgcaaatgatgactatttaatcaaactgacgtggttaagaaagttccttggagcaaaattcggttggaaactgaaagatgaattccaacatttaaggaaactttctgttcttcgcggactttgctataagattggtctagagttggttcctagagattatgatatggaatgccaagaaccgttcagaagttgtgatattattagcatgtatcctgtttgtaagcatgtaggatgctcttctgctgatggcagaacattgttggagtcatccaagattgctcttgacaaaggaaaactagaggatgcggttaactatgggacaaaggcattgacaaagatgatagctgtatgcggtccttatcatcgaactactgcgagtgcttacagtcttcttgctgttgttctctaccatactggagatttcaatcaggcagccgtatatcaacagaaagctttggatattaatgagagggagcttggtcttgaccatccagataccatgaaaagctatggggatctttctgtattctattatcggctccaacacatggaaatggctttgaaatatgtaaaccgtgccttattccttcttcattttacttgtggattgtctcaccctaacactgccgcaacatatataaatgtggctatgatggaagaaggcatgggaaatgttcatgttgctcttagatatctacatgaagctcttaagtgcaaccagagactgctaggagctgatcacatacagactgccgcaagctatcatgctattgccattgctctttcattgatggaagcttattcattaagtgtgcaacatgagcaaactacactcaagatacttcaagcaaaactcggaccagatgaccttcgtacccaggatgctgctgcctggcttgaatattttgaatcaaaagctctagaacagcaagaagcagcacgaactggaactccgaagccagatgcatcaattgcaagcaaaggtcatcttagtgtatcagatctcctcgattacattagtcctgatcaaggttctaaaggaagcgatgtgcagaggaagcagcggcgttccaaggtgttacagattagtgataaaacccatgatacacatcacaacttacaaacagatggtgctgtgtttattgatgcaacagataaagctacagcaactgtggatattaatgaaataggtaccctgacttctattcatcccgaagaaccagaggaaaccgataatatttctagtattgaggcaactgttacaactgaagttgttgaagatacaactttagatgaagggtggcaagaagccaattcgaaaggtcggtcaggaaatgccactggaaagaagtatggaaggaagaaaccagtttttgcaaagctaaaggtgaatggttgtgaatattcaaatggtagagagagtgggagtaggcgagacattatctcaccagcaggaaaaactgtcccgaagaacattataagggaaatgcaaacagtaaagcaatccaagtcttccagcttgaatcctagagggacttcaattggtttacctgcttctgtttccagaggttcctccccttcagcaaatcttagtgccattgcttcaaaatcactttcttacaaagaagtagctgcggcacctccaggtacagttctaaagccattatcggaaccaagtgagggaaaaatggaacagtcaatgtgcgctgagacagcaaatgtagagcatgggaacaacatctctgttgtcgatgatgtagtggatgacaatggtgaaactgaaggaactcatgatacagaaagtcagtcggaagaaactgctcctgaaattgataaggtgtcttcttgtagtcaggaaaaaggtttagaagcaaagcggagtaagctatcggcatcagctgaaccattcaatcccggagcactctatcaccctttaaactcagtttctgttacatgtgtctatgatgtaacagctagtcaaggcatgcttgttgagcctgttgtacctccagttgctgctcgagttccttgcgggccaaggtcgccattgttttacagaaacaataattcttacggtagctttcttagataccaaactcctattttggaacaaaatggatttggatctccgagagttatgaaccctcatgcacctgagttcgttccaagcaaaatttggcaaatgactggaactggtgatttgagtggctctgaagaagctatgaacacagaagtgaaggaagttgataagaagttgagtagggaagttaacggttctaatccaaaaaagagcagcgcagaggagaaatccgagctggcaaggcagattttgcttagcttcattgtccggtccgccaagcagaacatggatggtgaatgtgaggctttaatcaatgacaaaaggctcaaccattcccaaaactcttcggatgcagttacaagcgacactgcaataataaaaattctatatgggaatgaaggaaaggacttggattctcaatccagtagcaatgaagaaccaaaagcgttggatataaataataagaaacccggagatggcgaaggctttacagttgtaaagaaacggcggaaaaacaggcagcagcttactaatgaagtcactgggctatataatcagcaatccatatgtgcttctgtaaggtgaagaaataaccttaggaaaataacagtgtaagtgtcatcatgttccatttccagttttatttattatcatatccttgcttccatattaacaaagcaatttagagtgaagcctggttctttagttcctacttattttgagaacagcttggtgttatgctaataatctctgcaaattggttctcttgtttagagattttgtttgatcaataaaacggccaattcgtaatttcatacttcaatttttcattttggagtatttttgtagttttatggaaatactgtacccgggccctgtac

SEQ ID NO: 232 - DNA, 2035 bp, Gossypium hirsutum
tggccatgttgacttcacacttgaagtggaacgagctctcagagttttggatggagctatatgcttgttcgacagtgttgctggtgttgaaccggaatctgaaaccgtatggagacaagctgataagtatggggtacctagaatttgctttgtcaacaagatggatcgtctaggagcaaactttttccggaccagagatatgatagttacaaatttgggtgctaaaccgctggtgattcaactaccggttggtgcagaagataattttaaaggtgtcattgaccttgtaaagatgaaagctgtgctttggtctggggaagaattgggtgcaaagtttgagtatgctgatattccggctgatcttcaagagttggctgaagagtaccgatcacaaatgatagaaacgatcgttgaattagatgatcaagctatggagaactatctagaaggagttgaacccgatgaggaaaccattaagaaattaattaggaaaggcaccattggaatcagttttgtacctgtattatgcggctcggcttttaaaaataagggtgttcagccattactcgacgctgttatggattacttgccgtctcctcttgagttgccggcaatgaaggggactgatcctgagaatcccgaagtgataattgaaaggacagcaagtgatgaagaaccgttttccggattagctttcaaaatcatgaccgatccgtttgtgggatcccttacatttgtgagggtgtattcaggaaaacttgctgcaggatcttatgttttgaatgctaacaaagggaagaaagagagaatcggtagactattggaaatgcacgccaatagtcgagaggacgttaaggttgcattggccggtgatattgttgctcttgcaggtctaaaggatactattacaggtgaaactcttagcgaccctgaccatcctattgtacttgaacgaatggacttccccgatcccgtgattaaggttgctattgaacctaagactaaagctgatgtcgataaaatggctaatggtttgatcaagcttgctcaagaagacccttctttccacttctcacgggatgaagagatcaaccagaccgtaattgaaggaatgggagaattacatctcgagattatcgttgatcgtttgaagagagagttcaaggtcgaagccaatgtcggtgcaccacaagttaattaccgggaaagtatttccaaagtttcagaagtgaaatacgtacacaagaaacaatcaggtggacaagggcagtttgctgatattactgttcgtttcgagcctatggaggcaggtagtggatacgagttcaagagtgaaatcaaaggtggagccgtgccgaaagaatatattcctggagtgatgaaaggactggaggagtgtatgtgtaatggtgtccttgcaggttttcctgttgttgatgtacgtgccgtgctagtagatggttcttaccacgatgtcgattctagtgtattggcatttcaactggcagccaggggagccttccgagaagggattagaaaggctggccctaggatgcttgaacctataatgaaagttgaggttgtcacacccgaagaacatttaggtgacgtgatcggtgatctcaactcaaggagaggccagattaacagctttggtgataagcctggaggactcaaggtggtggatgcccttgttccgcttgcagagatgttccaatatgtcagcactctccgaggtatgacgaaaggtcgtgcatcctacaccatgcaactggccaagtttgatgtcgtccctcaacatatccagaacgagcttgctactaaacaacaagaagttgttgcttgattttgttgtttcataattttcctggcatccaaacactattttttgttcacttcataatttgaagtgcagcactctcctttctttaatttataagttccatgtatcagttttgggtataaatgtaacaaaactattgaagtagaaaatgcaacataaatcagaatttggggtttttacctatataatatt

SEQ ID NO: 233 - DNA, 1636 bp, Gossypium hirsutum
accctaaccctagccacatcttcacccaaatctttaattatttgcgcttttctcatcaaaattcatcaaatcatcggaatcgatggcagctaaaccgcttacaagtgaagcaatcgctctgacagaaaagaagatggacatgacattggatgatatcattagaatgtcaaaaactagttcaaataaaaccaagaagcagcaaagggtactgaataaaggtcagaaaccttttaataatgctgctaaagcaaaggctttgaaggttcaacagtatatggattcgcggtcctctgtcagacagggatttctagctcaaagaagatcaaacatcccggggaatcaatttcctttggcagctgaggctgcacgcagggctgcagttgccccagttcgaattaagaatgtaaatggtgtcagggtggctaatttgaacaaacctaggtaaataatggatcttctacaatattgatgacctctggaaagtggtcctggttaacttaattcaagttgcatgttatgtggaactccctatattttttattacttttcttgcggagaagtggcctaacttggtgttatcttgaaagtttagggtttttgtgcaccctacccaaaatagtatacttttagttctttatttccatgatgtgcaatgttcgttaatcagattaagtggtgctgattgtggaattggttttctgccatatgggatggatattgaagcatggagtagcaagtgttaaatgtgtttatcatgtttgaagcaggtggatctagagaagtaacattactaatttgataattgcaatcgcacaagagctgtatacatgcattccgtggaatgacattgttatgtgattggacaaactttttgaaatgtcaatttggtagtttgtttacatgcttatgtgtgctgtagctccatctgcttggtcattgccctgattttgattttcttcatcaattagctttggccacttaagattctttgactaacaactttagtcatttggaggttgcttatccatcaattttcacaactagttttaacctgtcagaggctatggtttaatcgaatgagccattttttctgagtctagcattgattcttcattcttccaatcatttctaggatgccacttaattgcctattttgtgactgggttttagctatgtttgagaaccttggattgatggtcacagtaatacatgacttgaaacgcatactttttggcaaagataacagtttgctgcctctggtgccatcttgaaattctctaggtagaagtgaagcaggaataataatggattgggaggaattttgaaagggacttggttgtttttatctagttattcggatgtaaattgacatctattatgcaatctttcatggcatttgcgagtgttgaatcttcttcacaagttggggtttggaggttactcaaatggaagtttactgtttgtctgacattctgggaaatctacccttgtgacttcccccagttccgctattgcattggagggttttctgtgtttttagtggtagcgcagcattcccagattgagcttaccagaaattcgatgagtacttgcaagcagatggtttgatttgtcttattttattgcttgttggaaa

SEQ ID NO: 234 - DNA, 2437 bp, Medicago truncatula
tatttgattttatggaaattttgaaggttgaatcgaggtcacataatgttcatcatgcacatggggaagaagagaaggtgatgacaaggaagcagaaggcagaatctaaggcacatgaagtagagcattctcctaaaaaggctaaggtggaagatgaaaaaaatggtcacactaatggaaaatctgcttctgatgttgtacaagaatatgatgagttttgtaaggccactaatgagcaactatctttggagcaaatgaaagagattcttgaggctaatgatcttgattcatctggctctgatcttgaaattacacgaagatgccaagacttgctgttttttggtgcattagagaaatgcatggtttgcaatggcaacatggagtttgatggaagacgttatggatgcagaggtttctacagtgaatggtctagttgcactttcagcaccagagaacctccaaggaaagatgaacctattaagctaccagattctgttcagaactctccagtttcagatttgctgaagaaataccaggatccaagtaaaaggcctcaaagggatttaggcttagctataaagccttttactggaatgatgatttctttgatgggtcgtcttaatcgaacacatttaaatttttcaggagcaagttgtttggtggcttcacctgccgagcgagatcgaggtggaacatccaaacttgcagatgccatggagaggggcatacctgtggttagggaggcatggttaaccgacagcatcgaaaagcaagaaccacaacctttagaatcttatgatcttgtttctgatctttctgtggatggaaagggaatcccttgggacaaacaagatcctggggaggaggctattgaatcactctcagcagaactcaagctttatgggaagagaggggtctacaaagataccaaattgcatgagcaagatggaaagatatttgaaaaagatgggatattatacaactgtgccttctccctttgtgaccaagggagaaaacttaatgactactgtgtcatgcaactgattgtcgtcccagagaattctttgcatttgtatttcaagaaaggaagagtgggggacgatccaagcgcggaggagcgactagaagagtgcgagaatgtggacaatgctatcaaagagtttgtgaggctctttgaggaaataacaggaaatgagtttgaatcatgggaaagagagaagaaatttcaaaagaaaccactgaagttttaccccattgacatggatgatggagttgaagttagacacggggcattaggtcttcggcagctggggatagcagcgacacactgtaaacttgagcctatggttgcaaattttatgaaggttttgtgcagccaggagatctataagtatgcattgatggagatgggttatgactctccagaccttccaataggaatggttacaaatcttcacttgaaaagatgtgaggaaattctgttggaattcatagagaaagtgaaaacattgaaggagacagggcccaaggctgatgctatttggtctgattttagccagaaatggttcactctgatgcactccacaaggcctttcatttttagagattatcaagagattgcagatcatgctgctgcagctttggagggtgttagagatataacccttgcttctcacctcataggagatatgagtggctctaccattgatgatccattatcagacacatacaagaaattgggttgctcaattactcccctggagaaaaattcaaatgattacgagatgattgtgaaataccttgaaaaaacttatgaacctgtcaaagttggtgacattgaatatggggtgtcagttgaaaacatcttcactgtggaatcaagtgcttgcccttcttatgctgacatagtaaagatgccaaacaaggttcttctatggtgtggatcgcggagctcaaatcttttgaggcacttgcacaaggggttcttgccagctatttgttcactacctgttccaggctacatgtttggcaaagccattgtttgctctgatgctgcagcagaggcagcaagatatggttttactgctgttgacaggccagaagggttcttggttttggccattgcttcactaggaaatgagattaccgagttgaaaagtccacctgaggacacaacatctttggaggaaaagaaagttggagtgaagggacttggaaagaagaaaactgatgaatcagagcattttgtttggaaagatgacataaaagttccttgtggtagcataattgcctcagagcatgaagatagccccttggaatacaatgagtatgctgtctatgatcccaaacaggtacgtataagctacttggtgggggtgaagtatgaagagaaagatgccgtgatagacacggcagagtgaaaggcacaacagaatga

SEQ ID NO: 235 - DNA, 508 bp, Medicago truncatula
ctgctttctaacctaccatacactccatacacccttgacaggaagtggtcctactcctggtcctgtactagtttatcccagtgagatggatggtgtaccaaatatttccatacctacttttgcaatggctgcctataaattaaagggatctatttggatgaaaaaagaagttagtgagaatcaagtaatgaattccctcgtgcaggctgcagataaatggttaaggctagttcaggtgaatcacccggatcatcagttctttaaatcgcatggcacatactacaaatgaattgaatgatatggcgtgccagttatattccctcggttaaaattaagccttaatttcattgccgtggtgcaaactttattaaagtccatccatctgtagagattgtgatggcacggttgtgacagcctaattgtaggtttttcttatacgcctaagcagcacaaaagatgaaactgatctcaagcgatgaattcgttgagattgccaaagcgaagacat

SEQ ID NO: 236 - DNA, 843 bp, Medicago truncatula
gcacgaggcacatacattgcacacaagcatagcacacctggtgacaactattgctcaagtgaagctcactaaattcctatctaccaaccaacagggaaaaataatatcatggcacctgctaatacttctgctgctgctttatctgaaactgaatatgaaatggtgaaaaacatcattgacattgaagttctagaagagttaagtttagcagattgtagcatctacaaggttcctcacaatctccgaaaagtgaaacaagaagcttacactcctcaactaatctcaattggtccaattcaccttggaaatgaagaacttcaaccaatgcaacaacacaaaaaaaggtatttccatttcttctatgagcgtctatctcaattcaatcaacaatccatgatcaagaactacaaactctatctcgaaaacaaagaacaagaaataagaaaatgttatgcagagaaatttcccaacataagcaaagagaaatttgtggaaacaattttgttggatgctgttttcatcatggaacttttgttgagaaacagttcatggaagtcggatacatcaaaacatgaacatgaatacaagcaatccaagtcatttagatggaaacatagtgatgattacattctaacacaagcttggctcagcaaaagcatcacaagggacttgattttgttggaaaatcagatacctttttttgtattgaagcatctttatgacactgtcgtcccgaacgacgacaaaaaaccaaatcatgaagattttcttgatcttgcactcgagtatttttgcattctacgacactcagaaatcgtcatcacttgaaacgaagtttgtttt

SEQ ID NO: 237 - DNA, 1173 bp, Medicago truncatula
aagaagtgggaacagttggtggtttgttatttcaatggagaaagcagcaagcagtgtgttgaagcagatgaacatcaccagtcgtcttgttcttcccggcagttgctgctgttcttcctttcaatcttcatcttcttcatctctccactttccattcccaatctctgttccattcaaattccgcagcagaagatcaactaactctgtttctgacgctgcttttcctgttccatcttcagtgattaaggttgctgcgacggatttatctcttgcggtgaagaagaaagcagcagatgtatcccctgagctgaaagggtcctccatatttttgattggtatgaaaagctcactcaaaaccaatctgggaaaacagctggccgatgtattgcgatattattattttgacagcgataatttggtagaagaagcaataggtggtgcatcagctgcaaaatccttcaaagagagtgatgagacgggcttctatgactctgagactgaagtacttaagcaattgtcgtccatgggtcgactagtagtttgtgctggaaatggcgctgtacaaaattcaactaatctggcgctcctgagacatgggattacattctggatagatttgcctttagaaattgtggctagggatgtaaccgaaaacccgactcaatttccttcgtttgagatatcaacttcaggatcttacccagaggtaatggatgaactgtgtgctctatacaataagtacaaagatggatatgctacagctgatgcaattatttcacttcaaaaagtagcttctcggttgggttatgaaagcttagatgacattacaacagaagacatggctttggaggttctcggggagattgagaagttgactagagtaaagaagatgatggcagaagctgcaagaccattttaatcaacccgacaaatacttcagttacgaatttcggaattctaaaagctcttagggagattgagaagttgacaagagtaaagaagatgatggaagaagctgcaaagaccattttaaccaacctgggccatgcttccatttacctgtcatttcattattctaaaagtatttttgaatttgtttacatccgatctttgattattcgaataaaatgatactagtttcatttctaaaaatataaaattactcattcatgt

SEQ ID NO: 238 - DNA, 698 bp, Medicago truncatula
ttcagatctgcctccaattgagaacgatgaaaaccgggatgacatggaatatggcggacctccgttgaccgagttccaaaagtttattagattaagccaaaatgaaatgttgggtggttcaattaagaagaaatctccaaagtccctgcttcatgatcaccgctcttatgaaatgaacgttgatgattatcaacgcgcatgtcgaatcccgaaaaggaagggagcatgctttagagatttaccgtgtgttcgtatgcggaacaaaaaagttgaattgaatcctgatgtggagcgtgaacttttgccttctggaaaacccctggttcccaactatgcaatttcttttgtgcgtggaacttcaccactgccttttgctcggatatggtgggacgagactgttcctactgttgtcactcgaccagaaccccataatcaaaaaattctacatccagagcaagatagagtgctatccgtccgtgaaaatgctagattacaaggttttccagacttttataagctttgtggatctgttaaagaaaggtacattcaagttgggaatgctggttgcggttccacttggcacagctctacgatattgtcttggacttgcatctcacggtgcttctactgacgggcctttgtacaccctacctgatcattttccaaggaaaaaagcttccattgcggcatctgatcaa

SEQ ID NO: 239 - DNA, 1603 bp, Medicago truncatula
tgttcttttgctatgaaacaggcaacaagcaagctttgatatcgttgtcagacaagaaggatctcgcatttgttggaaacggactccaggaattaggattcactattgtttcaactggaggaacagcttctgcattggagagtgctggagtggctgttactaaagttgaacagcttacgcagttccctgaaatgcttgacggtcatgtcaaaactcttcaccctaacatacatggaggtatccttgctcgaagagaccaaaaacatcatatggaagctctcaatacacatggaattggtacttttgatgttgtgatagtgaacttgtatccattttatgataaagttacttcagccggtggcattgaatttaaggatggaatcgaaaacattgacattggtggtccagccatgattcgagctgctgcgaagaatcacaaggatgttttggtagtggttgattcagaagactaccctgcccttctagaatttcttaaaggaaaccaagacggacagttcaggctaaagcttgcatggaaagcttttcagcatgttgcttcatatgattctgcagtagctgagtggttttggaagcaaactgggggagataaatttcctcctagtttgacagtgcctctttcactcaaaagttctctccgttatggtgaaaatcttcatcaaaatgctgcaatctattttgatagaagacttgcagaggtcaacgctggtggaattgctacagccatccaacaccatgggaaggagatgtcatataataacaacttggatgctgatgctgcttggaactgtgtgtgcgagtttagaaaccccacatgtgtagttgtgaagcatactaatccttgcggcgtagcttcacgtgatgatattctggaagcctacagacgagctgttaaagctgatcctgtcagtgcatttggcggaattgtagctttcaatgtggaagttgatgaggttcttgctaaggaaataagagaatttagaagccctaccgatggggagacaaggatgttctatgaaatagttgttgcacccagctatacagagaagggacttgagattcttcgtggaaagtcaaagactctaaggattctcgaagcaaaaaagaatgaaccaggaaagctttcactcagacaagttggtggagggtggttagctcaggattcagatgacttgactccatccgacatcaagttcaatgtagtctcagagaagactcctcaggatggtgagcttcacgatgcagagtttgcatggttgtgtgtgaaacatgtcaaaagtaatgctattgtgatagctaaggacaattgtatgttaggtatgggaagcggacaaccaaaccgtgtcgagagtttaagaatagcaatgaggaaagctggagctgctattaaaggagcagccttggctagtgatgctttcttcccctttgcttggaaagatgctgtggaagaagcatgtgaaagtgggattggtgttattgcagaaccaggtggtagtataagagatcaggatgctgtagactgctgtaataagtatggtgtttcactactctttaccgatgtgaggcacttcaggcactgatcatt

SEQ ID NO: 240 - DNA, 3575 bp, Sorghum bicolor
atggacgccgcggaggcgtcggagctgcaggcgcggctggccgcggccgtgcacgcgctcaaccacgacgcgagcccctccgcgcgcctcgccgcaaaccagtggctcctcgcgctgcagcggtccccgcaggcgtgggcagtcgctacctccctcctggccgccccggacccgcccccgcccgccgacctcctcttcttcgccgcgcagatgctccgccggaagatccagtcccccggctccgctttccccgcgctcggcctggcgccgcagctcctcgacgcgctgctcctggcagcgcggcggttctgcgccgccccggccccgcgccagctgctcacgcagatctgcctggcgctcgccgcgctcgcgctccgcgccgagggcggcgtcgacggcctcttcgcgcggatgccgcacctgccgcccccagccgtgctggagctgctcaccgtgctccccgaggaggctgcgcaggaccagggcggcgacacgggggtcgacgccgccgcgcggtgccggttcacgcgcgagctgctcgcgcacgcgcccgccgtgctcgagttcctccacgggcaatccgagaaggcacccaccgatgacgatggggttcccctccacgagcgcaaccgcagaatcctccggtgcctactgagctgggtccgcgtggggtgcttcttggagacgccggcagctgcgcttgccacgcacccacttctcacttttgcgttcaactcgctgcaggtgtccttctcgtttgaggtggccatagaggttatgattgagcttgtcagccagcaccaagaaatacctgaggcctttctgagtaagacaccttatataagggaagttcttcttctaccagctttagccaaccgaagtgagaagatcattgctggtcttgcctgtttgatgtgtgaagttggccaggcggcacctgctttggttgcagaagggggtggccaagcacttgctctcactgatggacttttgaggtgcagtttggcacattttattcttggtattgatgtgaagacagccaaaagaaatgtggtacgagagttgtttgtgcctgtgttttcttcactgctggatgctcttttatttcgtgctcagatggacactgattctgatggagcaccttgtatacctgagggactaacacagttcaggatgaatttggaggagctcctcatcgatatttgtttgcttctaggtgcccctgcatatataaacaagctcttttctggtggatgggacttctcaagccaaacaattccttggaaggaggtagaagttagaatgtatgcactcagcatgtttatgaaggtatataaatcgtttggtgatgtcattggttcgtactcaaagtggctatcgtcttctcaaagtaacattaagcccttactcctgttttgtgcgtcaggaatttcaaaatctatatcatcaaatgcttgctcgttagccttgcgcaaactttgtgaggatgctccttcattcatccatgaacctcagaaccttgaaattcttttctggattagtgagggcatgaataaagggaacctgcagctagaggatgaagaagagataattagtgcaatcacacatgctttaagttctgttagtgaaaaagagttgaagaaaagttcactggccaggttactttgttccagttactcagcagtggaaaagattattgacatagacagagatcaatcgctaaggcaaaatccagctgcttatacacaatcgttggatcttgctgtccgtggtctttacaggatgagtgctttgtttcatcatttggctacatcagtcacatctggtctggttgatgatgatataattatagttcttcttggaatactttggccacttcttgaaaagcttttccgatcatctcatatggagaatgtgaacttatctgcagctgtatgtcgttctctttcttctgctatgcattcttgcggacaccactttcatattttattacctaaagttatggagtgcttatctgcaaatttcttgctgtttcaaaggcatgactgcttcttgaggacaggcaaggagctatacttttatgcacaactatttttttttgcttccaaaattctattaaaaaaagattattctctgcaccttgtcataacaagggttaatactgccaatgttattgaagagtttggccacaaagaagaatatggggctttatgtgttaggacttttgaaacacttagctctgcatcttcaatatcagctctgaattcttcttatacctgtgatcaagaaccggacctagttgaagcatatacctactttacatctatgtttattcgctgctgtcaaaaggaagctattgtggcatctagctccctgcttgagttatcatttcaaaaggcagctatatgctctacagcaatgcaccgaggagctgcacttgcagcaatgtcatatatgtcgtgttttcttgagtctgtccttgctgctgtgctagaatctcctgagtgcatccctaatgggtcacctggtgtggccttaatccaaatattggcacgctgtggtgaaggtttattatctaatgtgctttatgctctacttggtgtatcagcattgtcaagggtgcataaatctgccacaatattgcaacaactggcggcattgtgcagtttctgtgaggcaacggcatggaaggctgttcttagttggaattctctttgtgggtggctacaatcgacggtgaaatctttgccttcggagtatctaaagcaaggggaagctgaaatgatagttccattgtggctcaaggtgcttcaggatgcaggctcagactatctttacagcaggactggtgataatataagaagccatcaaggttacatgcaagggaagggtggcagaactcttaaacgcataattagagattttgcagaaagccaccggaatgttccaattcccagtacttcatgatatggatccccagtgctgacagtagcttggagtctgactctagagaagggtccttgtggaactgatgtccgtctttgctggcatgctacatgttgatcctgtggttccatctattgtttggcaagaggaggctatttgcttgttccgaacacctggttctgactcggagagtcttctttgtatagcaaggtagtcacaccattgttctgctgactacttagagttgaatgttgtggagccacatgggcctacaagactggtggtcatttccaaagttggaaggcatgtcatggttcgagatccaatgtttttgatggaaacatggatgcatgatgagacatactgtgaaaatcattgcgctggtaagctatgaagacaaaatgtgggagacgaacgcatagttgtacataccattctttggtggttagggcaggcgatgtacaaaacattcatatgcagtgttactgctcgaattttgagttaaacatgggcagtaatgcttggcatttaattaaacctccatcatgtcagtttaacctttgaacaagtgtacataatcaaatatattatccaatgatcataattttatgagatggctctattatgtt

SEQ ID NO: 241 - DNA, 2351 bp, Sorghum bicolor
caatccccatccccaaatctcccatggcttcttcccctcccccaccgcccatccgcaccgtcctcgccgccaccctgctcctcctcccgcacaatgccgccgccgccgccgccgtagccgacgcgtcgtctgcggtgaacccgttcacggcgaaggcggcattcatccggtactggaaccgcaaggtgcccaacaaccgcccgcacccggccttcttcgtcgccaagctctccccgctcccggccgccgactccgcctccttccccaccgcgctgcccgacatccgcgcccgcctccccgagctctgcaccaaggccgcgctcctctgccccggcccggctaccaccgacgcggcatcgctggcggcatcgggccccagaggcgggggcccgttcaagggctacagcaacgccaacttctccaactacggcaccggcggcgtagcgggggccgactcgttccggaactactccccggacctcaacatcgccgccgacagcttccgccgctacggccgggactcgtcgggacgcgccgacagcttcgcctcctacgagtccgacggcaacgtcgtgaccgccaacttcacctcgtacgccggcggcgccacgggcgggtcgggctccttcgccgcgtacgccgcggagaccaacgtcccggactccaccttcaccaactacgacgccggcgccaacggccgcggccggagcttcgcgtcctactcccaggaggccaaccacggggagaacggcttctccggctacggcaagagcggcaacggcgtgcgggagacgttctcgtcctacggcaacgagtccaacgtgctgggctccggcttcgccaactacgggcagtccgccaacggcgccacggacacgttcacggggtacggcgtggaggggaacgtccccgagaacacgttccggaactacggcgccggcgggaacgccggcgtggacaccttcaagaagtaccgcgacgacgccaatgtcggcgacgacaggttcacctcctacgccaagggcgccaacggcggcgcggcggagttccagagctacggcaactcggcgaacccgggcagcaccaccttcaagggctacggcgagggcagcaaccccaaccaccacattgggttcaaggagtacgccggcgagaacaacaccttcaaggggtacgccaagaccggcgtcagcttcaaggagtaccacaacacctccagctctactgcggcgctgacggtgtcggcggaggcggcggcatcgatgcagcaccacgaccacctgaagtggtcgccggagccagggaagttcttcagggagcaggagctggtgtccgggaaccgaatgccgatgccggacatcagggacaagatgccgcccagggcgttcctgccccgcgccatcgcggcgaggatccccttcgatccccaggccgtgtcggaggcgttcggtctccccctggacacggcgctggggaaagccgtgtcgtcgacggtggcggagtgcttgcgcgcgccgagcaagggcgagacgaagcggtgcgcgacgtcggccgaggacgtggtggactttgcggtggagacgctgggcgacgacatcgtggtgcgcagcacggcgtcgacggcgggcagcggcggcgacgtccggctcgggacggtgacgggcgtggacggcgggaaggtgacgcggtccgtgtcgtgccaccagagcctgttcccgtacctggtgtactactgccactcggtgcccaaggtgcgggtgtacgaggccgacatcatggccgccgccgccgccgccgatgatgatggtggctcggacgccggcgagaaggagatcatcaaccacggggtggccatctgccacctggacacgtcggactggagcccgacccacggcgcgttcgtggcgctgggcgggaagcccggcgaggtggaggtgtgccactggatcttcgagggcgacatgacgtggacagtcgcggattgagtgacgacgttcgttctcctgccctgctgctagcgggctttgcaagatcacaacaagactgaactactaagaagaattattttctctctcgcaattaattttttttttattttcactcctttcttgatctaccttatataacgaacgaaggtggtaagaattgtgcgattggtgcaggaggagaaaaaaaaggtttggtgatgatgaaaactgtaaaactgtaaaaatcttgggtgggggatggaatggaatagctggcgatgtgattgtcttgatcaaattgctgcttatggtcaatggtggtggtgcaactgcaaacaaaggaattagttataattccaaaacaaaagcttggtcaaatttgag

SEQ ID NO: 242 - DNA, 2241 bp, Glycine max
gaggatttgatgaatccaatgggtgctagtactgtaagcaacgaagaactcaaagagatcgagagtctcgggagagaggacattgaagaggctccaattgtgcccgaggatgtgagcagaatagcaccatggataagacagattacacttcggggactagtagctagcttcctgattgggataatttatagtgtgattgtgatgaagctgaacctcacaactgggttagttcccaatctcaatgtttcagctgctctccttggctttgtgttcattagagcttggactaaggttcttgcaaaggccaaaattgtttcgaccccattcactagacaggagaacaccataatccagacttgtgcagtcgcttgctatagcatctcggtaggaggtggtttcgggtcttatctcttgggtttgaataggaggacatatgagcaagcaggagttggtacagaggggaataatcctggtagtaccaaggagcctggaattggatggatgacagcctttctctttgtgaccagctttgttggattgttggcgttggttcccattagaaagattatgataatagactacaaattaacttatccaagtggaactgctactgctgttcttattaacgggttccatactcctaaaggagatgttatggccaagaagcaggttcatggtttcttgaaattcttctcagccagtttcctctgggctttctttcaatggttttattcgggtggtgataactgtggatttgttaagtttcccacttttggattgaaagcatggaaaaattcattttattttgatttcagcatgacttatgtgggagcaggaatgatttgttcccatcttgtaaatttatccttgcttcttggtgctgtgatttcatggggcattatgtggccattaatcaggggactaaaaggggaatggtttcctgcaagcatagcagagagtagcatgaagagtcttaatggttataaggtttttatttccattgctttgattcttggtgatgggctttacaattttgtcaaagtcctctatttcactgccacgaatattcatgccaccgtgaaaaggaagaaccccgaaactttttcagataaccagaaaccactccctcttgatgatcttagacggaatgaagtgtttgctagagaaagcattcctatatggctggcctgtactgggtacatattattctccatcgtttctatcattgtaatccctttgatgttcccccagttgaagtggtactacgtggtgtttgcctatctttttgcgccctctcttagcttctgcaatgcttacggcgcaggcttaactgacatgaacatggcctataactacgggaaagtggctctctttgtgctagcagccttggccggaaaaaatgatggcgtagttgctggactagtggggtgtggcctgataaaatccattgtttccatttcatctgatttgatgcatgatttcaagactggccatctcactttcacttcccctcgctcgatgcttctaagccaagcaattgggacagcaataggttgtgtagttgctcctctcacattcttccttttttacaaggcttttgatgtggggaacccagatggggactacaaggctccatatgccatcatatatagaaacatggcaattcttggtgtggaaggattttctgcccttccacatcattgcttgcagctttgttacggattttttgcatttgccatagcagccaacttggtcagagatctagcccccaaaaacattgggaaatggattccacttccaatggcaatggctgtccctttcctagttggtggttactttgccattgacatgtgcatgggtagtttggttgtgtttttgtggcacaaactaaacagaaatgaggctggtttaatggttcctgcagttgcttctggtttgatttgtggagatggattatggattctcccttcatctattcttgctttgttcaaaattcgtcccccaatctgcatgagcttcctgtcagccagtgccagttagaagttcacaataacattcaaatatatgcagtcaacaacttagtacctacggtcattatgggcataatgtcgtaggatgcttgcttattagcaatttcattcacaaagattctgctcttggagaatcttgagcgatatgtaaatatttttacatactttattagagaaactaatcaattcgagcggaccttccacctctcta

SEQ ID NO: 243 - DNA, 1801 bp, Glycine max
gagatgaagcagttcatcacacacaacatgcactctcatcataatcatccacgcttcttctggttccaaagtcaacggattatgttccatgtttttgaaatccaacggtgttgatcttaggtgtaggaagtagcttgtgaagtgtttgcagattaagtgtccttctcttcagttatttatgggatgtgtaaagagaaaaaaaggatcataattaacttgttagcattggcgttacagagagagagagagagagttattatggtgactatggaagagagtccaaggagcccagaggcgaagctggggttgcgagtggaggatctatgggacattcaggaaccacagctaagtcctgatgagaagttcaatgcttgctttgaaagcatacctgtctctgccttccctccacctccttcaaatcaagaaattgagataaaatcagatgccaccctagccgaggcagtaaaaatacttgcagaacacaacattcttagtgcacctgtggtggacgtagatgcacccaatgatgccagttggattgacagatatataggaatagttgagtttgctggaattgttgtttggattctgcatcagtctgaacccacatctccaaggagtccatccggtggagctgctaatacggctgcagtgaatggaataacttctgaagcattcggccttgaatctgcttcgacaacttcaggcaatttctttgaggatctgacttcttctcaactatataagaacaccaaggttcgtgacatttcagggtcattccgctgggctccatttctcgctctggagagatcaaactcatttttgaccatgcttttgctgctttccaagtacaagatgaagagtattcctgtggtggacttgggtgcaggtcgaattgacaacattattacacagtcttctgtaattcacatgttggcagaatgtgctggtcttcagtggtttgagagttggggaaccaagaaactgtctgaagttggtcttcccatggtgacaccaaatcatattatcaaggtttacgaggatgaaccagtgcttcaagcatttaaactgatgaggaaaaagaggattggagggttgccagtgatggacaggggtagcagcacggcaattggtaacataagcctgaaagatgttcaattcctcctaactgctcctgaaatctaccatgattatagatctattacagcaaaagacttcctgacagccattagaagctacttagagaagcatgaaggggcctttccaatgtcaggtgacctgattacatgcaataaggattgcacaatcaaagaattgattcaactgcttgaccatgagaagattcatagggtctacgttgctgacaatgacgggaatctggaaggactaatcacactaagagatatcatctcaaggctagtacacgagcctcgtggctattttggtgatttctttgatggggttctcccaatgcctccaaacagcagggtttgaaatgctttcaggaagaataagttctattccataagtaacaaattgatgtgtttctcatcagagctgacgacaagatcctagcccctttgtaacatcagcacctagcactttgcaagttacttgctctcgttttaccgtaggtgaaactgtgaaattttgtgtaaattttgacgtaataatttggagttttggtcacatttttcttttgaacaagttgatccttaatctcatgctactctgcaattaaaagccagggaacttaacggaaacacaagttggtgcccccgaataccaacatttggtaccc

SEQ ID NO: 244 - DNA, 2673 bp, Glycine max
atgacaaatggtagaatgagaaggaaatttttttcaagctgcgtgggtcctacccagatacaggaactaactccacaacacaatctcattcgatcatcaatcctcactcgtggatttcaatctcgttcagttcctcccattttcatacacaaatcattttctttatatttctgcattgctttgagtggattttgcataatcatattatcaatttttcattcatttgtaagtgggcatagaagtaatccggaaaggcgaagggataaggtttacattggttgtggagctgggtttggtggtgacaagcccttggctgctcttaagttgcttcaaagagttcaagaactaaattatctggttcttgaatgcttggccgagcgaactcttgctgatcgttatcaaatcatgatgtctggtggtgatggttatgattctcagatttctaactggatgcatatgctgctgcctctggctttggaaagaggaacttgcataattaccaatatgggtgcaatggatcctctgggtgctcaacagaaggtcttagaaatagctaacagcctgggtctcaatgtttctgttgctgtggctcacgagaatttgggggattttcttattattctttgtgctaagttctacaacttatatattcatacaacatctttcaggttcaggattttcaccagcaaaatcatatatcatggagggtgtaagaatctgttctcacgacccatgaggctcacctacttgggagctgctcctattgttcgttgccttgaaaagtaccaaccaaatgtaataattacatcgagaattgctgatgctgctttattcttagcacctatggtttatgagctaggatggaactgggatgaattagaacatctagctcaaggatctttggctggccatcttctagaatgtggttgccaactcacagggggatatttcatgcatccaggagacaagtaccgagatatgtccttccagcaactactggatttatcactgccttatgctgaaatctgttttgatggccaagtatgtgtatcaaagtctgaaggaagtgggggagttttaaattttaatacatgtgctgaacaattactatatgaggttggagaccctggggcttacgtaacccctgatgtggtgattgattttcaggatgtttctttccttccattatcaagctctagagtttgctgtcatggagcaaaaccatctactatttcagttcctgataagcttttgcagttggttccacaggattgtggatggaaaggatggggagagatatcttatggaggttatgaatgtgttaaacgtgctaaagcagcagaatatctggttagatcatggatggaagaaatatttcctggtcttaatcaccgtatactttcttatataattgggtttgatagccttaaagctaccagcgggaatggaaatgagtcatcacagacaactagtgaagataataggctacgcatggatgggctttttgaacagaaagaacaagccatccaatttaccagagaatttatagcattgtatacaaatggaccagctggtggtggtggtatcagtactggatataagaaagagactcttctagagaagcatttggtaaagcgggaagatgttttctggcgaactgggataaagaggagcacaagaagtcagtcaaataaagtagttgatcctgaccacaatctgaggcacatattgacattgccaccgaagctacaagctgaaacagacaaatccttggaatctgtttctcttggtagtagttgctcacctgctccatctggccagaagattccactttacagtgtagcacacagcagagctggagataaaggaaatgacattaatttttccctcatcccacattttcctcctgataatgagaggttgaaactaattattacatctcaatgggtaaaatcagtggtctccaatcttctggatttgtccctttctcctgatttagatgcaaaaattccaagagataaatgggtcaatgaaaatgttaaggtggagatatatgaagtcaagggaatccagtcattaaacattgttgtcaggaacatactggatggtggtgtcaactgttctcgacgaattgatcggcatggaaagaccatttcagatctcattctgtgtcagcaagttgtgttgcctccttgattgtgtgatttactaataaggtggcaatgttctcctgaatggaatgaatagagcattgcaaaacttagaatgatagaatttattgaagcttggaagtgctttaattgaagtaggactcatatggggagggaggaatccattttgtgctctttagcctacacattcttatgataataattagcaaaagctgtgctgtagccacatcatcctttttaaagattatggtgggaagcattttgatctttagattatgttgtttctttttctttgtaatctactacataactagcttctattttattttttaaactttgttctgtagtttgagaactaagttttttggcttagtagaaatttgagaagttagagaaagatggagaaaagacattaagatgtaccaagaagagcaccaacacaagtgagattaactcatacactatacttaaattagtaagattaacacaaactatacttggg

SEQ ID NO: 245 - DNA, 1053 bp, Glycine max
tacactagtgcggttgtgtgttctgttgttgtctccgttcattacatcgtagctccgatcaccgagaatgcgtagtctcgctgcacctcattccttccgggttttcgtcaactcgcccatctttcgccccattaagcttccttttctcactctcaaccctctctcttcaccttccagaagatctccagcttccgttcaatgcgccgttcaattccgcccctgcatcgacatccacaaggggaaagtgaagcaaattgtggggtcgacccttcaagacttgaaagggggtgacggttcggatcccgtcaccaatttcgagtctgataagtcggctgctgagtatgccgcgctttacaaacaagatggactcactggtggtcatgtcatcatgctcggagccgaccctttgagcaaagcttctgcccttgaagcattacacgcttatcctggcggtttgcaagtcggagggggaataaattctgacaattgtttgagttacattgaggaaggagcaagccatgtcattgtgacatcttatgtattcaataatggacaaatggatcttggacggctaaaagatcttgttcaaattgtaggaaaagacaggcttgtgttggatctcagttgcagaaaaaaggatggtaaatatgcaattgtcactgatagatggcagaagttcagtgatgtttttgttgatcctgatgtaatggaatttcttgccaattttgctgatgagtttctggttcatggtgttgacgttgaagggaagaaggtgacagaatgcactggaagaaataaaacaacagaggagaatggaaaccagattcctgttacttatgctggtggtgtgactgaaatgtctgatctggagaggataaaaactgccggaatggaccgtgtgaatgttactgtgggcagtgcattggatatttttggggggaacttggcttatgaagaggttgtagcttggcatgcccagcaaaatgcctctgcagtttaattagtatgttttcttttagttgggggctgggactggttagcaaggatttgttt

SEQ ID NO: 246 - DNA, 3035 bp, Glycine max
cgattcgaaactaactaatttctatcttcttctcttcgcgtagcgcgtcgtcccccgcaacgacgtcgtttcatggtcgcgttgttgttgtgctggttctctatgcgaaaatcttctgagggcttctcggcgatgagtggagtaattcattctctggtgtttgattccgcatttccatttctaaatttctctgtctcccatgtaagaaatgtttgattggaacgacgaagagcttgctaacatagtatggggtgaggtgggtgagggtgatgatcatattgtgccttatccggaggcaagtgaagatcttaatgacaagaaagaatggagtcaggaagcttctgctactaaactgattgaccagaagagaatagaggctaaaactgattttcatcaaggaaagctcggaagcagttccaaacttgatataattgagggacaatctgcctcagaatctggcacaaactcatggcctgatttatctttatccactgcggctaaaactgatcagggttccctgggtgctgctgatgtatctaaaactttagaagagactacacagcttgaaaaggatgtagaaaagcaaggtgattttgtcaactatgcctgggataacataggaagctttgatgatcttgatcgaattttcagcaatgatgacgaccctatatttggccatgtaagtcttgagaattctgatgagctgtggtcttccaaagacgtgagtaacagcacagtacccatactcttggagacaccaaacccaacaagtgctttaaggaacagatctgagcctttggaaattaaagcagaatatgtccaacagaatgatcgatcattttcccccagatttaagaggattggcgattctttatctcatgatattgagaaggctcctgcaaacatattcaatgtaggatatgatagagatagaattgccccggctgataaggagcaacaggtctctgacaggggcctatggcctaactacatcagaccaatgattagagggcttattaaaagagaccagattgaaggaataaggaaaaccgtcccccaaggaaaaccgtcccccaccggggacctactgtccccgacggacctgtctgattttcgcatttattccgtaaaaaataaaataaaattggacactgtaaaaacatgttcgtcacatgtccactgtgttttggtgttgaaaacatgtcggggtgtccgacacatcctcagccggtgtgtctgtgcttcatatgcaataggctttattgtccaatctatttttgtgctttctgaggattttgggcaaaataatcagttgaaagctcggaaaaaatcacaaggtaaactagagggaaaatcattgaaggagttttatggtagctggtctccttcatcaactacatctggacaatttcagaatcagctggtgtcttcagtcatacagtcttctccctcttcaattcttgggcagtggaatgagcttcaaggacctgagacactataccaggacatcacaaatacatatgtgacatcctctgcatatgggaaccttacaaatacatattcttctatgtcaatgctaccacaggctcagtcaggagttcttatgcgacagcctctgctttctcgctatgaagcatctcttggtgttatgaatcctgtgagcaagtctgtggacttagttaagcctcttacaatgactccccaggaaaaaattgaaaaattgaggaggcggcaacaaatgcaagcaatgcttgctattcagaaacaacagcaagaattcggccatcaagttcctagcactaataaatcaatgaatgaaaaatgtgccatagaaatccatagtcaactctgtgatggggctgatcctgaaattgaagatttaagaacagctctagatccaccaactgagcaagatgattctaatacaatgtctctggcaattgatgatcattttgttgaagacaccatactgtacatgcttcaggatgctatatcaaagttagatgtcaaaataagactatgcattagagatagcttgttccggttggctcaaagtgcaatgcaaaggaattatgctaatgatacaagcagtacaaacaacactagcagagaagaacttaaagttgctgcaagagaagaaagcaatagccaaaacagatatgctaggattgctgatgttgaaaccaagacaaatcccattgatcgaactgtggctcatttgctctttcataggcctttggagttaactgggaattatcctgataagcttgagtcacctatttctgctaagatacaatttgaaagcagagaagctaacatggagaagtttcatatgggatgcttgccagatgaggacttgaaaagtaatcaacaattttctcaccaagggcttgaggcccagcctgaggaccaatttaaaaacagtcgttgcatagacacctcagagaatgcttctaacaatgttctagctgatgctggagatcaggtgcttgaagccttgcaatgaagaaaaagtctcccctggaattggaggctgtctggatcataatcaaggcaaccgttgaagtctatcatcacataactgaacacctgtttctcatgtgtatgttatcattaatatttatgtttcgtctgtcaaaatcttgacagtatatgtatctcagcatatgaacttattcagcttggtgagtgacttatgttaataatgactttgtcagacttgtctagtagtaagtaaatgccaataatgttaaagactacgtcagatttgtgcagtagtaatgccactcatgtcaaatagtcaagtcttcaccagactggtttggaccaagcttaaagttggtgttgtattcctgtactatttaactcgttttagttgccccacatcaatagctaacctgtggactgtcatattgagattgagtcttgatgtcagattgtttttttattaggtttatttatgtttctggtttgagcagttggtcatgggttcaaatagagaagaatctttgcatttgcaagggtatgattgtata

SEQ ID NO: 247 - DNA, 1348 bp, Glycine max
tcaatacaataactagaaatctagaatggctttgaagcttgtaaatctagggtttcactcatcgattccgtgttctccgaggcccttgaaagatcggttcgtgcttcggtcttctaaagtggagcaaatatcgtttacggaatctgagaactcactcatcgaagcccttcttggcatccaaggacgcggacgttcttcttctcgtcagcagctcaatgctgttgagcgtgctgttcaagtcctggagcggttagggggtgtacctgatccgacaaaatcaaacttgatcgagggtcgctggcagctaattttcaccacaagaccaggaactgcatcgcccattcagagaacctttgttggggttgacttttttagtgtatttcaagaggtttatcttcgaacaaatgatccacgcgtatgcaatattgtgtcattttctgatgctattggtgagctcaaagtggaggcagcagcatcaattgaagatggaaaaagaatcctttttaggtttgacagagctgccttttcttttaaatttcttccattcaaagttccgtatccagttccatttaggctgctgggagatgaagcaaagggttggttagacaccacatatttgtcgagttcaggaaaccttcgtatctcaagaggaaataagggaaccacatttgtgttacagaagcaaactgagcctaggcaaaggttattgacagctatttcctcggggaagggcattaaagaggcaatagatgaacttatttccttaaagcagaatactggtcaagaagatccagaactagaagagggtgagtggcagatgatgtggaattcacagactgtgacggatagttggatagagaatgctgtcaatgggctgatgggcaagcagattatcaggaagaatggaagaataaagtttctggttgatatcttgcttgggcttaagttctccatgagtggaaattttgtaaaaactggctccggagtgtatggcgttacaatggatgatgcagccataattggtggcccattcggatatcccttagaactgaaaaacaacttcatattggagcttctatacagtgacgagaagctcagagttagccggggaaacaacagtattcttttcgtacatgttcgtaccgatgcattgaggtgacctagtacatatgtgattgtttagaagaatagacgaaacctttgcgagtgacaattttaaatttgtgttcaattgggtatttaactgtacgacaatgcaaactaaatataaacataacatggacgtactacttgttcagcttccatttcaagttgtggtttattaaatgcttcaattctattttggcaa

SEQ ID NO: 248 - DNA, 2232 bp, Solanum lycopersicum
atggaagaaacttctctcgatagtgagcaaaatgttgctgggcaaggcagtgggagatttcaagaaatagagtcagatgatcagaacagtgagaaaattgagtcagatgaattatttgtacaaaatggtgtgcaaatagaggcaaatggtttagatgatcacaattgtgttactgaggatgggcagaaggaatttgttgccccagcagttggaatggagtttgaatcgtatgatgatgcttataactattataattgttattccagggaggttggttttcgtgttagggtaaaaaattcttggttcaaaagaaatagcagggagaagtatggtgcagtactatgctgtagtagtcagggtttcaagaggattaaagatgtaaaccggctgcgcaaggaaactagaactggttgtcctgcaatgatgaggatgagaatggtggactctaaaagatggagagtactcgaagttactcttgaacacaatcattccttaggtacaaaagcatacaagactatcatgaaaacaggtactggaaacaagaagaagttggattcaaactgtaacgctgaagtgcaaacgattaagttataccgggcactagtgattgatgcaggtgcaactaggaatgccaattttagtgcaaggaggtgccaaacttcatctgattgccatgataagctgaacttaagaaaaggagacacacaagccatgtataattatttctgccgcatgcaattgacaaatccaaacttcttttacttgatggatctgaacgatgaagggcagttgaggaacgtgttctggattgatgccaggtcaagggcggcatatgcttactttgttgatgtgatctatatcgataattcatatttgtccaacaaatatgagatccctcttgtggcatttgtgggaacaaatcaccatggtcaatcaatgttgctgggctgtggcctgcttgctggtgagactaaggcctcttatgtttggatgtttaaagcttggctcacctgctctcttggacgtttccctcaaacaattattacagaaaggtgcaaggttttggagactgcaattcatgaggtattcccgaggtctcttcatcgttttgctttatcacacatcctgaggaaagttccagaaaagttgggaggattgcgtaactatgatgttattcggaaggcattgtttaaaacaatatatgagggtctaaagccatttgattttgaagcagcatggagagttatgatccaaagatctggagtgggtgatcacgagtggctttgttcattgtacaatgaccgagctaaatgggctccagtttatctgaaagatactttctttgctggaatggccactgccagatccaatgaaacattgactgctttttttgacaaatatgtgcacaagcaaacgcctctaaaagagtttcttgacaaatatgaattagctttacagaaaaagttcaaggaagaagctcttgcagatatggagtcgagaagctcaaaccctgaactcaaaacaaggtgttcgtttgagctgcagctttcaaaagtgtacactagagagatctttaaaagatttcagttagaggtagaagagatgtattcttgttttagtacaacaaagttacatgttgatgggcaggtggtaatatttttggtgaaggagcgtgttttggaagaggggaataggagagagatacgggactatgaagttctgtacaacagagaagcagcagaagttcgttgcatttgtagctgcttcaacttctatggatatttgtgcaggcacgcattgtgtgtgctgaacttcaatggtgtggaagagatcccgtcaaagtacattttatcacggtggaaaaaggattacaaaaggttatgtgcattagatgttgaatctagttttaccgagtccactgaacaggttcaatggtatagccagttgtatataagtgcattacaagttgtggaagaaggggtgatttccctagatcattataaagtagccctaaatgcatttgaagagtctctgtccagagttcaccacattgaagaaaaaaccaaataaaaatttgttgtatttagcatatctactatctgttcttgttatcgaagggtgcctaaaaatctcttcttgtgtataatgataatagaacaagtacatctgtaaaacccttgtcttcctatgcataaatgtgtgaatgtaatgctcccagaagctttggacctg

SEQ ID NO: 249 - DNA, 954 bp, Solanum lycopersicum
gaagaaaattcaacagagagacgattcaatttgcagagatgaacggcgctatgaatatgcacggagatatggcgcccccggtaccacatgccgccgtgaacaaccacaacatgatgatgcacatgacgtttttctggggaaaaaacgctgaaattctcttctccggttggccgggatacgacaacatcggtatgtacgttttcgcacttatcgtcgtttttctacttgctttcttcgtcgagttgctatcgcactcaaattacatcaaagagagtgcaaatcatgtgacggccgggttgattcaaacggcgttgtacggagttagaattggtttggcttatctggttatgctttctgttatgtccttcaatggcggaatttttctggcggcgatttccggtcatacgttagggtttttggttttcgggagtagagtttttaagaaatcgccgttgacggcttatgctaaagcctccgatcttccttctatgccttgtaattgttaatgaaaattgaaagctttaaaatcgaattgtaatcgataattcaaaataaaaaaaatgttaattgaattatagatatcgaaacctcaactcaattatcgaggaataattatacaaaaatggagatgaattgaaataatgttcgattttgttcgttagcatccccgtgatagataaatgtcgacaacaaaagggacaattttcgtgaagtctgtgtcacaccgcctgccaactgtattctccgttgacagtaccaacaacgttcaatgtgatggattcattcgatctttttattaagagtttcatatttttgcgagttttgtgaataatgttattttttatttcattttatgtattttacattttgagattcaaataagtttatctttaacagtaagtttttcatagatgtttttaatattttgaattatcaattattgtgatttatagt

SEQ ID NO: 250 - DNA, 3082 bp, Solanum lycopersicum
cccgtctccggcgccaaatcatgtccggcaaatcccgaaacttccgccgtcgtggcggtgacgacggcgacgatgatgaaaccgccactaagtccaccaacggtaccgctgctaaacctacgaccaccgcttccgcttccgccgccaaacccaaaaagaaaagtctacttagtttcgccgacgacgaagagtccgacgatactcccttcgttcggccttcctccaaaccctcatctgcttcttcgcgaatcacgaaaccctcttcgtcatcttctgcgcacaagcttacttctggaaaagaccgaattacccctaaacctacttcattcacctccaatgtacaacctcaagctgggacttacaccaaggaagctctccttgagctccagaagaacactagaaccttagttggttctcgctcttcccaacccaaaccagaacccaggcctgggcccgttgagccagttatagttttgaaagggcttgtgaaacctccatttagtgtgagtgcccaaactcagcaaaatgggaaagagagtgaagatgacgaaatggatgttgatcaatttggtggtactgttaataggttgggttcaatggcattggagaaggattcgaggaagaaagatgatgttgggtcagtaatacctgataagatgactattgatgcaataagggctaagagggagaggctacgtcaagctaggcctgcggctcaggactttatagcattggatgaaggaggtaatcatggtgaagctgaggggttgagtgatgaggagccggagtttcagcagagaattgggttctatggggagaagattggtagtgggagaaagggtgtgtttgaggattttgacgataaggcactgcagaaagatggtggatttcgtagcgatgatgatgaggaagatgaggaggacaaaatgtgggaggaagagcaggttagaaaggggttaggaaaaaggttggatgatgggtctaacagaggggtgatgagtagtgttgtaagcagtgcagctgcagttcagaatgctcagaaggcgaattttggaagttcagccgtaggagctagtgtatattcctcagtacaaagtattgatgtttctgatggtcctactattggaggaggagtggttggaggcttgcccagtttggatgcattatcaatttctatgaaggctgaggttgctaagaaagccttgtatgagagcatgggaagactcaaagaatcccatggccgaactgtgacatcattgcacaagactgaagaaaatttgtctgcctcattgtcgaaagtcactacgctggaaaattctttgtctgctgctggtgagaagtacatgtttatgcaaaagcttcgcgactttgtttctgttatttgtgcgcttttgcaggataaaggtccttacattgaggaacttgaagaccagatgcagaaacttcatgaagaacgagcagccgctatcttagaaaggagagctgctgataatgatgatgagatgaaggaacttgaagctgctgtaagtgctgcaagacaagttctaagcagaggtgggagcaatgcagcaacaatagaagctgccacagctgctgctcagacgtcaacagcagcaatgaggaaaggaggagacttacctgtagagctagatgaatttggtagagataagaacctgcagaaacggatggatacaacaagaagggcagaggctcggaagcgaaggagaatgaaaaatgatgttaaaagaatgtcagctataaaatgtgatagctcttatcagaaaatagaaggagaatctagcaccgacgaaagtgactctgagagtacggcatatcaatcaaaccgtgatcaattgcttcaggtttccgagcagatttttggtgatgcacacgaggaatactctcaactgtctgtggttgttgaaaagtttgacagatggaagaaagattatgcctcaagctatcgtgatgcgtatatgtcacttagtatacctgttattttttcaccctatgtgagactagagcttctgaagtgggatccactgcatgaaaacacagattttatggatatgaattggcacaattctctattcagttatggaatttccccagaaggtgaaaccgaaataagtgctgatgatactgatgtcaatcttattcctcagttggtggagaagcttgcaatacccattcttcataaccagttagctaattgctgggatatgcttagcaccagtgaaacagtgtgtgctgtctctgccatgcgattggtgttgagatacggccccttttctggctcagccctcagcaatctgattgctgtacttcgtgatcgtcttgctgatgcggtggctaatttgaaggtgccaacttgggacacccttgttatgagggctgtacctgatgcagcacgagttgctgcttataggtttggcatgtctattcgtttgatcaggaacatatgcttgttccatgaaatttttgccatgcctgtcctggaagagctggttcttgatcaactcttaagtggaaagattgtacctcatcttcgaagcattcagtcaaacattcatgatgctgtaacaagaactgaaagagttgtcacttcactacacggtgtctgggctggccccaaagccacaggagactgcagtccaaagctacgaccgttggtggattacttgctctcacttgccagggtgctcgaaaagaagcactcatcaagcagcggagagatagagacatctaaatttgctcgtcggttgaagaagatgctcgtagaattgaatcaatatgattatgccagggacatatcaagaaccttcaacatcaaggaggccttgtgatctatctacttggtccccattgtcttaaaaaactcatgggatgttctcagttttagcagtcttctacaattttgaatttcatgtcattagtttttcttttagtgtagttacaaaaataacaaattttgatgatacaaatgaagcttaaacgaagaaccgaaggatttcatatagtcgaccctaatttgtttgggcacaaagtgtagtttgttgtattgtagtcccagattacccta

SEQ ID NO: 251 - DNA, 2186 bp, Solanum lycopersicum
agtgtactatgaacattcactatattttccttaaaagttcagtacctttctgcaattctcagaggactaaaatcaacacttttgagaccccttttagtagaaatggatgtagtaacttttggcataataataggaataataatactatttttctgtgctgtttgtgtaatcaccatagaaggcacttgcaagaaccgctcttcttgattcctaataccctttatccaaacacgcccttatcatctcacccttccataaatttagggtttttagctgattttgttcttgcccaaattgacaaaatgtcgaaaaaaattgatgctttggtgaaacagatctgcttcttcttgattgtttctacttctttatggctagtgatttttgggtcttctgtagaagcgaaggctctagaagatcccaagcaggaatttcatcagtgtagccatggtcatggtcatcatggccatgaggggcatcaccatgatcatgatcatgggtcgagtggagttgagcagaggaagcttctagaggaattggctgaagaggaggatctgaaactgtatggatttgggtctcatgctagtatggatgaacatcatcatcatcatcatcatgatggacatggagtcaaggatcttactggtcttggtctatgggtcaatgcaatgggttgctcactattagtgagcttggcttcccttatctgcctgattcttttgcctttaatatttatacacgggaagccgtcaaaagcagttgtagattctttagcattatttggggcaggagccatgctgggggatgctttccttcaccaattgccacatgcttttggtggtgggcactcccactcccatgatgaccatcttcatgatcactctggtcattcacacgcccattcattggaggatctttctgttggattgtccattttggctggaattgtgctctttcttattgttgagaagcttgtgaggtatgttgaagagttttctggaggagtcaatgagcggagtcatggtcatcatcaccatcatcatatgcactacacaaagttgaaggatgataatgatgctgatgataatctccgggaactgtctcaggagaaagatggaagttcatcagaaaaggtagctggagggagtagagtggatggagtgtctactgactctcccaatggggagaaaccaaatggaggagctattctacggaagaggaatactggctccagtgctgctgaagacaatactgctttagatgctgcaaattgctctaccaattctacatcaactggagaggaacaggctaaatcacgttcaagccttgtctttggttatctcaacctcttttctgatggtgttcacaattttactgatgggatggctttgggaagtgcattcctccttcatggatcagttggtgggtggtcaagaactttgtttcttctggcacatgagctccctcaagagataggtgattttggaatcttggtaaggtctgggttcagcgtctccaaagctctcttctttaacttcttatctgcactagtggccctagccggaactgcactggcattgacattgggacaagattctggtcattcgtcattgattgagggattcactgctggcggcttcatctacatttcagttgccggagtgttggctgaaatgaacaatactggcaggacgacgttagtgaatacagtaatccaacttatctcactggtatcagggatggctgttgctctttgcatctctctcattgaatgacggtatacgctacttcttgtgttcgtagagaggagagacggttgtcgtctccccccacagggacgagaacagccttcaggcgttgaccgtttacgacacatccagccagacaacgcttgtattaagattagtgttagacatcttgaatatttatatagaaatctacaggcaggtggaaaaaatttactccttctgtgacatgtattattttggtccatctaatatgaggggaatttcataaatatgagtggaagcatagaatattttataatcatcatatatattactaaaagcatgaataaaaaagttagaaagttgaattacgatttttccctttttataaactaaattgttataaaatatttaaatatttgattgtataaattcaattaaatgtcaatgactacttattca

SEQ ID NO: 252 - DNA, 882 bp, Triticum aestivum
ttaccctggcgatgtaaccgtccgagcaacgtattctcttccggaggccaccactctaagacttgatatggaagctataccagctaacaaagccactcctatcagcttggcacagcatacttactggaaccttgcaggccacaactctggcagcatcttggatcattcgatccagatctgggcaaaacacgtcactccagtcaatgaaaacacgattcctaccggagaaataatgcccgtccaggacacgccttttgatttcaccacggagcacaagattggagaccgcatcagcgatgttcctggagggtacgaccataactatgtgttggactcgggtgatgagaagaatggcttgaagcacgcagccaagctgaaggacccatcgagctcacgaactctggacctctggaccgatgcgcctggcatgcagttctatactgccaactatgtgaatggcatcacgggcaaaggtggagctgtttacggtaagcatgccggagtatgcttggaaacccaggggttccccaatgccatcaaccagcccaatttcccgtctgtggtggtgcagcctggtgcgaagtataagcacgccatgttgtttgagttctcggcatgattagatatgctgccggcagcttaaatggctgcaactgcaatagttatagagtggaataaaacgaccagaagaaaaaaagtcaaattgtagtaccaaacaaaaataaaaagggtgtagtgaccagaactgagcgacatgatctcattcggaaaatcatgttcaagggtgtcttatattttggttgtgtatactgtgactgagaagaattattcacatgcttgccaaaatattgaaggtcgtttgcttgatttgcaaaaaaaaaa

SEQ ID NO: 253 - DNA, 1116 bp, Brassica juncea
gagcctctatgaagtgtggtgggtgtcagggtacaggtatgaaggtgacaatgaggcagcttggccctggaatgatccagcagatgcagcatgcctgtaacgaatgcaaaggcactggtgagaccatcaacgatcgggacaggtgtccacaatgcaaaggagataaggtcatccccgagaagaaggtgcttgaagtgaatgtcgagaaaggaatgcaacacagtcagaagatcacattcgaaggacaagctgatgaagcgcctgacactgtcactggggatatagtcttcgtcatccagcagaaagagcatccaaagttcaaaagaaagggagaagacctctttgtagagcacacactttctctgactgaagctctttgtggcttttcattcgtcctcacccacttggatggcagaaatcttctcatcaaatctaatcccggggaggtcgtgaaacctgattcatacaaggccattagcgatgagggaatgccgatataccagaggccattcatgaagggtaagctctacatccacttcactgtggagttcccggactcactgagccctgaccagaccaaagcactcgaagctgttctgcctaagccttcaactactcagctgagcgacatggagatcgatgagtgcgaggaaactacgctacacgatgtcaacattgaagatgagatgagaaggaaagcacaagctcaaagggaggcttatgatgatgaagacgacgatgatgaccatcctggaggcgcgcaaagggtgcaatgtgcccagcagtaagtaaccttagagagagagagagaggctttggtcacatggttttggttcaaagatgctcctcttccttttcttattttcaagtgtattttggagtcttatggcttatggaattcggtttggtttagaccttgcccacttcggtggaacttgttttccgttctcacgtaagctaattccgtattacaattttgtattttcttattttgaatttgtagtaatttaatatattcaagaagtattttgtgtcttcatttctaaagttgttaactaacgggggcttgagtgatttattctatgttaagactaagtaaaagattggaatttcaaa

SEQ ID NO: 254 - DNA, 281 bp, Brassica juncea
aagatgtcattagcttcgccgattcaatgcatcagaattataaatccatcatcttcttcttcatcttctttgacgacttggtcgtctttgagattctcaacgagtaagccatgtgtattcatcatcagatgttctcaggcggaaggtcccttgagaaggccctctgctcctcctactctccgggagcctacacctccccaaaaacctgttactcctacgccgtcttcttcccctccaccaccgcagaaagctgtggctgttgacggtaagagcgtagtaac

SEQ ID NO: 255 - DNA, 488 bp, Brassica juncea
tgaagccagctgatggtgagaactactaccgaggaggaggccgtggtggtggtcgtggaaggggacgtggtggtcgtgaccgtggagttgtttctggtggtggatttgatggttaccgtagtgaagctgcgcctgccatcggagatactgctcagttcccatctcttgggggaaagtaagatccatccatgaacacgtctgaaacacacacacactcatgcgggagtttcatgcgagagtcgtactgtttgcatgtatgttgtcagttgtaaatttttagttgtctgtcagtttttagattttctgcaaacttatgcctgaccgttttttttttcgttttttaattacttttgaaacattactcgcttttagtttaccacttctttgtcgttgttttgttgtttatgaaaacttgtcagacaggcaagtctaatgttatcggttttgtgtcttctttgaattcactctctcatctctttcctcatgtt

SEQ ID NO: 256 - DNA, 767 bp, Brassica juncea
gggggtttagagtacctccatgagaaggttcagcctcctgtcatacatagagacgtgagatctagcaatgtgcttctgtttgaagactatcaagcgaaagtggctgattttaatctctccaatcaagctcctgacaatgctgctcgtcttcactctacaagagtcttgggcacctttggctatcacgctccagaatatgctatgactggacagttgacacagaagagtgatgtgtatagctttggggttgtacttctagagcttttgacagggaggaaacctgtggatcacacaatgccacgtggccaacaaagtcttgtaacctgggctacaccgagactgagtgaagataaagtgaagcagtgtgttgatccaaagctaaaaggagagtatcctcctaagtcagtagctaagctagcagcggtggcagcattgtgtgtgcaatatgaatcagagtttagaccgaatatgagtatagttgtgaaagctttgcagccacttctcaaacctccagcgccagcccctgtacctgagtcctgagtttgttcgtaaaagagttggattctttgttcatacaaagtttagtttgtattttggtgtgaaagggagggatacttttgatattttgcatttgttattgtctggattggaacaacaaagatgtattgcgtttgctgttcttttgacatttcctttgaatatttggtctctgactatattgacaactcctttcaaggttaatctgattctctaccattttactactt

SEQ ID NO: 257 - DNA, 1411 bp, Glycine max
ttcttctccctcaattctctctcaccaaaaccctttgcacccaataccctcaaactcaacttcaattgctaatttttataaagctagccggagatgatggttcaaaaggaagatttgggtttgagtttaagtctcaatttccctcatcacagtaccccaaatcctcaacatctgagtctcatgtcatcctctactcattcctcttccccttctggtttcaaccctcaaaaaccctcttggaacgaggctttcgcttcttcggatcgaaactccgacacatgcagaggcgaaacacggtcgttcctgcggggaatcgacgtgaaccggttaccttccgccgtggacgccgaggaggaagcgggagtttcgtctccaaacagcaccgtctcgtgcgtgagcggaaaacgaagcgagagagaacccaacggcgaagaacacgacatggacagagcctgttcccgcggaatcagcgacgaagaagacgctgaaacctcaaggaaaaaacttagactctccaaagaccaatccgctatcctcgaagaaagcttcaaagaacacaacaccctcaaccccaagcaaaaattggcactggcaaaacagctagggcttcgacctagacaagtggaggtgtggttccagaacagaagggcaaggactaagctgaagcaaactgaggtggactgcgaagtattgaaaaggtgctgtgagaatctgacggaggaaaatagaaggttacagaaggaggttcaggagcttagagcactgaaactttccccccagttttacatgcaaatgagcccacccacgacgctcactatgtgcccctcttgcgagcgtgtggctgtttcgtcctccgccgttggttctgccacgcgtcatcatcccatggcccatgcccatgcccatgctcggcccatgcccaatggcccgtgggcttccgcagctcccattccacaccggccgtttgatgctttccaccaatgatcttgagggtgttttggtcattgtgaattattattatttacaattatgggcctacttgtaccaccgtgaatgtgtgtaccccaaaagagagaaaatattgggagaaacagtgagggagcggttgaaacagcatgctgtggaattgtgcgtgttccaaagtgcggtgcggtctaaggatatggtcattagaagaagggatttggtgggtctccaatgttttgtaccagtttgacccatcaacttttgttttgttgggtatgacctatattagttaggagtttttcagtttttagtattacttaaattttctcctcaacagagactttgtgtaaagtgcaattttctagttaaatttcacttaattgggtttgggataattatttattagttagttttttgcgaaaatattatcacacccattgaaaca

SEQ ID NO: 258 - DNA, 1048 bp, Arabidopsis thaliana
ggtttttgttgctctctctctcttctcaccttgatatttttcagagagggagagatgatttccgatcattgctatgtcgtccggatttcttcgtcaaggccgtccggtttgtcaaccggcttcagcccgacatccatatgcctcttgtgatgtggtttgtcggttactttcccggaatcttctggctcctttagcagaattgtccggtgtcgccgtcctccatcggttggttcctctaccaacggtggttggctcttgtctagcttctccgtcgtccctctccggcggtttaggctagcttttggccggatttcttttccggttttgttttatgttctcgttttctatagatccagtttgattttgctcctttgtgttctaactcttagagggctcaattccttgaacctcctttgtttaaagggctcaatttgtttttcaagcttatcgatttcaattatataagaacaaattagagttgtggattggggttttctctagtgcctttgagttgggttttatgcaattgagtcaattgtcatattggtttttggaaacgagtgtttttattttacttttaggtgttcatggaagttccattggcttaagttctacgctgatgtcgtttgaagatcatgatatgactacccaggggagattttcctttgcgaattcgaagatgaagaagattgatgggattctctgaatttggtgttgctccatcggacaagcttgaagtcttggtggttcctggtagttttggagttccctgcgatgactaaccaaatcggcggtggccgtgataacaaatgtttcttctgcccacgtgcttcaacctcgcttgataacttacatgtggttttgcgttggactacatcaattacttcctaaaagggtttcttatttcaactgggctttcttttagttgggcttttatctttattttgtttttgtctgcagtctgaaagttgagtttccactcttgtaacctttacaatctttggtttaaataatagccaacacttatgagaaaaaaaaaagattctac

SEQ ID NO: 259 - DNA, 1381 bp, Arabidopsis thaliana
cctttgccatttgctgatattctgcatccaccatctttcttcccaatatctaattgagttttttccttctgcgcttgaaaagaaatgtcgaattctaggatgaatggtgttgagaagctaagcagcaaatccacaaggcgtgtcgcaaatgccggaaaggcaacactgcttgctcttggcaaagccttcccaagccaagtcgttcctcaggagaatctagtggaaggatttctacgagacaccaaatgtgatgacgcgtttatcaaagaaaagctggaacacttgtgcaaaacgacaaccgtgaagacgcgatacactgtgttgacgcgagagatactggctaaataccctgagctaacaacagagggttcaccaacaatcaagcaaagacttgaaattgcaaacgaggcggttgtggaaatggcattggaagccagtttaggttgcatcaaggaatggggaaggccagtggaagacatcactcacattgtctacgtttcctcaagcgagatccgtttacccggtggtgacctttacctctcagcaaagctaggcctgaggaatgacgtgaacagagtgatgctgtattttctgggatgctacggaggtgtgactggcctccgtgtggccaaagacattgctgagaacaaccccggaagccgtgttctgctcacaacctctgaaaccaccattctcggatttcggccaccaaacaaagcgcgtccgtacgacctagttggagctgctctgtttggagatggtgcagctgctgtgatcatcggagctgacccgagagagtgtgaagctcctttcatggagctgcactatgcggttcagcagttcttgccggggacacagaacgtgatcgaggggaggttgactgaggaaggcataaacttcaagcttggacgagacctcccgcagaagatagaggagaacatagaagagttctgcaagaagctgatgggaaaggctggcgatgagtcgatggagttcaatgacatgttctgggctgttcatccaggaggacctgcgattctgaaccgtctggagacaaaactgaagctggagaaagagaagctggagagcagcagaagggcgttggtggattacgggaacgtgagcagcaacacgatactgtatgtgatggagtatatgagagatgagctgaagaagaaaggtgacgcagcacaagagtggggacttggcttagctttcggacctggaatcaccttcgaaggccttctcatccgcagcctcacctcttcctaattgttataatttacatttgggttataaacatattgtaagcatgaaatgagagtattatttgttaaacaacatctatatagaatagatgcatgtgactaggaatgttgga

SEQ ID NO: 260 - DNA, 926 bp, Arabidopsis thaliana
tacttgtttagagagagtcccaccaccaccactaccacaatcccaatggcttcaccaactcttactctcctcctcctcctcaccaccgtctccttcttcatctcctcctccgcagatcctgacatgcttcaagatctctgcgtcgctgatcttccctctggaatcaaaatcaatggcttcccttgcaaagacgcagctacagtcacatcagccgatttcttctcacaaggattagctaaaccaggtcttaccaacaacacattcggtgccttagtcacaggagctaacgttatgacaatcccaggactcaacacacttggtgtctccctctctcgtatcgactacgcaccaggaggcttaaacccacctcacacccacccacgtgccactgaggtcgttttcgtcctcgaaggaacacttgacgttgggtttctcactactgccaataagctaatctctcaatctctcaagaaaggagatgtctttgctttccccaaaggacttgtccatttccagaagaacaatggtgatgtccctgcttctgttattgcagctttcaatagtcagcttcctggaactcaatctcttggtgctactttgtttggttctactcctcctgttcctgacaacatcttggctcaagcctttcagacttctccaggaactgttaaacacatcaaatccaagttccaacccaagaaatgatcatcacccttcctttatattcattactacagttctgtttttttctaaagggaagatctttttatcttctttgatttgtcttctgtaataaaaaaggaacaataactgatgatcttcagtgtgcatttgagctccatagtctcatgtattcgtcttcttgtataatccatattattttttgttcaaagttgactaaagacaggtaagaagtcgaggttgat

SEQ ID NO: 261 - DNA, 1333 bp, Arabidopsis thaliana
ctttctgtttcttgatcccgaggaagaagaagaataaactcttgttcccatgatcttcgtcgatgttctttggaaattgtttcctctatactcgtttggatcaggaagagactctctctcagagtccattttgcagatcattcccgagacaatggcttcttctaccactaaaatcctctgtgatgctggcgaatcagacctctgtagagacgattctgctgcatttctccttaagtttgtagccattgcctccattctactagctggagctgctggtgtagccatacctctcattggcaggaaccgccggtttcttcaaaccgagggaaatctctttgtagctgctaaagcctttgcagctggtgtcatactcgccaccggctttgtccatatgcttgcaggtggcacagaagctctgagtaatccgtgtttaccggattttccgtggtctaagtttccctttcccgggttctttgcaatggttgctgctttagctactctgcttgttgatttcatggggacacagtactatgagaggaagcaagagaggaatcaggctgctactgaagccgctgctggtagtgaagagattgctgttgttcctgtggttggggaaagagtgaccgataataaagtgtttggtgaagaagacggtggcgggattcacattgtcggcattcgtgcacatgctgctcaccataggcatagtcactctaatagtcatggtacatgtgatggacatgctcatggacattcacacggacatatgcacgggaattcagatgttgaaaatggagctaggcatgttgttgtttctcagatattggagctcgggattgtgtcgcactcaatcatcatcggtttatccctgggggtatcacagtctccatgcacgatcaggcctcttattgcagctctgtcatttcaccagttctttgaaggatttgcgctcggaggctgcatctctcaggcacagttcaggaacaaatcagcgaccataatggcttgcttctttgcgctaaccacaccattagggatcgggattggaactgcagtggcctcatctttcaactcgcatagccctggagctttggtcactgaggggatactggactcgctgtcagctggaatactggtgtacatggctctggtggacctcatcgcagctgattttctgagtaagaggatgagttgtaatttgaggcttcaagttgtgtcttatgtaatgttgttccttggagctggacttatgtctgctctcgccatttgggcttagctcttagattacatattatctactgtagaatcaaataatatactgctctcgcaatag

SEQ ID NO: 262 - DNA, 1324 bp, Arabidopsis thaliana
ttataacctcttcgtcttcttcgccgtctctggtattaactccggcgagttttttttttttttactttgatatgaatttgcgagatttactgtttaattcatgatgacaattttggatttttgatcggatgtgaaattcagagtttttcattcttcttcatcatcttataacaaagaagaaacaaaacaaaaaactttttttttctttctttctattgtttcggaatctatgggtgaagcaagcagacaacaaagggcatggaacagagaaatgacggttacgacaaatctttctctagacatagataaatacccgagagatctgttacgaggtttcatgtctgaaaacggcggtggaagagtctttcacggcggagaaacaaactgcgatgatgagagtacgattgagctcaatcttggtttgtctttaggtggtagattcggagtagacaagactccgaggaagctgaaacgatcttcttctgttttggacactgtaccattcaacgattcaactgtggctgagcctgagaattacacggtgggtttagagagaacgacgtcgttaccggcggagatggaagaggaatggaggaaaaggaaagagatgcaatcgcttaggagaatggaagctaagagaaggagatgtgagaaacagagtttcagagttgggaattctgatgaccaaacggtgtcgtttgagaatgagagatgggttactgcgagtaaaagtggcttcttgcagagacatttggtttcttctaatagacaagtctgtggtgttgattccgatggaggaggagcaacgggaggaggtagttcatcgagcttgtcggagctagacaacaaaaatcagcaaggatcatcaaacagctgcaatgatgaaagaagcccgaaaatcgtggcaggatgttcatcgaacagcggaagccagggaacagagagaccgagtgtgactagagccaacaaagtgaatgagaatgagaatgaaaaaagagtgagaagtgaagactcggtggataggaaaggaaaagggatggctacgtctactggtttggttgatatgccttgtgtgtttactaaaggggacgggccaaacggaagacgggttgatgggattctgtacaagtatggaaaaggagaggaagtgaggataatgtgcatttgccatggtagtttcttgacaccagctgagtttgttaaacatggtggtggtggagatgtggatcgtcctcttcggcatatcgttgtcaacacctcttcttcgaccttttaaatcgaagaatcggtgaagaaaccggaagggtcttgtgttctctgttag

SEQ ID NO: 263 - DNA, 914 bp, Arabidopsis thaliana
gatttcgtttctgggttgtgagattgagaaatgccgagatcatctttgcggctactagctaagcctctcttggagagcaggcgagggttttgcacgagctctgataagatcgtagcttcggtgcttttcgagagattgcgcgttgtgatacccaaaccggatcctgccgtttacgctttccaggagttcaaattcaattggcaacagcagtttcgtcgtagatatcccgatgagttcttagacattgctaagaacagagccaagggtgaataccaaatggactatgtacctgctcctagaattacagaggctgacaagaataacgataggaagtcattatatagagccctagacaaaaagttgtatcttctcatattcggcaagccatttggagctactagtgacaaacctgtttggcacttcccagagaaagtctatgattctgagccaactcttcgcaagtgcgcggaatctgctttgaagtcagtcgtaggagacctcactcacacatactttgttggaaatgctccaatggctcacatggccatacaacctacagaagaaatgcctgatttgccatcttacaagaggttcttcttcaaatgcagtgtagtagcagcatcgaaatacgacataagcaactgcgaggattttgtgtgggtaaccaaagacgagctcttggaattcttccctgagcaagctgaattcttcaacaagatgatcattagctgagccactcacaccacaaaaactcctattttcatcccttcttctccatcaatgtcatctctctggtattagacagtgtgagaaggtcaatgtaataaccaaacaaaaccatgtctctggttgtgacgtgaaggaaatttttgttgacagttgatctgaagtacgtagttgaatgtagttgtggc

SEQ ID NO: 264 - DNA, 734 bp, Arabidopsis thaliana
tgacttgccttctcaatacaaacaaaaatactctctacctaaaaaaacacaataaacaacaaacgcatctttggagcggcggtgagattagagaagaagggtttgtgaaatggagtccagtgaggatgtggagaatctgagtagagctattgagaagcttcttcatgagaagaggaagagagaagcttctggtgacgccttcattgaagacgctgatgatcagcttttcctctctagccttatctctcagttggaatcaccaaaccccaaggggaaagaagatgtcataaccggagaagaagaagaaaaagaagaagaatctgcagattcttcaccatccaaaggaaaaagcgagggccagagacaattggaagaaagtatagaagaaatagctaaagacatcaagaaggtgaagaagcagaacaaaataacccatgtacttctctcggctacgatcatcctgacattggtttggcagctctctgagtactccatgattttcatgttgaaagatagaataagccacccagtcagatccatcggaggtatgcttaatggaatgttcaaaggtaagttacgtccaatcaagaaccaacttgcggggacttccaactccaatgaccaaaacaaccatgggaatggatcacacactggacctcaacttcaagtgcccgagctgttgcgagaattcggtttcgacgatgaagaatgatagcttccctttgtgactcaat

SEQ ID NO: 265 - DNA, 2114 bp, Arabidopsis thaliana
gcgatatggcgaaccttccgatccttcaatttgaagagaagatcgtggaaacagtggagaagaattcagtggtagttataattggagaaaccggttctgggaagagtactcagctctctcagatacttcatcgacatggttacacaaagtccggcgtcatcgccatcactcagccccgacgtgttgctgccgtttccgttgccaggcgagtcgcacaggagcttgatgtacctcttggagaagatgttggttatgcgatacgtttcgaggatagaactacgagtaaaacacggattaagtacctcacagatggagttctacttcgtgagagtctgtccaatccaatgcttgatgattattctgttatcatattggatgaggctcacgagaggagtttaaacacggatattctgttgggtctagtgaaacggttggttagaatccgtgcatccaactttaaagttcttataacctctgcaacacttgacggcgaaaaggtttctgaattcttttcgggctgccctgtgctgaatgtacctggaaaattataccccgtggaaatattatacagcaaagagcgtcctgtcagctatattgagtcatctctgaaagtagctattgatatacatgttcgtgagccagaaggtgatattttaatcttcatgaccggacaggatgatattgaaaaattagtatcaaggctagaggaaaaagtacgaagcttagcagaaggatcctgtatggatgctattatttatcctcttcacggttctttgccccctgaaatgcaggttcgtgtctttagtcctcctcctccaaactgccgcagatttattgtttctaccaatattgctgaaacttcccttactgtggacggggttgtgtatgtaattgattccgggtatgtgaagcaaagacaatataacccatcaagtggaatgttttctcttgatgttattcaaattagcaaagtgcaagctaaccaacgtgctggacgtgctggccgaacaagaccggggaaatgttatcgtttatacccattggcagtctaccgagatgacttccttgatgcaactattcctgaaatccaacgaacttctcttgccgggagtgttctatacttgaaatcattggatcttcctgatattgacattctcaagttcgattttcttgatgctccttcatctgagtcattagaagatgcgttgaagcaattgtatttcattgatgcaattgatgagaatggagcaataacaaggattggacggacaatgtctgatcttccactagaaccatcattgtcaagaacattgatagaagcgaatgaaaccggttgcttatctcaagctctaacagttgttgctatgctgtcagcagagacaactcttcttcctgctaggagtaaacccagtgaaaagaagaggaaacatgatgaagattctaatcttcctaatggatccggatatggtgatcacattcaactgctacagattttcgaatcttgggaccgtactaattatgatcctgtatggtgcaaagagaacggcatgcaggtgcgagggatggtgtttgtcaaagatgttagaagacagttatgtcagattatgcagaaaatatccaaagatcgattggaagttggggcagatggtaggaagagttcaagccgagacgactacaggaagttgaggaaagctctatgcgttggtaatgcaaaccaaattgctgagagaatgcttcgtcacaatggataccggactcttagtttccagtcccagctagtccaggtgcatccatcatctgtattgagtgccgacaatgacggaatgatgcctaactacgtagtgtaccatgagctgatttccaccacacgtccgttcatgcggaatgtttgtgcagtagatatggcatgggtggctcccatcaaaagaaagatcgagaaattaaatgtcagaaaattgagcggtggaccggctccctctttcaaagtacctgaggagaagacggagttgtctaaaaacaatgcagaaacacctgcagtttctgaaaatgttgagagtcggattgaagcagccagagaacgctttcttgctcgtaaaggacagaaataaatttga

SEQ ID NO: 266 - DNA, 2007 bp, Arabidopsis thaliana
tccgataaacccacaaataaagacagactcttttgttctttaaacagagattgtaaatccagagccgccggaaaatacaaccgccggtttactctcaggattagttgatattattcgattttaaaaatcagtaggaagaagatgaagtacgtgcttgtaacaggaggtgttgtgagtggattagggaaaggagtaacagcaagtagtattggtgttctccttaaagcttgtggtcttcgagttacttctatcaaaatcgatccttatctgaacactgatgctggaactatgtctccatttgaacacggtgaagtttttgtcttggacgatggtggtgaggtggatcttgatcttggaaactacgaaaggtttctagatatcaaattaacaagagacaataacatcactactgggaaaatttatcagcatgttattgctaaagagaggaaaggagattatttgggaaagactgttcaggttgttcctcatgtcactgatgcaattcaagattggatcgagagagttgcggttattcctgttgatggagaagaggatcctgctgatgtttgcgttattgaattaggtggaacaataggtgatattgaatccgcgccttttatcgaggcgcttggtcaattctcttaccgtgtaggcccagggaatttctgtctggtccatgtcagcctcgtgcctgtgcttaatgttgttggtgaacagaaaactaagccgacacagcatagtgtcaaggggctacgaggattgggcttgacgccggatatcttagcttgtaggagcacaaagccacttgaagataatgtgaaagaaaaactagctcagttttgccatgtcccgcttgagtatatcttcactctctatgatgttcccaacatttggcgtattcctttgttgctaaaggatcagaaagctcatctggcaatctcaaaagtgctcaatcttgctagtattcttaatgagccttctctaggggaatggacttccagagctgaattatgtgacaatttacatgtgccggtgagaatcgctgttgtggggaaatatacaggcctctctgatgcttatctctctgtcttaaaggctctcttacatgcttctgtggcttgtcgcaaaaagctcgtagttgattgggttccagcttgtgatctcgaaaaagaaactgagaaagagaatccagatgcgtataaagctgcttggaagttgctaaagggtgtagatggaattcttgtacctggaggttttggtgatagaggagtggaagggaagattcttgctgcaaagtatgcacgtgaaaacaaaatcccgttcctcggtatttgtcttggaatgcagattgctgtcatcgagtttgcacgatcagttctaagcttgcaagacgcaaacagcacagaatttaaccctgaaaccaaacatccttgcatcattttcatgcccgagggttctaaaactcatatgggaggcactatgcgcttaggatcaagaaaatccatcttcaatgtcaaagacagcaaatctgcaaaactatacgagaacaaaagctttgtagatgagaggcatcgtcacagatacgaggtgaatccggacatggttgaacgccttgagaaggccggtctttctttcgctgcgaaagatgaaactggcaaacgcatggagatcattgaacttccaaaccatcctttctttatcggtgctcaattccaccccgagttcaaatccagacccgggaaagcttctcctctgtttttagggctcattgcagcatcgtgtggcgagttagacacagtcctgaatccagcttctgctcatcaacattcgattagtaacggtccaacaaacattttcatcaatggaacttccaagaaatctcccaatggcttggctgatgtaagatataataacggctactgcaatggcctctacactagatagctgcatttgctgaattctccctctccattagaattattgctttgtgttcgatttagtttgtag

SEQ ID NO: 267 - DNA, 1662 bp, Arabidopsis thaliana
ctcaaacaacccaatctaaatggcttctctatctttaccaataactctcaagaacccaagattcttctcttcttctcctcaaaacatctttaaaacccaaccccaaaccctagttttgacaacaaagttcaagacttgttccatcatttgctcatcttcatgcacaagcataagctcttcaacgactcaacagaagcagtcaaataaacaaacccatgtgtcagacaacaaacgagaagaaaaagcggaagaagaagaagaagagaaagaagttagtcttcgagaaatttggagagaagtacaaggttgcaataattgggaaggacaactagatccaatgaacaatcatcttcgaagagagatcatacgttatggcgaatttgctcaagcttgctatgactcattcgacttcgatcctcactctaaatactgtggctcttgcaaataccatccttctgatttcttcttaaaccttgacctacatctccacaaaggctacaccataacacgttacctctacgctacatccaacataaacctcccaaacttcttccagaaatcaaaactcagctcgatttggagccaacacgcgaactggatgggttttgttgctgtagctacggacgaagaagaggtgagtcggctcgggagacgtgacatagtcattgcttggagaggcacagtcacttatctcgaatggatctatgacttaaaagacattctttgttcagctaacttcggtgacgacccatctatcgagattgaattagggtttcatgacttatacaccaagaaagaagattcttgcaaattctcttccttctcggctcgggaacaggttttggctgaagtcaaacggcttattgagtactacggtaccgaagaagaaggtcacaagacaagcatcaccgtgacagggcacagcctcggcgcctctctggctttggtcagtgcttatgatatcgcagagctaaacttgaatcacgtaccggagaacaactataaaattccaattactgttttctccttctcgggacctcgagtaggtaacttgaggttcaaggaacgatgtgacgaactaggggttaaagttctgagagtcgttaatgtacacgacaaggtaccttctgttccagggatattcacaaacgagaagtttcagtttcagaagtatgtggaagaaaaaacatcattcccgtggagctacgcgcacgtcggcgtggagcttgccttggaccacaagaaaagcccatttctgaaaccgactaaggatttgggttgtgcacataacctagaagctttgcttcatttggtggatggttatcatggaaaagacgaagaagcagagaagagattttgtttggtgacaaagcgagacatagctttagtgaataagagttgtgatttcttgagaggtgagtaccatgtgccgccttgttggagacaagatgagaacaaaggtatggtcaagaacggcgatggacagtgggttcttccggaccgaccactgcttgaacctcacggaccggaggatatcgctcatcatcttcaacaagttcttgggaaggttaacgatgataattttaaacccacaacgacttaagtcgaaaattaaatataaatagttataaaaatattttcgtaattaatgtgtggatcacg

SEQ ID NO: 268 - DNA, 1178 bp, Arabidopsis thaliana
agacacacaaacccactgaacattcaaatgtctcgttctcttgtcttcttcttcctctttcttgtcttggtcgtcccttgtctctcccatggaaccggaggagaccacgacgacgatgaggcttcgcacgttaagagttccgatctcaaatccaaatccttaatctccgtcaagatcgcatgtcttgtcatcatctttgtcctcacgttcataagcggtgtatctccttatttcttgaaatggagccaagggtttttggttcttggtacacaattcgccggaggcgtgtttcttgcaaccgccttgatgcatttcttgtcggacgctgatgagacgtttcgtggtttgttgacggcggaaggagagtcggagccatctccggcttacccatttgcttatatgttggcttgtgctggttttatgttgaccatgcttgctgattctgtcatcgctcatatctactcaaagacccaaaacgatttggagcttcaaggagaagacaaatcgaatcagaggtcagcaacaactgaaacttcgattggagatagcattctattgatcgtagctctctgttttcactctgtcttcgaaggcatagctattggtatttcagagactaaatcagatgcttggagagctctctggacaataacactccataagatatttgcagcgattgcaatggggatagctcttctccgtatgatccctgaccgtcctttattctcctcaatcacttattctttcgcattcgccatctcgagcccaattggtgttgccatcgggatagtcatcgatgcaacgactcaagggtccatcgcggattggatattcgcattgtcgatgagcttggcgtgtggggtatttgtgtatgtatctgtgaaccatttgttggcaaaagggtatcgaccaaacaagaaagttcatgttgatgagcctcgttataagtttttggctgtgttgtttggagttgttgtcattgccattgttatgatatgggacacttgaaaaacactacaattgtcccaaaatactgattagatttttctggtttgcaaagaaagcttgttgatttttgtatgtttatagcatgtagcaatcctcgttttgtaatgtactttgtacttttgtagcatcaaagataacacaccaataagagaggtttctttcttgttcga

SEQ ID NO: 269 - DNA, 1274 bp, Arabidopsis thaliana
aaaaaatgtacgtgacgagaacattgtcgcagttcagaaaatatcagaagacgctctcggaagagtcaccggaaggtccgttctccggcgttttggttatcacagatgaagaagctgaaacagaggatacgttctgtttcgggatgtgtacgaggacaaaaatagagaagcttccgttacctcaggacaagatcttatcagttgttcacttagacagttctggtaacagagagacttcggttaagaaggtcttgttcataccggctctcgatcaacctttgtcttccaatcggtattacgttgttcacgctagaggcagacacaaagggaaagtttccgtgtgttctagagagatagagaaaggggtatgttgttttccagatatcttgcatgacaagaaacctaaacctctggatccaagaaacatatatcagacggttaagatcaaccggcatcacgaccggacattctatgcaaaatctgtggcgccagacggtacaccgccaacatttctcaagaagaaaggatgggagctacgaacctcgaggagcctacatccgaggagacctagagaagctcttggcctagacgaggaactaagagctcgtctcccagcatttggatttccagtttctacaattcggtcaggaagtgtgatagttggagaatggtattgcccttttatgtttgtgaaggagaattgtagtgtaagtcaacaaatgaggaagtcaatgttctataggatcacactatcccaatactgggaacgaatttaccattgcggaaacaatgatcttgatgaaaacaatgatgaaaacgaagaagaagttgtgagagtagaggctaacgtcgtgagagaggccaactatgtgaagggtatggaggcggttaagggagagaaagaagggcatggagggttttattggtataggcaggttcaaggtccacggggaccgggggagaggaggaggaagacgggtttaaggtctccggtggggctgagttttgtggtggtagaaaggatgagaagggtaatggaggaaggagggtgggtgggaggaggaaggaaagtggtgagggtggagagagatgaaccaatcagggtttgtagaagagatggtaggaatatgaatggtaacaatgatagaaattggaggagatttgggtgttatgtgttggtggagagttttgggctgagaagagcagatggagttttgttggttaaatgtgtatttagacatactaatagattgagatgtaactgggagtgatga

SEQ ID NO: 270 - DNA, 1049 bp, Arabidopsis thaliana
caacaatggcgctcaaatcaaaactcgtctctcttctcttcctcatagcaacactatcatccacattcgcagcttcgttttccgattcggattccgattcagatcttctcaacgaacttgtatctctcagatcaacaagcgaatcaggcgtaatccatctcgatgaccatggaatctcaaaattcctaacctccgcttccacgcctcgtccttactcgttactcgtcttcttcgacgctactcaactccacagcaaaaacgagcttcgtcttcaagagctccgtcgcgaattcggcatcgtctccgcttcattcctcgctaacaacaatggatctgaaggaactaagcttttcttctgtgagatcgagttttcgaagtctcaatcttcgttccagctctttggcgttaacgctttacctcacattcgtcttgtaagtccttcgatatcgaatctacgtgatgaatctggtcaaatggatcaatcggattactctagattagctgaatcaatggctgagtttgttgagcaacgaactaaactcaaggtcggtcctattcaacgtccaccgctactttcgaaaccacagatcggtattatcgttgcgttgatcgttatcgctactccgtttatcatcaaaagagttttgaaaggagaaactattcttcatgatactagactttggttatctggtgctatcttcatttacttctttagtgttgctggtacaatgcacaacattatcaggaaaatgccgatgtttcttcaagatcgtaacgatccgaataagcttgtgtttttctaccaaggatctggaatgcagcttggagctgaaggatttgctgttggattcttgtatactgttgttggattgcttttggcgtttgttaccaatgtgcttgttcgagtgaagaatattactgcacaaaggttgattatgcttttggctttgttcatatcgttctgggctgtgaagaaagttgtttacttggataactggaagactggatatggaattcatccgtattggccatcgagttggcgttgatga

SEQ ID NO: 271 - DNA, 2252 bp, Arabidopsis thaliana
tcttgattctctcttccactgtcattatcttcaagatttgtctcttgcgagactcgatgaagcttcatcaatttcttgtgttccttttcttgttcctctcatgttttgctctttcttcatgggctcttcctctctgttccgattcaagagctccctcggaggtgaattcgacattgagcttttgtccttacaaaggaaaaacatgctgcaatacaatgaaagataccagtttgatgaagcaatttcaagctatgaacatttccgacaagggttgtgcttctgttgtaaaatcaatcctttgtgctaattgcgatcctttttcatcagacttattcagagataactcagatcagcagtctgttccaatcctctgcaactcgaccagttcagcaaattccacagagaatttttgctctgagacatgggagacatgtcaaaacgtctccatatcgggttctcttttcgctgcctcattacaaggccgagctggagcgccgtcaaataaaaatgcctccaagcttgctgatctatggcagtccaaaaccgatttctgcagtgcctttggtggagctagctccaatgaaactgtttgcttcagcggtgagccagttgctcttaatgacaatgatactactcctgacaagccgccttctggtatatgccttgagaaaattggaaacggttcttacctcaacatggttcctcaccctgatggctccaaccgtgcattcttctctacgcaacctggaatagtattcttggctggtataccggatcaagattctggcggggttttggatgtggatccatctagcccatttgtggatatgactgatgagattcattttgatactgagtttgggatgatgggaatggcttttcatccaaagtttgctcaaaatgggcgttttttcgcttctttcaactgcgataagtccaagtggccaggctgtactggaaggtgctcatgtaactccgatgtgaactgtgatccttccaaactaactcctgacagtggatctcaaccatgccaataccaaaccgtaatagctgagtatacagccaattctacctcgtcagacccttctaaggcaaagaacgctaagccaacagaagtcaggaggattttcacaatgggacttcccttcacatcacaccatgctggacagattctctttggtccagatgggtacctatactttatgatgggagatggaggtggaggagcagacccgtataatttcgcacagaacaagaaatctttgctaggaaagatcatgaggcttgatgtagataacattcctagtgcttctgagatctccaaaatgggtctatggggaaactactctataccaaaagacaacccttttcgtgaagacaaagagcttgaacctgaaatatgggctgttggattgagaaacccttggagatgcagctttgattcttctaggccttcttacttcatgtgtgctgatgttggacaggacacatatgaagaggtggatctcataagcaaaggaggaaactatggttggcgtgtttacgaaggcccggatcttttccatcctgagtcatcccctggaggaaacacatctgttaaatcactaaacccgatatttcctgtgatgggttacaaccactcagaagttgactcaagcggaaaatcagcttcaatcactggaggttacttttatagatctgaaactgatccttgcatagctggaaggtacgtatatgctgatctatatggaaatggcgtgtgggcggggattgaaacgcctgctaatagcgggagctttgtgaccaaaagaacaaccttcagctgtgccagtgactcacccatgaaatgtagtgattccccgggaacttcagggctctccctagggtatgtcttctcctttggtgaggataacaacaaagacatctacttgctcacaagcaatggtgtctatagagtagtaaggccgagccgttgcaacttgacttgctccaaggaaaactccacagctagaagaaaccccggtacctcaagttctccttcttcttcatcgtcttcttgttataagcatataaatggtttccatggaagcttggtggttttgtttgtgtctctgtctttgattctgctaggtttattaaactaatttgcaaaagttgtttcttgtttgtgttgaagaattattatgagattgtatgttcaggatcttttgagagaacacaatacatgtatgatgaatgagaccaacgataca

SEQ ID NO: 272 - DNA, 1083 bp, Arabidopsis thaliana
tcgaggcttcgaagaatgtcgatgttaatggctgtcaaaacaacttcactctgttgtagcagcttaaaccttacagcttcaccaacattccgacggaacccacgcgcggcgagattggtgaatccgacagcgagaatccaaacacgttttcatcgcctgattgaagaacaaggcattgtgcttatgcctggatgctacgatgccttatccgcggctattgtgcagcaaaccggattctccgctggttttatatccggttacgccttatccgcttctctcctgggaaaacccgatttcggtttgctaacaccaccggagatggctgcgacggcaaggtcggtgtgtgcgtcagctcctaatatacccatcattgcagatgctgataccggtggaggaaatgcgctaaacattcaaagaaccgtaaaggatttgattgcagctggtgctgctggttgcttccttgaggaccaagcatggccaaagaagtgtggtcatatgcgtggtaaacaggtgataccagcagaagaacatgccgcaaaaatagcatcagctcgagatgctattggagactctgacttcttccttgtcgcaagaacagacgtgcgtgctacttctgcaaaatcagggcttgaagacgccattgcacgtgttaatctatacatggaggcaggagctgatgcttcctttgtagaggcaccaagagacgacgatgagctcaaggaaattggaaaacgcacaaaaggttatagagtttgcaacatgattgaaggaggagtcacaccattacacacgcctgatgagcttaaagaaatgggattccacttgatagttcacccccttaccgcactctatgcatcgactcgagctctggtcgatgttctcaagactcttaaagaaaacggtagcactcgagatcacttgcaaaagatggctacttttgaggaattcaatagtttggtggatttagattcgtggtttgagcttgaagctcgctattcaaacctcagaaacgctcttgggacaaccaaatcatgaagatagggacatttttttttttttttggaactctctcaagcaatggtc

SEQ ID NO: 273 - DNA, 1083 bp, Arabidopsis thaliana
tagatctgctcaccatttctccgccatcgccgacggaagaagaaagatgggagacaacaaccctaaccgatcagaagcagaacgtcttctcggaatcgcggagaagcttctcgagtcacgagatctaaacggttcaaaagagtttgcaatcttagctcaagagacagagccactcctcgaaggcaccgatcaaatcctcgccgtcgtcgatgtcttactctcatcagcaccagagaatcgtatcaaaaaccaaccaaactggtacaaaatccttcagatcgaagatctaactgaatcatcaacagacaacgatctaatcaagaaacaataccgtcgtcttgctcttcttctccaccctgacaaaaaccgtttccctttcgccgatcaagctttcagattcgtgcttgatgcatgggaagttctatcaacacctacgaagaaatctcaattcgatggagatttgaatctcatcttcactaaagtaaatctcaacactcagaaatcgaagaagaaaacaacaacgaatgagaagatgtctacgttttggacggcgtgtccgtactgttacagtcttcatgagtatcctagggtttatcaagagtattgtattagatgtcaaaactgtcaaagagcgtttcacgctgcgagtattcctcagttgcctccgttgatacctggtaaagatgagtattattgttgttggggtttttttccgatggggtttgttggtggtaaaggaggagaagctgccattgctaatggagtagatgcagctaagttccctaattggatgcctccggttttctcatccggcggcgttgcagctcctccaagtggtaatggtgttagttttgatggatggtcaggtggtgcggcgaagagagataatgaggctgtgaggagtaataatggtgttggagttaattcagatggaacaccgaagaagagaggaagaggaaggccgaagaagaatccggtttagtgatctcttttcaaactccggtcatgattgttaaaattatggagacaaaattttaaaggcaagttttttttaaggcaaggaagtttaggatcagcgtttgt

SEQ ID NO: 274 - DNA, 1416 bp, Arabidopsis thaliana
tagctttggttctttatgcaaggtttactctcttagaagaatgagagcagataatgatcacgcgcttggtaactcgatagagatttgtaaagatgaatctaagccgcatcaatgtcttgatgagaattgggaagatgcagagctaaaggtcccggaaaatgggaagaacaacaacaatgtgtgtgagttgttctatgatacaagaagtggtgaagaatgggagaatgaggccggaaagaaagttcgagatactagtcatgattgtgatgctaatgtggattctcctgagaaaaaggatccggttttctatatggacaagaatgttacggcctgtgatttacctgagattgttgtttgttacaaggagaatacttaccatatcgtcaaagatatatgtgtcgatgaaggtgtgcctgttcaggagaagttcttatttggtgagaaggattctgtcaagtctagctcaacagaggatttgatgaaagcagacaaaacaaatgtgaatccatcagaaactaagtctgcggaagacagcatcagtaaggttgatgattctgagttttgtaacgatcataagacagacagagatgttgaagaatcttcaggagaagattttgctgatgctgaaggtacttctagcaattacaatcaagagcatttgattgtgacagaggaagtcaaggcttcaccaacacatgggctaagtccctctgaaattgaacctgatgagaattcaaaggacgaagtggctatatcacaggataatgactcaaaggaatgtttaacattgggagatattctatcaagggaagatgaacaaaaatctctcaaccaagacaacattagcagcgatagtcatgaagaacaatctccttctcagcttcaggataaggaaaaaagaagcttagaaaccacagctatcgaaacagagcttgagaaaacagaggagccaaaacaaggagaggagaagctttcctctgtttctacaacgacctctcaagaaccaaacaaaacttgcaacgaacctgaaaagcctgaaactgagaatcatcatcagcaaaactgtttagtggaaaactcttacgaagacgataaattttcttcaagcagatttggagagacgagtttctctgcagcagattcagtttcaatatcaggtcatataacatactcaggaccaattgcatactctggaagcctctctgttcgatcagatgcaagcacaacgagtggaagatcctttgctttcccaatattgcaatcagaatggaacagtagtcctgtaagaatggcgaaagctgataaaagaagacaaaaaggaggatggagacacactcttctctgctgtagattctcttgatgtctctcctccacaatttagtcctaaagctattcactttgaagcacagaagaaga

SEQ ID NO: 275 - DNA, 500 bp, Arabidopsis thaliana
ggatccctccatctctgtctccggtaagtcactgaaagatggggcgtgttagaaccaagacggtgaagaaatcttcacgtcaagtcattgagaagtactactctcgcatgactcttgactttcacactaacaagaagatccttgaagaggttgccatcatcccatcaaagagactccgcaacaagattgctggattctccacccacttgatgaaacgtatccagaagggaccagtccgtggaatctcactcaagcttcaagaagaagagcgtgaacgccgtatggactttgttcccgatgagtctgctatcaagactgatgagatcaaggtcgacaaagagactcttgagatgcttgcttctctaggaatgtctgacacatccggcatctctgcagtcgagccacaacaagctatggcaccaatcgctgctttcggcggcagggcacccagaagatactaagatggcctcagctaatcatcagctacgattggctctctg

SEQ ID NO: 276 - DNA, 399 bp, Arabidopsis thaliana
acaaagtgggctgtaatgatgtcagaatttgcaccaatttctatctatttagtgattagtctgctagtttctttgatcttactcggtgttccttttccatttgcttccaatagttctacctacccagaaaaattgtcggcctacgaatgtggtttcgatccttccggtgatgccagaagtcgtttcgatatacgattttatcttgtttcaattttatttttaatccctgatctggaagtaacctttttctttccttgggcagtatctcccaacaagattgatctgtttggattttggtccatgatggcctttttatttattttgacgattggatttctatatgaatggaaaaggggtgcttcggatcgggagtaaagtgatagggcacaaaatgggtag

SEQ ID NO: 277 - DNA, 1190 bp, Arabidopsis thaliana
ctcctacaaatctggaatcagccggagcgaatctcgaagcttatgatctcgacttgctgaagaggctgggaatggctggtaaagaggagactgatgtatctgcacaagggtctttaaccagggaggccactgagatatggaggagtgagttggaatctcgccggtttcaggtagatagtttagaagctgaacttgtggatgtcaaggcttaccttgagtttggctcagaagaagatgccagaaaggagttaggagttctttcgggtagggtcagatcgactgcaactatgttgcgttatttgagatcaaaagctagagtcttggccattcctgatgatctagcaaatgtgtcatgcggtgtggaacagattgaagaactgaaaggattgaaccttgttgagaaagatggtggttcatcttcttctgacggggctaggaacactaatcctgaaactagaaggtacagtggttccttgggtgtagaggatggagcctatactaatgagatgctccagtccatagagatggttactgatgtgctggactctcttgtgaggagggttacagtagcagaatctgagtctgctgttcaaaaggagagggcacttttgggagaggaagaaatcagtaggaagactatccaaatcgaaaatttgtccgtgaagttagaagagatggaacgatttgcttatgggactaatagtgttctaaacgaaatgcgggaaaggattgaggaattagttgaagagacgatgaggcagagggaaaaagctgtggaaaacgaagaggagttgtgtcgtgtgaagagagagttcgagtcgcttaaaagctacgtcagtacttttaccaatgttcgagaaacacttctttcgtccgagagacaattcaaaaccattgaggagctctttgaacggttggtcactaagacgacacaattagaaggggagaaggcacaaaaggaggttgaagtacagaaactgatggaggagaatgtgaaattgacagcacttctcgacaagaaagaggctcagcttctagctttgaatgaacaatgcaaagttatggctttgagtgcatcaaacatatgaaatttgctttatctttgcattgttgttggctcatctcttatttttttcttgagacaatgctttcgcagaagtagatgaatgcaatcttcttccttcattgtt

SEQ ID NO: 278 - DNA, 951 bp, Arabidopsis thaliana
taagataagaatgccttcggtgccctctaagcttcttcctctcctgtctttgattccttcgttgactccttatcattctggtttgagttctaatcgtttgaaacctcttgaaaagtgtgattggcgtggtaatcttagttaacatttcctttccttcttctctcctttttaccctttcttctctcgccctcgtttacttcttgagattttcttagctcgatttgatctttggtgctttaacttctggcggtgtttgatttgcagcacaaaaagttactactactactgtgattaccttgtactgttagttggatatgagctctgtttgtggtaagttggatttcaaagatgcagactttgacatctctacttcgagtcccacacaatgttctaaaggctcggagcatacctcgtttactggctctgaagattctcaggagtctgatggagatgaaactggttatatagacccaactgtgaatgatgaaaccgctgttcaggatttcggcaaatctgttttaagtcctaactcttctgatgatgaagacaaggatgagaaccttatgactacaccaattgttcttatcccagccataaaaggcagtcgagagaagtatggcttgtcactgaggaagtcgagtgtttcatggggggctgatgtgtatgatcctcctccctcgatagcctcccacacagtcacaagaagcaagaaacagcagcagaaatccaagagcaaagacaaccacaggaagactggaaagaaaggacagaagtctaaagacaactcttcctcacgtggtggcagcagcaaagacaagaagcaagcttctcgcaaacacagtcgagacaaatttgattgggtaactcagatgcctatagttgcagcatcttcatgaatgagtggctgctagtaaccaagcacattttcagtttggcttcctcttgtatgat

SEQ ID NO: 279 - DNA, 1004 bp, Arabidopsis thaliana
cttaagaaaccttccacagtcgccgccgattttatcttctccgccggaattgtgagggatcaacaaatggctcccagaggaagaagaaagaaggctggattgatgcgagaggatgcagcacgagatcgcatgagaggatttgggtttcatgagcatgttatcagtgagagtattaaggaactgttagaggtctacgaagaccaatggtttttgattgaagatgatagctatggtcccctccttgctatctgccttgaaaagcaagaggaaaaagagaaacaattggctgaagtacaagccaaccaattgcctgagaatcacaatgaagagatggctgaggaagaacaacccaatcaattggctgtggaaatacacgaagaagagaaggagcaggagcaggacatgcatattgagtatggaagagaccaagctgatgagttatcaatcaatagcgaagcagtcaatgacccatcaccagcagctattcatttgggagaagcatcatcagattatgcacaaagttctgttcgaggtgtggagaatcttcattgtggatggctaattgatgaggaggagacggatcctgaggaggaaacggatccagaggagaaggagaccgagccagaggatccaaaggagaaggagacggagccagaggaggatagtgatggtgatgatgatgagatcattcagcttactccagaacctctttgtgaagaacttcaagagcttctcagggaagtacgtggacagaagaggaggaagaaagagatgaggtgggacaagtaaaggagctatggagctcctgtaagtagcaaattgatatatatgttaggaagccaaatagtagtagtaagctatagtattgtggtgaaaaaaggtaaaacgacccatcttaacatctcttgagatattggtttttaataatttgtgatggagtagagaaagcagatagtctttatcagtagttgtatgagtcatacaatagtacccgaacccactta

SEQ ID NO: 280 - DNA, 983 bp, Arabidopsis thaliana
aactttcctactttgtttcaatccaaacgagtcaaaatgcttctcaagactgtttcttcatcttcttcttcagctctctcgctggtgaatttccatggcgtgaagaaggatgtgtctcctttgttaccttccatttcatcgaatcttcgagtttcttctggaaaatctggaaacttaactttctcttttcgcgcatctaaaagctcaaccaccgacgcgctaagcggcgttgtcttcgagccgtttaaggaagtaaaaaaggagctcgatctcgtccctaccagctctcatctctcactcgctcgacaaaagtactcagacgagtgcgaagccgccattaacgagcagatcaatgtggaatacaatgtctcgtatgtgtatcacgctatgtatgcttactttgatcgggataacatcgcgctcaaaggtcttgccaagttctttaaggaatcaagtttggaagaaagagagcatgctgagaagttaatggagtatcagaacaaacgtggtgggagggttaagttacagtccattgtaatgcctctttcagagtttgaacatgttgacaaaggagatgctctttatggcatggagcttgctctgtcactggagaaactagttaatgagaagctcttaaaccttcacagtgttgcttcgaagaacaatgatgtccacttggcagattttattgagagcgagtttctgacagagcaggtggaagcaatcaagttgatctcagaatatgtggctcaactgcgacgagttggcaaaggacacggaacatggcatttcaatcagatgcttctggaagggtaagcagcttcgagggactcttgtgtctactgtgtttctatatgtgtctactttatgtttagttctttagcttttacgattttgtgaggtagtagacttctttttctgtaagagacaaaagacatgatcacataactttatattctggtataaggttcatcaaacccacc

SEQ ID NO: 281 - DNA, 691 bp, Arabidopsis thaliana
aaaccctagcagcagacacaacacgagttcatcgagaagcaagatgactttcaagcgaaggaacggtgggaggaacaagcacaacagaggacacgtcaacccaatcagatgctccaactgtggcaaatgttgccccaaggacaaggccattaagaggttcattgtgaggaacattgtggagcaggctgctattagagatgttcaggaagctagcgtctatgagggatacacattgccgaagctatatgcaaagacgcaatactgtgtctcctgtgctatccactctcatgtcgttagagtccgttcccgcaccaaccgcagggttcgtactcctccacctcgtttcgccagacgcaaggaggatactcccaagcctgggcaaccaggacaggcacctcgtcctgctggacctggagctgcagctgcagctgcaccgcgtgtctgaagccttcaagcagagctttctgtcttgttttcctatgttcttgttacgtctttaaggatgtttgtctctgtttaacatagttttgccatgtggatcttgaattctgtcaaactatttcaatagttgattcaacttgtttttttttttgttcctctatccagttttgcagtctgatgtcttagttaactaaatgcttcattcaacatcttaaaactagcagatgctgaatttaaatattcgtggtga

SEQ ID NO: 282 - DNA, 882 bp, Arabidopsis thaliana
aaactcttctctgtttcgacgcaaaaggaagcatttttaatggacgcattgggtggttgcggcggcgctggtggtttctggggatggaatggcttcgatcaacggagaaagaagaagtcttccggtgatagaggtaagaaacgtaattctggatcgtcggattccgtcgatgtgagcagagacgccggcggttatcggtttcctttgaagcaagctgtgacggccggagcactcactttcaccggtgacacgattgctcagctatcagggagatggaaaaagagaaccgctcttaaacaatcatcttctgagcttgacgagggggaattgtggaacattttctcagaacatgactggattcgtgcgctgcggatgagttcttacgggtttctcttgtatggtcctggttcttatgcgtggtaccaattccttgatcattctttgcctaaaccaactgcgacaaatctagtgcttaaggttctgcttaaccaagtaatccttggtccatctgtgattgctgttatatttgcttggaacaacttgtggctgggaaagctctctgagcttggaaacaagtatcagaaagatgctcttcctacgcttctttatggatttcgcttctgggttcccgttagcatacttaacttttgggtagtcccgcttcaagctcgagtagcgttcatgtccatgggttctgtgttttggaacttctacttatcttcaactatgagcaagtagttacatttatatttgtattcttcagcctcgctgagtgataatatatcattctgaaaggtttcaaatacaaaattactgtttaccaagagactatggaaggctcttctcatcctcactccttcctttctttgagtatcgcacaac

SEQ ID NO: 283 - DNA, 547 bp, Arabidopsis thaliana
aaagaagagtgatcgatcggagaaagatggcgatggaagtagcaacaccggctccggcaccaatcccatcggagaggaacatcgttctcgcgcctgcaacaacaacaacaaccgccactgttgagactcacaagaagaacaggatccaagtttccaacaccaagaagccattgttcttctacgttaatctcgccaagaggtacattcagcaacacaacgaggtcgagctttctgcacttggaatggcaatcacaactgtggtaacaatctctgagatcttgaagaacaatggacttgcaacagagaagaaggtgctaacatcgactgtgggaatgaaagatgagacaaaagggaagatggtccagaaggcaaagattgagatagtgttgggcaagtcagacaagtttgactctttggtgccacctgtgaccaacggcaagactccggaggaggaagccagtgcagagacggaagcttccgtggaagcacaagaagaagttgccgctgccaccgaggtctaggttggagccggttgagagatttactg

SEQ ID NO: 284 - DNA, 1509 bp, Arabidopsis thaliana
aaacatcaaggagcatctcttcttaattcttatctgaaccaataactgaaagatttggtcaagaagaggaaatgggaagaacatgtttgccgagatggcgattaggaagactaatggcaggattacaagtcatcttaggattactggtgatcactgtgagcctctcatgtctctaccgattccattccgtgggttacttcttgcaaaacgaagacacttgcaacaatatctacacaatcaaagaagtcagcagcgaaggattcgacctaaaggcgctgcacgatcgtgttgatgaagtactagaaaagatggacaacttgtacgagaagctagagaagacggtaaaagatatggagaagagcaaagacggaagcaaaaaggagatgaagaagtttcttgaagatgaagtgatgaagccattttattatgctcatatcggattaaggcaaatccggttgccaaaacccgaaggaatcagaaactcaacggaaaaggaagagcctttgatcaataagtttctcattgaagagataaggcagtacattacaccaaaggagaatcgtgttgggaagataaacatgtttggaacagagagagtttacaacactattggtcatgcttgtgcgttgatgaagatggagctagagaagtatatggattatgacgttggagcgtattgcgatgatgattggaacttagcacagaagctgatgcttaacgggtgtgatccgttacctagaagacgatgcttgacaagagcatcaatgacttaccaaaaaccttatccgatcaatgagtcactgtggaagcttcctgatgatagaaatgtaagatggggaaattatcaatgcaggaacttcgcgtgcttatcaagcaagaacccgaaaaggggttacacgaaatgcagcggatgttttgaaatggagaaagagaaagataaatgggtcaagaacagtagtttgttagttgattttatgattgaagatgttctgagattgaagccaagtgagatcaggattggattggattatggtgttgggacaggaacatttgcagcaagaatgagagagaagaatgtgactattgtcacaacagctttgaatttgggagctcctttcaatgagatgattgctttgagaggtttgatcccattgtacatatctttgaaccagaggctaccgttcttcgataatacaatggatatgattcacactaccgggttaatggatggttggatcgatcttcttctgatggatttcgtgttatatgattgggaccgagtgctgagaccgggagggttactgtggattgatagattcttctgtaaaaagaaggatcttgatgattacatgtacatgttcctgcagtttaggtacaagaaacacaagtgggctatttcacctaaatccaaggatgaggtttatctctctgcattgcttgagaaacctcctcgtgcaatttaaggattacaatatgaagtttaagcttcaatgtttgtaattgacattc

SEQ ID NO: 285 - DNA, 1553 bp, Arabidopsis thaliana
aagctgaaatcgaaactcgaaccggactgtgatggtggtttccgatggcggcaaacgagtgaagctcaacgtcggcggcgagatcttcgaaaccaacgcgtcgaccattcaatcatcttgcccagactctctcctcgcagctctatcgacttcaacctcccatggatcgaatccggttttcatcgatcgtgacccggagattttcgccgtcattctcaatctcctccgtactggtcgactcccagctaattcctccggcgttttttccaagcaagagctactagatgaggctatgtattacggcgtcgaatcactcctcagattggcgatgttaccgccgccgctgctaggtttcgatgcgtctcttgtctccacaatcgtaccggctgctgatggagtcccgtctgctttaaccgctactgctggagacgcctctctgtggatcgctcacggtggtcagatctccgtctacgattggagtctttcccatgctggaaccgtccgtacacatctcaacgatatcacatcgatctgccgtgtctggggcgaagctgctgcaattggatctggatccgcgtcgggacttcatttctacgatctctctggaggtcgatacatcggatctacgcactggacggatccggaagatccgaggatccataaggcacgcgtcgccgccgttgctgattcggaaggtggagtattcgcatcctttgattgcctgcacagagagaacagtgttctccagatcgacaaatccactcttcaagtcgccgccgtgatcggtcagcaatctggaaactcggctaaaaccacagtaccggagaaactccggtggctgccagcgaaaggtcttttggtgggatcagccgttcaacgtggagtgtttggttgctctggctacatccggatttgggacccaaggtccaggaacatcgtatgggaaacgaacgagccaggatcgggacgaagcactaggtttggagacgccttagctgatatggacgtggacgttgaagactcgatccttttcaaggtatgttccaagtcaggagacctcggaatggcagacattcgtaaattaggtgaagatccatgggtatatatgtcagacgagaatcccggtgcctggaaagccggcgacggaggtggttacagcgtggtacattgttacagaaagcaagtgttggccgccagaggtggtgcattagaggtatggtcaagtgttaaggagaagacaagtggtgatccaattcgcaggagaaactttgtagacaaggaagatgattccaagagagggatgatttcgaaaattgaagcaggaggtgaccggctctttgtttctcgggaatgtatggaaggtgtggaggtctgggaaacttctagtttctccggtgtggtatccgtcgagtaatggtttcccgaagaacggtgatcgatcaccctctgttttcccgggaaaatcttgttaatttcgcaggaaagtaacaaatcttcaaactttccagggtctagtagaagactagtagtactgattgtctctacccaggtcc

SEQ ID NO: 286 - DNA, 1388 bp, Arabidopsis thaliana
ttcaatcgtgaaatcgaaacaaacaaaataattaaaaaaagaaataagaggaggcgatggcgatcaaagacctgacggcgacgaccggtgattcatctcttcctttaataaaatctccgccgtctgaaacaaccggcggtgacagaacctctgctcttcaaacgctcggtaacattatcgtctccatcgtcggtacaggcgtccttggtcttccttacgcattccgcatcgccggttggttagccggatctctcggtgtcattatcgtcggattcgccacctattactgcatgctcctcctcattcagtgcagagataagctagaatcggaagaaggagaagaagaatcgaaaacttatggtgatttaggtttcaaatgtatgggaacaaaaggtcgatacttaaccgaattcctcattttcactgctcaatgtggtggatcagtagcgtatttagtgttcataggtcgaaacttgtcatccatatttagttcgtatgggttaagtatggtttctttcatattgattctggttccaatcgaagttggattgtcgtggatcacttctttatcagctctctcgcctttcagtatctttgctgatatatgcaacatcatagcaatgtgttttgttgtcaaagaaaatgtggaaatggtgattgaaggagacttctcgtttagtgatagaactgctatttcgtctaccattggtggtttaccttttgctggaggagttgcggtgttctgttttgagggttttgcaatgacgttggctttggagagttctatgagggaaagagaagctttccctaaattgttagctaaagtgcttgccgggattacgtttgtctatgtgttgttcgggttttgtggttatatggcttatggtgatcaaacaaaggatatcatcactcttaacctcccaaataattggtctgccattgctgttcagattgggttatgtgtgggattgacgtttacatttccgatcatggtacatccgcttaacgagatcatagagcagaaactgaagaggatagactggcttcaaaagcatcataatgggtacagcaacgaaacaggttcagtctcaaaatttgcaatctttacaacgaggacacttttggtggtaggacttgcagcaatcgcgagtttagtcccagggtttggtacatttgcatctcttgttggaagtactttgtgcgcactcatctcctttgtgttgccggcttcttatcacctcacgctgctcggtccatcactaaatgtatggaacaaatccatcgacgtattcattgtgatttgcgggttgatctttgctgtttatggtacgtacaacacaatcgtcggagtgtgaaaagggatagcatgtgatctgtgtaaagcatag

SEQ ID NO: 287 - DNA, 1940 bp, Arabidopsis thaliana
gaataatgagcgcggttagttttctttacagctcgaaaacccccaaatttcgaggggttttcaatgggatttgtgctctggttctgttttgcttcttctttgatcggagcgaattactcagaaaccctttgttaaggaacgcgtctttcgtcaatggtggtagtggctcaacctccggaggtatcacccagtttatggtaattcgtagaaatgcgaggcaaattgaaacgaatggttctggtaataatagcagcttgagtagcagtagtactgttttatgctcagggttacacaaacacatgggttatgctgatcaatgcgagttcttaaaagcaaacccaatttgttcccctgatggattctttgattacctcagcttcttttactgctcctgtagagatttcagtatcttgggttacatgatgttaggtgtttggcttgttgctttgttttatctgttgggtaatactgctgctgattacttttgttgttcactggagaagctttcaaagcttttgaggctgcctccaactgttgctggtgttactttacttcctcttgggaatggagcaccagatgtgtttgctagtatagctgcttttgttggtacagataaaggagaagttggtcttaacagcgtcttgggtggtgctgtgtttgttacttctgttgttgtagggattgtttcgctttgtgttgcggataaggaagtcaagatcgataagaattgcttcatcagagacttgagtttcttccttttctcgcttgtgtctttgctggtgattttgatggttggtagagtgacagtccggattgccatcgcgtttgtctcaatatatgtggtttatgctttccttgtggcagcgaatgtgattctgagaaaacatgctaagaggtttaaactagaggctcttactcctttgctacctatgcaaggaagtgtgttttccccgagtgttggagaggatatgccaatgaatacccccttgatagaaactgagactgaggatggtccacctcggctacagagtcttcctcagtggatgtgggcgtcaaatgtggccatctattcaaaccatttcgcaaaagttagtgtacatgatgaagacaggccaccttggggatggattgatgacactgcagaagtagagagctcctcatgtactaaattcacttccttgttggaaattccgctgaccattccaaggagattaacaattccatcggtcgaagaagatacatggtcaaagacatatgctgtggccagcgtctcattagcgcctgtccttttggcgtctctctggagtagccaagacgatgtgagtctccaagcttgtggtgtcgcatactttttcagcgttgttataggctccactcttggctttctggcttacaaaaacacagaacctgatcacccacctcgaagattcttgatcccttgggttcttggtgggtttataatgagcatcgtatggttctacatgatagcaaacgaactcgttgctcttctggtgacatttggtgagatttacggaatcaacccgtcgatacttgcgctaacagtacttgcttggggaaactcaatgggtgacttagtatcgaatatcgcattgacaatgaacggtggggatggtgtacaaatcgctctatcgggatgctacgccggtccaatgttcaacacactcgtcgggctaggtatgtcgatgctttttggcgcatggtccaagagtcctgacacatacatgctaccagaagacaaaagcctattctacacacttgggtttctagtactcggtttggtttgggctatggtgatactcccgcgcaacgacatgcaacctagcagaaccttaggtgttggactcattgcaatatatctgatattcgtcactttcaggctgagctgcgccatgggattcataccatgggctgcttaataa

SEQ ID NO: 288 - DNA, 789 bp, Arabidopsis thaliana
aaatcattcgttaatcaaaccacaaaatctaacttccacacacaaaacacacatacacaagaaaataaaaataaaaatggaattagttgaagagaccattccaaaagaagggaaaaagatgggagaaagaattgtggtcgacaaagcttatctttaccaagaagacaaaccactcaccgtctgcaagacttctctcttctacaccggcgatggcttcgccgcctatgactgccgtggtgatatcatcttcagggttgattcttatggacctgacacaagagataacgatgagattgtcctcatggacgcgaccgggaagtgtctccttaccgttaaacgaaagagaccaactctacaccaaagatgggaaggttttctcggcgagagatcggaaggtcagaaaccgatattcagcgtccgtagatcgtcgataatcggacggtgtacgatggaagtagaagtttacgacggaacaggagaagagtacattatcgatggagacttctcgcaacgaagctgtctcatatacgacacgaagaaatgtactgtggctgagatcaaacgcaaagtagacgcgtcaacgaacgtgatgcttggtcgagatgtgttcactctagagattaaaccgggttttgatggcgctttcgcgatgggtttggtcgttgtgcttgaccagatcaacggtgatgatccagttgagattggtgatgaacaggtacacccttttgtagaggattagtgtcggtctctctctcacctctctcagcggtcttcacgttaacatatcga

SEQ ID NO: 289 - DNA, 1797 bp, Arabidopsis thaliana
cgtctcaattacagaacaaagcttcgtttctccaggtttaagaaagaatggaaggtacagatgatgcttctgcacttcaagagcctcctgaccccgaagtgctcgaagttgatccaacttttcgatatatacggtataaagaggtcattggaaaaggggcattcaagactgtttataaggcatttgatgaagtagatggaattgaagtcgcatggaaccaagtacggatagatgatgttttgcagtcaccgaattgcctggagaggctctattctgaagtgcgtctgttgaaatcattgaagcacaataatattattaggttctataattcatggatcgatgataagaacaagactgttaacataataactgagctattcacttcagggagcctccggcactaccgcaagaaacacaggaaggtgaacatgaaggccgtcaagaattgggcgaggcagattttaatgggtttgagatatcttcacggtcaagagccaccaattatacatcgggatctcaaatgcgacaacatttttatcaatggaaaccatggagaagtgaaaataggagatcttggtctagccactgtcatggagcaagctaatgccaaaagtgtgattggaaccccggagtttatggcacccgagctttacgacgagaactacaacgaattggctgatatttattcatttgggatgtgtatgttggagatggtgacatttgattatccctactgtgaatgcaaaaactctgctcagatatacaagaaggtttcatcgggaataaaacctgcttcactctccagggttaaagacccagaagtaaaacagtttattgagaaatgcttacttcctgcatccgaaaggctgtcagcaaaagagcttttattggacccttttctgcaactaaatggtttaacaatgaacaatcctttgccgcttcctgacattgtaatgcccaaagaaggcgcatttggagaccgttgccttatgtctgaaggtcctcctacaacacggcctagtaaaaccttgtcgatagatcttgatgaagacagtaacctgcctattgttacttttagcgacaattcaggatccaggtgtattgaggttagacgcgcaaagagagggaatttctttgtcctcaagggtgaagaaaacgatgagcagtctgtgtccttaattcttcgtatagtagatgagaatgggcgtgtgaggaacattcatttcctgttctatcaagaaggggacactgcttctaaggtgtcgagtgagatggttgagcaactcgagttaactgaccagaacgtcacgtttatagccgagctgattgatatactacttgtcaacatgatacccacctggaaaaccgatgtcacagtcgatcatctcatccattcgcaactgaatcagaactcaagaagtcatcataacgaagcaaagccacagaaacaagaggagactgtttttcatgatacttgtgagttggttagtcactcgtgtaactcagattgcccacgatcagatgaggaagataagcaatgcgtcgatgccaccaaaggagaagacaagagctccattcaagaagtagaagaagcaaccgaaccagtaagtttggaggaagaagaaaggttaagacaagagctggaggagatagaagctaagtatcaggaagatatgaaagagatagcaacgaaaagagaagaggccattatggagacgaagaaaaagttgtctctgatgaagttaaagtaatagccaaaaaagctcaaagaaaacgttgatactgatgaagagcttt

SEQ ID NO: 290 - DNA, 1526 bp, Arabidopsis thaliana
cacctctctttgttggactctctttttctttcttcttcccttagtctattttaactcagaaacctctgtttttttttgttagagagaaaggtaagaaatgggtgttgatttgaggcaagtagttgctggtattctcaccattaccatgtttgtgatgcttggacagatgcttcatagagattactttgattctcttcaggagaaagctcagggagatgcacaagatattgaatttgaaggatctaaagtctctgtgaaagatggtcttgtcggaaccgttgaaggcagtaaaggactttggatggaagataacactgatcttactccttgttggccaacattactatctgatgacgctgtatcatcgaaagggtatgttacattctcacttaccaatggtcctgagtaccatatctctcagatcactgatgctgtaatggtggctaagcatcttggagcaactctagtacttcctgatataagaggaagcaaacctggtgatgaaaggaattttgaagatatctatgatgcggataagctgattaaaagcttggaaaatgtcgttaaagttgtgaaaaaattgcctgaagaagtttctctaaggaacatggccattgtgaaggtccctaccagagttacagaagattacattaaagagcacattgatcccatctttaaatctaaaggaaacattcgagttgcatcatacttcccttctgtaaacttgagaaaatcctcacaagatggcgaaactgatcctgtagcctgtttagcaatgtttgggtctttggagttgcaacctgaagtgaatgcagtggctgaatcaatggttgagcggttgaggactcatagccgtaaatccggtggccgtttcatagcagtagaccttagaatcgacatacttgagaagaaaaattgccatacaactggtgtagtagggtccaagacatgttacaacgctcaagagattgctttattcttgagaaagcttggatttgccagcgacacaactatctatctgactcagccaagatgggacagtagcctcaatatccttaaggatatcttcccaaaaacattcactaaggaggcaataatgccggcaagtaagagatcaaagtaccttgaatcagtgagttccgagtacgaaaatgttatcgacttctacataagctcaagaagcgatgtctttgttccagccatctccggtctgttttatgcaaacaccgttggcaaaaggatagctttaggtaagcctcaagtgttagttccagcagaaatctcagagacatctggccttgctacagatttcatctctccatacatctcaaagaagaaccatttggcttattcatgcttttgctgaccttctcgcatttctaaagtaatctccacgcatacttccatggaagggccttctcagttttcatcaagtgtaagcaatttaattatttttcttgtttttaatttgtaagtttgtttcaatataagttggtttttttgggcagtgaggtttacagtttgaa

SEQ ID NO: 291 - DNA, 569 bp, Arabidopsis thaliana
aaagatctcgttcaatttcaccattcacggaacctaacggaggaagaggtcgatcatgaagtttcgttcttcctctggtcaaattcgatttgtgttttaaaaactgaagtaaacattaaacaatgtcgaaaccggtcctgctcgtgtgtctactagttatacttatagttacctctcagtttgaatggaggcaaccacttgttgagttagatacagccactagctcgtctcagaaacagcagcaaatttcagatagggaagaagctgtcaaagagaagatcattatatcacaagagagacatatccagaggctaaatgagctagtcaggagtcttcaattgcagttgctgcaatgcaagggagagaatgagacccaaaatgccaccaaaagctatcatataaataaacaattcatcgaggtcgaaaggaaacaaatcctggaaggctaaactctgcagcgacaaaacattattttaataactgttttggtaatgtacaagttgtgaaagaaatcactcttttaacttttgtgttgagatgttgtattgtacaagaacaagacgtcggtt

SEQ ID NO: 292 - DNA, 1176 bp, Arabidopsis thaliana
cgaccaaaagaagtgagagagaaagagagagatatgatattattaagtagtagtataagcctctcaagaccagtttcttctcaaagcttctctccacctgctgccacttcaacaaggagatctcattcctctgtcacagtcaagtgctgctgttcttccagaaggttgttgaagaatcctgagttaaaatgttccttggagaatctctttgaaatccaggctttgaggaagtgttttgtttcagggtttgcagctattttgcttctctctcaggcaggccagggtatagcgttggatctctcatctggttatcagaacatttgccaactagggagtgctgctgctgtgggagaaaacaagctgactcttccatctgatggtgactcggaatcaatgatgatgatgatgatgagaggcatgactgctaagaactttgaccctgttaggtactctggaagatggtttgaagtagcttctcttaagcgtggatttgcaggtcaaggccaagaagactgtcattgcactcagggagtatacacgtttgatatgaaggaatcagccattagagtagatacattttgtgttcatggcagccctgatggatatataacaggaatcagagggaaagttcaatgcgtgggagcggaagacctcgagaaaagcgagactgacttagaaaagcaagagatgattaaagagaagtgtttcctacgatttcccaccattccttttatccccaagttgccttatgatgtcatagccacagactacgacaactacgcacttgtttctggagccaaagacaagggctttgttcaggtatactcaaggacgccaaatccaggacctgagttcatcgcaaagtacaagaactacttggcacaatttggctatgacccggaaaaaataaaggatacaccacaggactgtgaagtgactgatgctgagctagcagccatgatgtccatgccaggtatggagcaaacactgaccaaccagtttccagatcttggattaagaaagtcagtccagtttgatcccttcacaagtgtgtttgaaaccttgaagaaacttgtaccgctctatttcaaatagagcaagcttctttgctcaaattcttatgtagactataatcactgtccatatatacatatcttccagaatcaaaacacttag

SEQ ID NO: 293 - DNA, 1333 bp, Arabidopsis thaliana
actctccaagaaatcgactgagttcgtaacttgttgttgtctgatcttttaaagattcaaccttttttggtccgatcatggctgttgctgagaatgctggtgtcaaagtggactcttctggtcagaatttagacaacaacaacactgctgcttcagctaccgagacgacaaagccgccatgtcctgatgatgatcaaagccctaaatctgactcatccactcctcttaccatcgattcgactcctgaaactgacgatcggatcaatgagactgctcaaaaggttcagactttaaatgggtttagtggaaatggtgagagagataacaatggagagatcaaagatttggctgatgcgttttctaagcttaatccgatggctcaggagtttgttcctccttctcttgctcgaagtcaatctggggttttgagaaatggattagggtttactaacaattttgcagccccacctaaacttgctgatgggaatgatcattttcctagaaggagaaggagttttggccaagggaagcgaagaatgaacaaaaggacaagcttggctcagaaggatgatgtaatcaggagaactgtatatgtctctgacatcgaccaacaggttacagaggagaacctcgcaggtgtctttattaactgtggacaggttgttgattgtcgtgtatgcggtgatccaaattctgtccttcgtttcgctttcattgaatttaccaatgaagagggagctagagctgctttgagcatgtcgggtactgtgctaggtttttaccctcttaaggttcttccttccaaaacagctattgctcctgttaacccgacttttcttccacgatctgaggatgagcgtgagatgtgcgttaggactgtttactgtaccaacattgacaagcggatcactcaaattgacttgaaaggcttctttgaaatgctttgcggggaggttcatcgtctgaggcttggagactatcaccaccaaacccgtattgcttttgttgagtttgcgatggcggaaagcgcaattgctgcgcttcactgcagcggtattgtcttgggggcactcccaataagggtaagtccatcgaagacaccagtaaggccgcattttccccgcgctgagttcaagtgaaactctagccggagatcttaaaattatatagcaaacgagagagagagagagaaagcagaagaagaagtctaaagaagaaggtacttgaggcgttttgtgtttatatataaaactctttctagatttattttaagttaatgcttcgcggtcgcagagcctgcccggtatctttgaacaactcaacaactttggtc

SEQ ID NO: 294 - DNA, 2992 bp, Arabidopsis thaliana
cttcaccagtctcttcctcgttttggtgagaaaacgatgaccgatggatttcgctataatggtttctctggaatagcgtacccgttttggctctcatctccaccaccgcctacacctccacatcatccagcttctgcgccgccgtttcaacaaagcaatccggttgaatcctatgatccagccaaagaagtgtttgatccgatgatgttgtatcatgactcttatcaacgatcgccggctaattggtcaaataacccatcgtatcgcgaaaattctcgctctcagactccttcttcatcgttttatgctgacaacactcaacatggaaatagtggtcttcgaggtgaagattcttcttataaagatatgttatcaccgagtggattttactcttcaagggaatcatcatctgattttgtgtcacttcctcccactgagaatttctcagagaggcaacgtttgaactttgagcctacctacagctcagctaccttagctcctgtgtcttcttatgcagatatgctaatcagaaattctcaggactcattctttactcctatcgcgtcatctggtgtttactcttctagcaatgctgttgatgagaaacgtcctggatattactttcttggctcagatagatctgaaactatgaatgttgtctctgcttctcgtgtggagccttacatgtgtgatacagattgtaatccttcttttccaatgccgaattttataacacaagctctctttgatggaagtcagactgggcttcgtgtaggagatgggagatcattcccgagcaacagtgatgtttgtagtcatgcgcctcagaattttttaggagctcaatccagcttgcagagttcctctgttgaaccagttaacttcgatgtgttactgggatatggtgaagctactggtcatatcaagcctttgcccgagaatccaaatcttccctatccggtagttggctcgcaaggttcgagaagtccgcgatcttcctaccccttaccatctattattaattcctctgtgtcactgattaaagatgaagtagaaggtagtggtgtctcctccctttatcagaggccttatactttggttgctgacagtgagaatggtgtttctgagagctccttaaagaatgcaactgaggatttaaattgtcacgagcctcgatcttggagccacttcatggtaacctctgagggaccttcagctcccacgatgttttctatgggaagtgagtcaggtggaccttcagctcctacgatgaaagcggataatgagaatgctcagtcagctggcaactacaaaccccctttcgaaggtagtactactcaacctagtgaagatgttccaaccaaccaagagtcttgtaatctccagaaacaaacatttgatataatggatagagataagaagatcagatcgttgacagatgtggggctcgatttgagtagtagatcaaatgcagatgatgtctcaactggccgatcacctgaaaggcacttctgtgatcaaggagatttcccatctccaacttcttatccaagagtttcttctgttgttaacgccatgcataatttgtcagaagtgcttgtttatgaatgctttaacaatggaagctggctgaagctggagcaacttgagaaccttgataaagtagtagataatctcacaaagtgtttgaagaaaattactgataataagacaacagcaggggaagcaacacttccaacgcaatctatgcatgtcacctgtccaaacgtggttgaccttcatgaggccgcaacgggagttgctaaagactttcaaaggtttagtgtcaagccactagacagctttggtgtcaaagaaccggtggataagaatgaaatgacccagagtattaagaacatacttgcttccaactttcctgatggtgaagaaaaccacccacaaactctcttgtacaagaatctctggctcgaaactgaagctgccttatgttccacaacttgcatggctcggtatcatcggatcaagaacgagattggtaatctcaaattgaacaataaagagatctctgcggatgcagtaagctttatgcaggaaccttctcttaacacacagaaatcggttcccatcatgaatgcaaatgcagacaaggatacacctgaatctatcatcaaacatggaagcaattgtgggaaaaatgcagcaacaatgagtcatgatgcatccgaaagctctagaatcaactcagatcctgtggatgcagtattatcggttatgtccagaagctttactggtggtttagagcagaccattcgtggaaacttaaggcctgatgatgcaacctttgcaaagataccggatgcgatatggcaggaaacctctgcatccactacagagaacaaacatagagaggttatagaccggtttcagatattgaaggagcaggaaacagagcgcaagctcaagtctcagaagctccctgattcagacattgatgttatagaccggtttcagattctcaagcagcaggaaacaaatcgcaaactcaaggctcaaaaatgtccagaaacaaaaaagggtgaccaggaggacaaactagaaggttcagtgatggctaatatgggcagaagcagcgatgtgagtgatgttatggatagattccagatactgaaacgccgggaagctgaacaagtgaagaaatctctcaacagcatggatgtagattcggattcagaaaatgaccagccacaaaagcgtgatcatctctggtcagattcgttattcccaatacgtggacattctcagagagaaacatgcgccgcggacactgaacaatctgcatctggcaaaggatacgagagcccgacctcggactgggaacatgtcatcaaggatgattgagtagtgaaatttccttggacaagaagtttcgatcctataatgaaatcttgttattataaataaaaggtatttgtagaataacatgaacggccat

SEQ ID NO: 295 - DNA, 2058 bp, Arabidopsis thaliana
aatggatccaaaccctacccgagcagtcgccagatgggcacggaggactacacattccctcaaggagcggaggagcttcaccgccgccaccacacggtggaggctccacaacctcaaccgttcttgaagtcacttcagtactcagtgaaggaaactctgtttccagacgacccttttagacaatttaagaaccaaaatgcatcaagaaaatttgtgttaggcctcaaatacttcctcccgattttcgaatgggcaccacgctacaatctcaagttcttcaaatcagatctcatcgccggaatcaccatcgctagtctcgccatccctcagggcatcagttacgccaaacttgctaacttgcccccaattcttggcctttattcgagttttgtaccgccattggtatacgcggtgctagggagttcaagggacttagcggtgggaacggttgcggttgcgtctctgttgacaggtgcgatgctgagcaaagaagttgatgctgagaaagatcctaagctttaccttcaccttgctttcaccgccacttttttcgccggcgttctcgaagcctctcttggaattttcaggttagggttcatagtggactttctatcgcatgcaacgatagtaggattcatgggaggagcagcgacggtggtgagtctgcaacagcttaagggtattttcggacttaaacatttcacagactctaccgatgttatctctgtcatgcgttccgttttctcccaaactcacgagtggagatgggaaagtggcgttcttggatgtggttttctattctttcttctctccaccagatatttcagcatcaagaaaccaaaattcttttgggtggcggcgatggctcctttgacctcagtgattcttggaagtctcttggtttacttcactcacgctgagagacatggtgttcaagtgataggggacctgaagaaagggttgaatccactctccggttctgatctcatctttacttccccttacatgtccacagctgtcaaaactggcctcatcactggcatcattgctctcgctgaaggagtagcagtggggaggagttttgcgatgttcaagaactacaacatagacgggaacaaagagatgatagcgtttggaatgatgaacatcgttggttccttcacatcttgttacctcacaaccggaccattttcaaggtcggcagtgaactacaacgcgggttgcaagaccgcaatgtccaacatagtgatggcgattgcggttatgttcacactcctcttcctcacaccgctttttcactacacaccactcgtcgtcctctctgccatcatcatatccgcaatgctcggactcattgactatcaagctgccatccatctctggaaagttgacaagttcgacttcctcgtctgcatgagcgcctacgttggggtcgtattcggcagtgtagagattggactcgtcgtagcggtggcgatatctatagcgaggttgttgctgtttgtgtcgaggccaaaaactgcggtgaagggaaacataccaaacagcatgatctataggaacactgagcagtacccatcatcaagaaccgttcctggtattctcatcttggagattgatgctcccatctactttgctaatgccagttacttgcgtgaaagaatcataaggtggattgatgaagaggaagagagagttaaacaatcaggagagagcagcttacaatatattatactcgatatgtcagctgttggtaatatcgacacaagcggtattagcatgatggtggaaattaagaaagtcattgacaggagagcgttaaagttggtattgtcaaatccaaaaggagaggtcgtgaagaaattaaccagatccaaattcatcggtgatcatttgggcaaagagtggatgttcttaacggtaggagaagcagtggaggcttgtagctacatgcttcacacgtttaaaaccgaaccggcctccaaaaacgagccttggaacaacgtatagttcctttattttttgctgtcgttctgtgactactcgtagggtaccttt

SEQ ID NO: 296 - DNA, 1547 bp, Arabidopsis thaliana
tgaaatcttcttgttggatgtgttgtttagatttatagaggctgatctgtctcaaagaaaccatggatgattgttccaaagatataatcaattgtttaccagacaatcttctttgccaaatcttgtccaacttgtccacgaaagaagctgctttgacatcacttctctcaaaaagatggcggtatttgtttgctcttgtaccaaatcttgattttgatgtccttccctctctgcatcccgaggttgcgatgcaggaccaggatcagacgagttttatagattttgtggatagagtattgaaattgcgagggaaagatcatattaacaagttctctctgaaatgtggagatggtattgaggatgaagatgtcttcccttggatattaaataccttgagacatggtgtatcagatctttctctacatgtctctccctctttggtttattggttgccttcaaaggtttttgcaagtaagacactggttaggctgaaaataggacctaaagatggtcctagagttaaactgagaaatgtctgtctaccaaagcttaagactctaaatcttgattcagttgtgtttgaagagggtaagattggttttgcaaagcttctttctggttgtcccgtgctcgaggaattatctttgcttaatcttgcgtgggatcgttgggattcttgctctgtgtcttccaaaatcctcaagagactaacgctatattgtgcacacagtagcagaaatccaaagagtgtatcatttgatactccaaatgttgtctactttgaatattctgataatattgcaaacaagtatccgaaagtgaattttgattcgctggttgaagctagtatcggtattcggatgacgaaggttcagaaagcaaatgcgagatatgtgtcagatgttgatgaggaaacagagatggttggcaatgcaacggatcttcttatgggaatatgcaatgtgaagaccctttacttatcttatgacactcttgagacacttaatctttgctgtcaagtgataccggtattcaacaatttgactcatctaactattgagagtcatccggaactaggatgggaatcattgccaaatcttctcaagagttgtccaaatcttggaactcttgtcttccaaggactccttcacaaagcaacagatagatgtggggatgtgtgcatgtgccaaggtttggagaatagtcattcttgcttatcatcaagtccggtgaagtgtctaaagatattgaaatttggagaaaccaatgatgatgacgatatggagatagagatggagcagatcaagaattttttggagaaaatgcctaatcttgaacaactcataatatactacgaatcatcaatcgataatgatttagttagagtatcaagccaacttcaggaggttcctacagtagcttcactcaagtgcaagattcaagtaatctctgataaccttagcttgtcatccactttgcccatttccttgtcgatggaaaatggatttcacctgtagaagaaccttactggtttcgtggaattatag

SEQ ID NO: 297 - DNA, 2545 bp, Arabidopsis thaliana
gtcactttcttgtcatccaaacaatacacagtcccctttttctccattattacttctcaaaaaaaatcatgtaaatttgttccatgaatcattcccaatcttcttcaacgagattcattgttattacgagctccttaatatttggttttttgcttttagctcttattgtctggatttttgtgcatttttcttctatcccctaaacttgtagtattgagaatgttctctaatatgggtttcaagtagtctccttttcgtgtctccctcatatcgggtttaaactcatcttctaactcttcttcgcgagtgtctaaccaaagaagctctccaagtgttcgacgatttgtctgatagaaaacgaaaaacagagtaacttaaaaacagagtaatttacagagagaagccaccatggaagagacttttgttccgtttgaaggtatcaagaatgatcttaaaggaaggttaatgtgctacaaacaagattggaccggaggaatcaaagctgggtttaggattctggctcctaccacatacatattcttcgcgtctgcgattcctgttatttcattcggcgaacagttggaacgaagcactgatggagttcttaccgctgttcagacactggcctctacagccatttgtggaatcattcactcgatcatcggaggccagcctctgcttatactcggagttgcagagccaactgttattatgtacacattcatgtttaactttgctaaagggagacctgaactgggacgcaatttattcttggcttggtctggatgggtttgtgtctggacttcgttgatactgtttgtgttggctatatgtggagcttgttcatttatcaacagattcaccagagtagctggagaattgtttggccttcttatagctatgctcttcatgcaacaagccatcaaaggattagtcgatgaatttcgcgctcctgcgagagaggatctgaaacttgtggagtttttaccttcctggagatttgcaaatgggatgtttgctttggttctttcctttggtcttctgataactgcacttagaagcagaaaagcaagatcatggagatatggaacaggctggcttagaagtttagtagctgactatggtgtgccactcatggttctggtgtggaccggtgtctcctacatcccaacaggagatgttccaaaaggaattcctcggcgactttttagcccaaatccttggtcccctggtgcttatgagaattggactgttgtaaaggagatgcttcaagttccaattgtctacataattggagcattcattccagcaacaatgattgcagttctttactacttcgatcatagtgtagcatcacagcttgcgcagcagaaagaattcaatttgagaaaaccatcttcttaccactatgatctgcttcttcttggatttctgaccttaatgtgtggtctacttggaattcctccatcaaatggagtcatccctcaatcaccaatgcatactaagagcttagcaacactaaaatatcagctgcttcggaacagactagttgcaactgctcgcaaaagcatcaagcagaatgcgagtctaggacagttgtatggaaacatgcaagatgtttataatcaaatgcagactccattagtctaccaacagcctcagggtctgaaagagctaagagaatcaacaatccaagcaacaacattcacaggaaatctcgatgctccagttgatgagactctgtttgatatcgagaaagagattgatgatttattgccaattgaagtcaaagaacagagagtaagcaacttgcttcaagcagtaatggttggagggtgtgttgcagctatgcctctccttaaaatgatccctacatcagtcctttggggctactttgccttcatggcaatcgaaagcttacccggaaaccaattctgggaaagaatcttacttctcttcacagctcctagtcgtcgattcaaggtccttgaagataaccacgcgacattcgtggaaaccgttccattcaaaacgatcgcaatgttcacaattttccaaacaacttatctcttaacttgctttggtctcacgtggataccaatcgctggagttatgttccctctactgatcatgtttctgatacccgtaaggcaatatatcctcccaagattcttcaaaagtgctcatcttcaggacttagacgcagcagagtacgaagaagcacccgctttaccgttccatctcgcagtaccggaagctgagatgggatcaactgcttcgtatccatgtgattctgagattcttgatgagtttattacaagaagcagaggagagtttagacacacatgtagtcctaaagttactagttcgacttcaacaccggtttataatcggaatctctctcaagtgtttagtcctagagtgattgatttaagaggtgagatgagtccaaggctctccgggaaaggccaaaatagtccaaagccgagtcctttaaacccatcatcatcgtcgaaatgagtttaccgatgatggaggcttgata

SEQ ID NO: 298 - DNA, 1301 bp, Arabidopsis thaliana
attgcctcttgaagtcaatcacagaatgtcatgttagctttaggttatgccaaggaaatcgctcaaagatttctcagaaatccaaaatggacctctagattcttcttgcttcactatcaatcctctaattactccagttatgtaaagtcaagaccttttctacaagttcaatgtaaatcagcttcttttgatgtttcacaagctcagagatggaatctatttgcgtatgatggtttgtttagtagacgttacttgagtaattccacaatagagctaagaacagatgataatgtggttaggtttgctttcaacaatgtctctagtagtggtaacaatgttgtacctacaagaaaagagaagaaatggaaacgggctaaattgtcaagaaaagctaaagtgaatgagttaaggttttatcgtctgaaggctaaaaagaagatgaattctccaaaccctgaagttagaattcgttacaagcttgaaaaggctaagaggaaagaagaatggttgattgagaaactgaggaaatacgatgttccgaaatcaccagcggagccttatgatccagagagtttgacagaggaagagcagcattacttaaaacgtacaggtgagaagagaaagaactttgtacttgtcggaagacgaggagtgtttggaggtgtggttttgaatttgcaccttcattggaaaaagcatgagactgttaaagttatttgcaagccctgcaacaaacccgggcaggttcatgagtatgcagaagagcttgctcggttaagtaagggcattgtgattgatgtcaaacctaacaacaccattgtgttgtaccgtgggaaaaactatgtgagaccagaagtgatgtctcctgttgatactctctctaaagataaggctttggagaaatatcggtatgagcaatcgcttgaacatacgagtgagttcatagagaagctggagaaggagcttgaggagtaccataagtacgttgctcggcacaagaagaagaaagatgaagaagcagagaagaagaaagaggcggtttcgaagagcaaagtagtgtaaggtctctcgtttcagagtttttgtagcatcaagattccaattctcaaaaggattctgaaagcaacggtgaacattgcattatgtctaagtaaatgggttcagtttggctaaaccaagttataccaaccggttagagaattagaatagagaagtctatatacaacttttactagtttagtcgtttgtcaataaatatcaccattcagtatttgtagtggagaaccaccaatgtatggtct

SEQ ID NO: 299 - DNA, 759 bp, Arabidopsis thaliana
tgatcatctctcaggtgaatacgttttggtataatctcataccaatgtctgcgaattccaagtcggagaggtctgcttctcaatcggcggagacggtggctgtttctaaccgtgtcgtggcgtcacggtcaagtcgtcagccgcgtctctctttctcctcctttgctccctcatcagagcacgataacctgaagaagctgaaatccgatgagatttctcccgcgagagaggaagtgccggtgtcggtgaaggagagagaagaaacggaggaggaggaagcgaagaggacgtggaatcttcgtccgaggaaggcttatggtggttcgaagaaaggaaacggcgtgttcacggcggaggtttgcggtggcggcggaggaggaggttcggaggtgaagaatcagaaatcaggcgcaggaattgagccgaaatcgaacaggcagagaggaatcccggcggaatcacccggattaggcggtggtgaggttgcaaacgagaatcataggctttgggttgctctagctcgagacgagatcgaagaagatttgttcagcatgagtgggaacaggtcatctcgccggccaaggaagagggcaaaagctatgcagaaacatctcgatgtcattttccctggattgggtctcgttgggatgaatgctgattgcttcagagtagccacttctccggctaagtgatgatcgatgcaaaggagtcttttggtgaaggaaaaagggtagataggtatgctggtgatcgagaatc

SEQ ID NO: 300 - DNA, 1350 bp, Arabidopsis thaliana
aagggttggtgaaatatgaatggaatccaatttcgttgggaggttgttgtatattataagtttttagtgtctaatctttttgaactatttgttgaaattaaggtgtaaagttgttccattcatcaaaaagctatggatttcaatagaaaagctcatccagattgcgtatatgcggataatcctttccatgaatgtgcttcagcttgtttagagaaaattgctcaaggccatgtcaagaagaacactaagaagcaaagttcaaggcttcttagcttctcagggagtttcggtaggaaaaagaaggagtcgaattcacaaccgcctacaccgctatccgcaaggccttatcaaaacggcagaggcggttttgcaaatggtaattccccaaaggttcatcattctgtagctccacctgcttccgtgaagaagaagattgtttctgaaacgaaaaattctttcacttcttcatcatccggtgatccggatgatttcttcaaccataaaccagagaagaaaccttctcaaaccattcccctttcatcaaacaatttggttgatcaaagcaaagtggtatcacctaaaccgggaatacaagaacacaatgggaagattggagaaggcggcgaaactagactctttagtttcctaagccttccaagatcgcctggaaaagagagcaatgatgatttttctgatgatgatgacgaaaacaacaatgagattggtgtagagctcgatctcgaatcagtaatgtctgacacttttgtctctgtcgggaaataccgagtcagatcgggttcatccactatactaagtgctgtcatcgaaaagcacggagacattgctcaaaactgtaagctggaatcggattcaatgcgatcacgttacctcgagtgtttatgctcactgatgcaggaacttaggtcaaccccggtagggcagttgagcaaagtcaaggtcaaagagatgcttgcggttctcaaagacttggagtctgtgaacattgaagtagcttggctacgttctgttcttgaagagtttgcgcagtctcaagaagatgtagaaaatgagaaagagaggcatgatggtttagtgaaggctaagagagaagagcttgaggctcaagaaacggatttggttaggatggagaaggaagtggtggaagtgaagcggcggattgaggagacgcgggctcagatggttgagatcgaagcagaacggttgaggatggagaaaatgggattcaaaatggagaaatttaaagggaaatcgtttatagatgagcttctgtgagtttgagttgtgtgtgatgttgttagtagtaagccaagggtagtaggtaatagcaca

SEQ ID NO: 301 - DNA, 1267 bp, Arabidopsis thaliana
agagagagagaaagatgggttgtgtttcttcgaaactaggcaagaagaaactcataagagagattagagtcaacaatggcggcgatcacattgtctctcttacttcaactacttatggtcatctcgatctcgatgaacgagcagagacctctcctaagtcactggaagttactaaaggcgaagtctttgaatctgaaatcataccgagaagatctattaagagagatgatccggagattatcaatacttgggagcttatggaagatcttgaagattcaatgcacgtttctaatccacagaagattagtcccaaatctcgtggtattttcggtaaatcatggaagactccggtgaaatcggttgttgaatctccgaagagaggaagtagtaagagatttggagggaaagagaataattcgagaggtgtgagtccgaatcagattctgaagccgaagaacattcttgaaacaccgaagagaggtgtaatgcgtttgagttttcctcttaaatctgaagaatcttcggtgacggttacgcagaggaggaagagttatagtccaatgtttgatccagatcttgtggcttcttacgaaagagagttgtctcaagagaaagaacagatcaagatggtgatttctccggtggtgcacgagagcagaaaaacagagaaaacagagagaattcttgagaagttcccagagaaatgtccaccgggaggagagcactctgtggtgatctacataacaactcttagagggatacggaagacgtttgaggattgtaatgtggtaagatcgatattagattcacacgaagttcgattctcagagcgagatgtgtcgatgcactcggtttttaaggaagagatcaggggcattatgggaacgaaacatgtgaagatacctgcggtattcgttaaagggaggatggtaggaagtgttgaggaagtgatgaggttagaagaggagggcaaattgggaatattacttgaaggtattccggcggcgaggcttggaggcagttgctgccgtggatgtggaggaatgagatttatgatgtgtgttgtttgcaacggaagctgcaaggttagggaggaagagaagaagagtatggttaagtgtttgaagtgtaatgagaatggtttggttctatgtccaatttgttcttaaaaaagagaatcagttttgccctaattctggaggctgacttttgaagggttgattttggtttgtaatgatttggtgagagagagtttctaaagccgtgt

SEQ ID NO: 302 - DNA, 5049 bp, Arabidopsis thaliana
tcatcactcatctgttatcttcctcttcttcttcttcttcctcttcttttttccttccacatttatctttattttattttttagtgtacatttatcttattttacacacacgcctctcattttttttcatttcaatggcgatgcaatctctttcccctgttcctaagcttctctccacaacaccaagctctgttctttcttctgacaagaacttcttcttcgtcgatttcgttggattatactgtaagtccaagaggaccagacgcagacttcgtggagactcttcctcttcctcacgctcttcttcttctctctctcgtctttcctctgttcgtgccgttatcgaccttgaacgtgttcatggcgtctctgaaaaggatctctcctctccttcagctttaagacctcaggttgctaatttggaggatatattgtctgaaagaggagcttgtggagttgggtttatagcaaacttagataacataccttcacatggagttgtcaaagatgctcttattgctcttgggtgtatggaacatcgtggaggttgtggagcagacaatgattctggtgatggctctggtcttatgtcttccattccttgggatttctttaacgtctgggccaaggaacaaagtcttgctccttttgataagttgcatactggtgttggcatgatctttcttccacaagatgatacctttatgcaagaagccaagcaagttattgaaaacatatttgagaaagaaggattacaagttcttgggtggagggaagttcctgttaatgttcctatagttggtaaaaatgctagggagacaatgcctaacattcaacaagtgtttgtgaaaatcgcaaaggaagatagtactgatgatattgaaagggaactttacatctgccggaaactaatcgaaagggccgtagctactgagagttggggaacagagctttacttctgttcactgtccaatcaaaccatagtgtacaagggcatgcttcgatctgaagctcttggattgttttatctagatcttcagaatgagctttatgagtctccttttgctatttatcatcgaaggtacagtacaaacactagtcctaggtggcctcttgctcaaccaatgaggtttcttggacataacggggagatcaataccattcaggggaacttaaattggatgcagtctcgagaagcttcattgaaggctgctgtttggaatggccgtgaaaatgaaattcgtccatttggtaatcccaggggttcagactctgctaatcttgatagtgctgcagaaatcatgattagaagtggaagaacaccagaggaagctctaatgattcttgtccctgaggcatacaagaatcatccaaccttatctgtcaaatatcctgaggttgtagatttctatgactactacaaaggacaaatggaggcttgggatggtcctgccttacttttgttcagtgatggaaaaacagttggggcttgtcttgaccgtaatggccttcgtcctgctcgatattggcggactagtgacaatttcgtctatgttgcatctgaggtcggagttgtaccagttgatgaggcaaaagtcacaatgaaaggccgtctaggacctggaatgatgattgctgttgaccttgtgaatggccaggtatatgagaatacagaggtcaagaagagaatatcttcatttaatccatatggaaaatggattaaagaaaactcccggttcttgaagcctgtgaatttcaaatcctcaactgtcatggaaaatgaagaaatcctaagaagccaacaagcatttggttattcaagtgaggatgtgcaaatggttattgagtctatggcttctcaaggaaaggaaccaaccttctgcatgggcgacgatattccgctggcaggattgtctcaaagaccgcatatgctttatgattatttcaaacaaagatttgcacaggttacaaaccctgccattgacccccttagggaaggtttggttatgtctcttgaagtaaatattggaaaacgtggaaatatattggagcttggacctgagaatgcctcgcaggttattctgtctaaccctgtgttaaatgaaggagcgttagaggagttaatgaaggatcaatacttaaaaccaaaggttctgtccacatatttcgatataagaaaaggcgttgaaggttccttgcaaaaggctctatattatctttgtgaagcagctgatgatgctgtccgaagtggctctcagcttctcgttctttcagaccgatccgatagactggaaccaaccaggccttcaattccaataatgttagctgttggcgctgtccatcaacatcttattcagaacggcttgcgtatgtcagcttctattgttgctgataccgcccaatgcttcagcacacatcattttgcttgtttggttggatatggtgcaagtgctgtatgcccatacttggcactggagacatgtaggcaatggcgcttaagtaacaaaactgtggccttcatgcgtaacgggaaaattcctactgtaaccattgagcaagctcagaagaactacactaaggcggttaatgcagggcttcttaaaattctttctaagatgggaatctcattgctttcaagttattgtggtgctcagatatttgagatatatggtttgggacaggatgttgttgatcttgcattcactggaagtgtgtcaaaaatcagtggactcacctttgatgagttggcaagagagacattgtctttctgggtgaaggccttttctgaggatacaactaagcgattagaaaattttgggtttattcaattcaggcctggaggtgagtatcattcaaacaacccagagatgtcaaagttgcttcacaaggctgtccgtgaaaagagtgaaactgcatatgcagtctatcaacagcatctctctaacagacctgttaatgtcctccgtgacctgcttgagttcaagagtgatcgtgcaccgatcccagtagggaaagtagaaccggccgttgctattgttcagagattttgtactggtggaatgtcacttggtgctatttcaagagagactcatgaagctattgctattgcaatgaataggattggtgggaaatcaaactctggagaaggtggagaggatcctatccgttggaagccacttacagatgtggttgatggatattcaccaacactaccacatctcaaaggtcttcaaaacggcgatattgcaacaagtgctatcaagcaggttgcttcagggcgttttggagtcacaccaacgttcttggtcaatgcagatcaattggaaatcaaagttgcacaaggtgccaagcctggggaaggtggtcagcttcctggaaagaaagttagtgcgtatatcgctaggctaagaagctctaaacctggtgttccgcttatatctccgcctcctcaccacgacatttactctattgaggatcttgctcagttgatctttgatctacatcagattaatccaaatgcaaaagtatcagtcaagctagttgcagaagctggaatcggaactgttgcttcaggagttgcaaagggtaacgctgatatcatccagatatcaggccatgatggtggaaccggggctagtccaataagctccataaaacatgctggtggaccatgggaacttggactaacagaaactcaccaaacacttatcgcaaatggactaagagaaagagtcattttaagagtcgatggaggcttaaagagtggtgttgatgttctaatggctgcagctatgggtgctgatgaatacggattcggttccttggcaatgattgctactggttgtgttatggctcgtatttgccacactaataattgcccagtgggtgtagcaagtcagagagaagaattacgtgcaagattccctggtgtacctggtgatcttgtcaactacttcttatacgtagcagaagaggtgagaggtatcttagcacagttgggatacaacagtttagatgacatcattggacgaacagagttactgagaccacgagacatttcgctagttaaaactcaacatctcgatctgagttatcttctttcgtctgttggaacaccttcattgagcagtactgaaatcagaaagcaggaagttcatacaaatggacctgttctcgacgacgatattcttgcagatccattggtgattgatgcaatagagaacgaaaaagtggttgagaaaaccgtcaaaatatgcaacgtagaccgtgcggcttgtggtcgtgttgctggtgttattgcaaagaagtatggagacactggttttgcaggacaagtgaacctaactttcttagggagcgcgggacagtcgtttgggtgctttttgattcccggtatgaacatccggctcataggagagtcaaatgactacgttggaaagggaatggctggtggtgaaatagtagtaactcctgtggaaaaaatcgggtttgtgcctgaggaagcaacgatagtcgggaacacttgcttgtatggtgcaacaggtggtcagatattcgctagaggcaaagctggagagagatttgcagtgagaaactcactcgctgaagcagtagttgaaggcactggagaccattgctgtgagtacatgactggtggctgtgtagtcgtgcttggaaaggtgggaagaaacgttgctgctggtatgacaggagggttagcttaccttcttgatgaagacgacactcttcttcctaagattaacagagagatagtgaagatccaaagagtaactgcgcctgcaggggaattgcagctgaagagcttaattgaagcacatgtggaaaaaaccggaagcagcaaaggcgcaacgattctgaatgagtgggaaaagtatctacctctcttctggcaactggttccaccgagtgaggaagacactcctgaagcttctgctgcttacgtaagaacatccaccggggaagtcacatttcaatcggcttagagatcattcaagagcaggttgtggcagttgaaacacaaggattgat

SEQ ID NO: 303 - DNA, 489 bp, Arabidopsis thaliana
ctaagcaaatttcaaagcatttcaaaaaccctagcctatctctctttatctctcacaacaaaatctttgaaatggcgatctctaaggcttccattgttgttctcatgatggtgattatctccgtcgttgcatcggcacaatctgaggcaccagcaccaagtcctacttctggatctagtgcgatctcagcgtctttcgtgtcagctggagttgcagcagtcgcggctcttgtttttggctcagctcttcggatctaagttactgtgatggtgatttcgtacagagattgtttttgcggtataggccattcatcattattcgtcgtctcgtgtgtattccgaagcagcttatagatctcattttctatttgtccctcttcttcttcgttttctatcttaatcttcatatctgtatgaggatattactatttctttttagagtatttgtggttttgtgattttctagacgatttcttagttatgcgatatg

SEQ ID NO: 304 - DNA, 1229 bp, Arabidopsis thaliana
tctctctctctccgacgatggcttccggtgaccagagcaagaagagaaaacagcattatcgccctcaaaacagaccagtgaagaagaagggatcttaccctttgaagccaggtgttcaaggttttttcatctcttgcgatggcggacgcgaattccaagctgctcaggaagctattaacgtcattgattcctttttcgaggagctaatacaagggactgactcgaaagtgaatcctggtttgtttggtaatccaataaacaaaaaagttacattttcgtatagcgaggatgaggatgaggaggaagatgagagtaataatggcgaggaagaggaaaacaaaggagatggggataaggcagtagtgagtgaaggcggtaatgatctagtgaatgagaaagaaatagctagtgaaggagttaatgatcaagtgaatgagaaagaaatagcaagtgaagggtcatgtgaagtcaaacaattggcagaaaatgagactgtaaaagaggaagaagataaagggaatcagaagaatggtggagatgaacctcctagaaagaagacgtgtacggaagaagcaaatcctttagcaaaagtaaacgaaaatgcagagaagtctattgataagttgattgaagctgaactaaaagaacttggagacaagagtaagagacggttcatgaagttagatccgggttgcaacggtctggtcttcatccaaatgaaaaagagagatggtgacccaagtcccaaagaaattgtacagcatgctatgacttctgctgctgcaacaaaaaagcatatgtcaaggttcatcctaagacttctaccaattgaagtgtcgtgttacccttcagaggaagaaatttcaagagccatcaagccgcttgtagaacagtacttccccattgagaccgaaaatccccggaaatttgctgtgttgtatggagcgcgtgctaacacagggcttgataggatgaaaataataaacacgatcgccaaatctattcctgcccctcacaaagttgatttgagcaatccggagatgacgatcgtggtggaaattattaagacagtgtgcttaattggagtggtagagaagtacaaggagctagcaaagtacaacctcaggcagctcacgtcgaccaattgacacatcttcttttatctttaactatgtttcgtttcttaagactgaagatgcttttgtgtttagtgttacagagtttctggc

SEQ ID NO: 305 - DNA, 2158 bp, Arabidopsis thaliana
ggaggtttcttccctagtagaccataagatcgctgagaatatgtcgtggctgcgaacggccgtgaataaggctgtggaggtcggaaaccgcaaaaacatcacacgaaccgtcaaaaactatgccgactccgtcgtccagcacgctggccaagccgtcgctgaaggagccaaattgttccaagaccgcattggtgttggggcttataagagtgttcatcagacaattcagagattggaagaagctgcagtctcatatagaggtcaagaaagggcattgctgattactagatggctaagtgtgcttaaggagattgatagagctactgacagttctctaaaggataaacaattgagttcagaggaacaacttgcttctgatgaagcaaagaaacgtgaatgggttttgtattacgatccagatataggcggtgagccacttaacttccgtgatgtttttctgcaaagtcaagctctggaggggatcgttctgtccatgattattgaaccaccacatgacgaagaaatcacgctactcctggagatgtttggcctttgtttgaatggaggaaaggaagttcatgatgccatagttagcagtatgcaggatcttgctacagtcttttcaagttacaaggatgaagttttggttaagcaggacgaattgcttcagtttgcccaaaatgccatcacagggttgaagattaatgctgaaatgctgagaattgatgctgaagcttctgatttgagaaagaaactcgaaaagatgaatgcctctcaaattccacaggagagtgaagacaaggaacataaagagactcctttaacaatagaggctttcaaagaaacacttgcaaagattcgtctttgctccagattagaaggtcttctaattagaaagagacaactaagcaatggtgactcaccagatatacatgctcagaaagtcgacaagctcagggtgttattagaatctttagcaaattcaacttccaaagccgagaaacgaatatcagagaacagacttcagaaagaggaagcactaaaagctcgtgtggtgaaagcaaatgaaaccggtgaaaaggaaaaggagttgggtgccgaaattgcacagcttgagaaacaaagagatgagctggaagccgatctgaagagggtaaatctatcgttagctgctgctcaagctcggtttcgtaatgcgacagaggagagggatcaatttggtgaagccaacaatcagataatcgctcacctgaaaacgaaggatgatgacctgtccaaatcagttgtagcttgtaagaaagaagcagaagttatcaagacgtggattaattttcttgaggatacatggcttcttcagtgctcacatatcgaaacgaaggataagcagactttggacgaattggagaagcatgaagattacttctcggatgtggccttgaatatactctctgtgtacaagaaggaggtggcacctttaataagtcgtatagaaaattatgtggaaaatctgaagaatctgggtcctgggtcggagaagccaccaaatgcagatcagggagacaatcaggtatcaaacccgaggaaaattctggaggaggagtatatagactatgagaccaagatcattaccacattcagcattgtggacaacgtgaaagagcaattccaggttctccaaagcaaactggataaaaaggacgaccggcgtgtgaaagagctgtttgatgacatggagaaaatgaggcagcaatttgaatccatagcgaggccaacgttagagatagagattccatcacctagaagcagtgttacgtcccctaaaagcagtgctacatcacccaaatctcccaagcctagcagtagtagcatgaatgcttcaactgaatctactcagacccaaaagccagagctgagcaattctcctcaggcacccaatcctgcagctggttccagtcaagagtttaaccctgaagccgaactagccgagctggaatctgaatttggtaaggtggctcgtgattactctgcagatgaggttgatggatgggaattcgatgaactggagaaagaactgcagtagtatgatccatcacacgcctgcctcacatacactgatatgtttttcatttactttctttgtttgaccataactccgtag

SEQ ID NO: 306 - DNA, 1828 bp, Arabidopsis thaliana
tccgtcgccttcgtaaagtcgccgcagctcaaaattcaataacaatgttcctttcccgcgtgaaccccacgcgcttccctccattcgtagcttctcgtcgtctcttctccgcctccgcctccgccgcttctcttcagcaatactgcacggagaagccaccgatcaaaccgtggccgcagaggctattcccgaagcgattagtctccatgatcacccaacagcagaacatcgatctcgctctccaaatatttctctacgccggtaaatctcatcccggtttcactcataattacgatacttaccactcaattctcttcaaactatcccgtgctcgtgctttcgatcccgtggagtctctcatggcggatcttcggaactcataccctccgatcaaatgcggcgagaatctcttcatcgacttgcttcgaaactacggtctcgcaggtcgttacgaatcttcaatgaggatctttcttcgaatccctgatttcggtgttaaacgctccgttagatcgttaaacacactcttaaacgttttaatccagaatcagagatttgatttggttcatgccatgtttaagaacagtaaggagtcttttggaattacgccgaacatcttcacttgtaatctactagtcaaagctctctgcaagaaaaatgatattgaaagtgcatataaagtgctcgacgaaattccttcgatgggattagtgccaaatttggtgacttacactacgattctaggtgggtatgttgctagaggtgatatggaatcggctaagagggttttggaagagatgttggatcgtgggtggtatccggatgcgacgacttacactgttctcatggatggttactgtaagttagggagattctctgaggcagctacggtgatggatgatatggaaaagaatgagattgagcctaatgaagtaacttatggtgttatgatcagagctttatgtaaggagaagaaatctggggaagcacgtaacatgttcgatgaaatgcttgagagaagttttatgccagattcttctctttgttgtaaagttattgatgcgttgtgtgaagaccataaggtagatgaagcatgtggtctgtggagaaaaatgttgaagaacaattgtatgcctgataatgcccttctgagcactctcatccattggctttgtaaagaagggagagttactgaagcgaggaaattgtttgatgagtttgagaaaggctcgatccctagtctcttgacgtataacacgttgattgctggaatgtgcgagaagggagagttgacagaggcgggtagattatgggacgatatgtatgagaggaaatgtaagccgaatgctttcacgtataacgttttgattgaagggttgtccaagaatgggaatgttaaagaaggagtcagggtacttgaagagatgctggagattggttgctttcctaacaaaacaacgttcctgatattgtttgaggggttgcagaagttagggaaagaagaggatgcgatgaagattgtttccatggctgttatgaatgggaaagttgataaagagtcttgggaacttttcttgaagaaatttgctggtgaactagataaaggggtcttgcctcttaaagaattgttgcatgaaatttctgtctcttgaagaaccaggactatgatcaatactcaaaaggctttatctatgtcctggaggctcttgtggcagatgaacgtataagggaagagaagcagccactccaggccgcttaagattcggcatccatgttccgcttcaagctatatagataatcaagcagctgacattgatggaggaagatg

SEQ ID NO: 307 - DNA, 1281 bp, Arabidopsis thaliana
caaaagaagcggaaacagagaaaaagagagaaaaatgctgagtagatcagttgcttctgctgttacaccggtctcatcttcttctctcttaccaaactcaaagcctatcttctgtctgaaaaccctctccggttatcgttcttcttctttctgtggcggctgtattcgtaaaatcaaccataagcctcttcgaatgacgagttccaatattacaccaagagctatggccacacaacagcttgagaacgctgatcagctcattgattctgtcgaaacttttatcttcgattgtgatggtgtgatttggaagggagataaattgatagagggagttcctgaaactcttgatatgcttcgtgccaagggaaagagattggtttttgtgacaaacaactcaacaaaatctaggaaacagtatggaaaaaagttcgagactcttggcctgaatgttaacgaggaggagatatttgcttcatcttttgctgctgctgcatacttgcagtctattaatttcccaaaagataagaaggtctatgtgattggtgaggaaggtatcttgaaagagctagagcttgctggttttcaataccttggaggtccggatgatggtaaaagacagattgaattgaagccaggttttctaatggagcatgatcatgatgttggagctgttgtggttggatttgatcgctatttcaactactacaaaattcagtatggaacactctgtatccgtgaaaacccggggtgtcttttcatcgctacaaaccgagatgctgtcactcaccttactgatgctcaagaatgggcaggtggtggctctatggttggtgctcttgttggatccactcaacgtgagcctcttgttgttggaaaaccctcaacttttatgatggactatttagcagacaaatttggaatccaaaagtcacagatatgcatggttggtgatagattggacactgacattttattcgggcagaatggcggttgtaagactctactcgtcctctcgggtgttacttcaatctctatgttggaaagccctgagaacaagatacaaccagatttctacaccagcaagatctccgattttctgtctccgaaagccgcaactgtataatctagtaagccccgcgtcaatcactctgtagaactcagggtactgaatctatttatgggtatacaactacagtctattcatttttctttgtgactatgtgtataataataagaactttcttgcttgtttttggcaagcttattttatttgcagtgcct

SEQ ID NO: 308 - DNA, 1145 bp, Arabidopsis thaliana
ccttcaagaacacaaagctagacagaaaaaaaaaaatgtgttcctcaaaattaaaaaatctgacccaagaaaacatttctcagatcaacggccgtccggttcttcaaccgaagtcgaaccaagttccgacattagaccgacgtaactcactaaaaaaatcgcctcctaagcctttgaatccaattgcatcaaagataccctcaccaagaccaatttctctaatctctcctcctttgtctcccaacacaaaatccttaagaaaaccggccggttcttgcaaggaacttcttaggtctagctctacaaaatcgaaaccagtgatatcaccagagaacagtgatggtggctacaaagaggttatgcctatggtgattgttcaaaagcagcctggaagtatagcagctgccagaagagaagaggttgcaatgaaacaagaagagagaaagaagaaaatttctcattacggtagaatcaaatccgtaaaatcgaatgaaaagaacttaaatgttgagcatgagaagaagaagagatgcagtttcatcactacaagttcagatccaatatatgtcgcttaccatgacaaagaatggggagttccagttcatgatgacaatctactatttgagcttctggtgttaaccggagctcaggtcggatcagattggacttcggttttaaagagaagaaacacttttagagaggctttctctggtttcgaagcagagttggtcgcagacttcaacgagaagaagatacaatcaatagtcaacgactatggcattaaccttagccaagtccttgcagttgttgacaacgctaaacaaattctcaaggtgaaaagagatttggggtcattcaacaaatacatttgggggtttatgaaacacaaaccggtcaccacaaaatacacatcatgccaaaagataccggttaagacatcgaaatcggagactataagcaaagacatggttcgtcgtgggtttagattcgttggtccgacggttatacattcgttaatgcaagccgccggtttaaccaacgaccacttgatcacatgtccgaggcatctcgagtgtacggccatggcggctttataggcaaaaggatcatgttgtaattgttgttgtagtcacattggcttttag

SEQ ID NO: 309 - DNA, 1236 bp, Arabidopsis thaliana
cttcttcccgatgtatcagtgaagttaagtagtcgagagaggggataatgatggaagtggaaggatcgatgaatcgtgctcctgatcaatcatccttcttacgatcaagacgatccaaagctctgtatcagtttaagcagcagaaactcccagcttgtaagccagtcttaacaccaatatcggttataacagtgtttatgttaatgggttttgttttcattcccattggtctcattactcttcgtgcttctcgtgatgctattgaaattatagaccggtatgatgttgagtgcattcctgaagaatatagaaccaacaaactgttgtatataactgattcatctatcccaaagaattgtacgcgctacttgaaggtacaaaagtatatgaaagctcccatttttatctactaccagcttgataactactatcaaaaccatcgccggtatgtaaagagtagaagtgatcagcaactattacatggactggagtatagccacacaagttcttgtgaacccgaggagtcatctaatggtctcccaattgttccttgtgggttaattgcttggagtatgttcaatgatacatttacgttttctcgcgaaagaacaaaactgaatgtgagccggaataacattgcgtggaagagtgaccgcgagcacaagtttggaaagaatgtgtatcctatcaatttccagaacggaactttgattggtggagcaaagttggatccaaaaattccactaagtgaccaagaggactttatagtgtggatgcgagcagctgctttactaagcttccggaaattatatggaagaatcgaagaggacttggaaccaggaaaagttgttgaagtaaatttgatgaacaattacaacacttatagctttagtgggcagaagaagcttattctctccacatcaaattggttaggaggaagaaatgatttcctgggtatcacctatcttgtcgttggttcctcttccatagtcatatccatcatcttcatgttgctccatttgaaaaatccaaggccatacggtgacaattcttggaacaagaaaagcctttcaagttgagaagctgttacattctttctctaacagattcatattccagaaaactgggtgtaagaaaaaaaaatgaccaaggaaatgaggtttgttcaaacatggggagaggtagcaccaaggcttattgcatctcaccagaaacaacaacagcaattctcagact

SEQ ID NO: 310 - DNA, 2348 bp, Arabidopsis thaliana
gagggtttcttactctgctgcttcttcttcttcttcagtagagcgagattctctcgcgctctctatcgctacatataaccatgggtttatcaacgaatctccatagcctcgacctccgttcaactttcttcaccggtctacgtacatctccaatcccttccaatttcatcaaaatctcttccatttccaaccctagacgcgatatctccaccatcagagcccaagtctccaccatcagcctcgagacctccgttaaacagcgtcaagacgaaatcgaatctcttttctcgaagcaaccctctcagcaagactccgatcggaaacgaaacgggaagagttccaaaaacggagcttctgggatatcttcaggtgtgaagctagagaacataaggaaaagctacaaaggcgtgactgtgcttaaagatgtgacatgggaagtgaagagaggtgagaaagtagggttagttggtgtgaacggagctgggaagacgactcagctcaggattatcactggtcaagaagagcctgattctggtaacgtaatcaaggccaaacccaatatgaaagtagctttcttgagccaggaatttgaggtttcgatgagtaagactgtgagggaagagttcatgactgctttcaaggaagagatggagattactgagaagcttgagaaagttcagaaggctattgagggatctgttgatgatttggatcttatgggaaggttattagatgaatttgatttgttgcagagacgagctcaggctgtgaatttagattccgttgatgctaagattagtaagttgatgccggaattagggtttgctcctgaggatgctgataggcttgtggcttcgtttagtggtggatggcaaatgagaatgtcacttggaaagattttgcttcaggatccagatttgctgctacttgatgagccgacaaatcatttggatcttgatactattgagtggcttgaaggttatttgcaaaagcaagatgtgcctatggttattatttcacatgacagagcctttcttgatcagttatgtactaaaattgtggaaactgagatgggtgtgtccaggacatttgagggtaattattctcagtatgtgatctcaaaggctgagtggatcgaaactcagaatgcagcgtgggaaaagcaacagaaagatatcgactcaactaaggacttgatcgccaggcttggtgctggtgccaattctggtcgtgcttccactgcagaaaagaaactagagaagcttcaagaacaggagctaatagagaagccatttcagcggaagcagatgaagattaggtttccagagcgtgggacaagtggaagatcggtagtcaatgttaaaaacattgattttggtttcgaggataagatgctatttaagaaggctaatctatcaatagaaagaggggagaaaatcgccatccttgggccaaacggttgtgggaaaagtacgttattgaagctaattatgggtttagagaagcctgtgaaaggtgaagttattcttggagagcacaatgtactgccaaactactttgaacagaatcaggctgaggtccttgatttggataaaacagtgcttgaaactgtttgtgaagctgcagaagactggagaagtgatgatataaaaggtcttcttggacgctgcaacttcaaagcagacatgcttgatcgaaaggtctctcttttaagtggtggggagaaagcgcgtcttgctttctgcaaattcatggtgacgccatctactttactcgttttggacgaaccaaccaatcacttagacattccttcaaaagaaatgctcgaggaagcgataaacgagtaccaaggtacagtcattgcggtatcccacgatcgatacttcatcaaacaaatcgttaacagagtgatagaagtagaagatggttgtttagaagattatgcaggcgactacaattattacttggagaagaatctggatgctagaacaaaggagctagagagagaagcagagctagaagagaaagcaccaaaagtgaaggcaaagtcaaagatgtcaaaagcagagaaagaagcgaggaagaagcagaagatgcaagcatttcaacaagctaaacagaagtcaaaggctagcaagaactccaagagatggaactgaacaaacattgaaaactgaaaggagtcaagatttataaaaaaggcttcttcacagtctcacaaaatcgtcattgtggaatgtatatagatattacttttagaaatgcagagagagtattaatgtttctacaacacttgagccccattgggtaaaaattaagaaactttattctcaaacatggaaccgaac

SEQ ID NO: 311 - DNA, 1226 bp, Brassica juncea
cattcacaccagcactcaactcagccatggcttctattaactcttctcttcttcttgtcctagccgtcgcttgtttcatctcaccggcgatttcacagacgtgctctacgcagaacgtctccaccagcttcgacagttgcatggacctccccgtactcgattcctacctccactacacttacgacgcagccaactcatccctctccgtcgcattcgtcgctactccgcctcgttccggcgactgggtcgcttggggtatcaaccccacagggactagaatgatcggttctcaggccttcctcgcttacagtcctcgagccggcgcgcgtcccatggtggacacgtacaacatcagcagctacaacctcaccccagggagacttaccttcgacttctggaacgtacgcgccgaatccatgcccggtaatctgatcgtgatttacgcctcggttaaggttccgatgggagccaacagcgtgaaccaagtgtggcagatcggcgggaatgtgactaacggtcgtccgggagtgcatcctatgactccggcgaacatggcctctacacgggtgttgagattgaccggttctgatgctccgagctctgctccgggctctgctccgggctctgctccaggctctgttccagggtctgctcaagggccgaccactcctggtgcctcgaccactccaggacaggcgggaggtccagagaacgcgggttcgatgtcgaccagcgtaaatttcggggttaattttggaattttggttatgttggctactattttcatcttttgagtatgatttcatcatctttacattactttttttttttgctcaataatggagacatatactgttgtttatctttttagtctttagagtcatttactcttttttgttttccacctatctcccctctcacccacattattattctgagttattattggatttgtatggaccattactatattatcatcttgtctgcttaaaataactgcgtttgcatcccccttcagtagtggactattgccattagattcacatagatatttattttgtccttcagcttttattttcaaaatggaatttaaaaaagctttaggataaacaaagcaatattcacatagatatttgttttgtccaacattgtttttttgtgtgttctccatttcatttgaaaagttatcaattgttttgttttgttgttgtcaatctggtgcttaa

SEQ ID NO: 312 - DNA, 1244 bp, Brassica juncea
tcgacaggaagtagcgaatctcttttaactctttaagatctgaggtgatggcgatgcgacgagtcaccggagcagctatcagagcctgcgtttcctcttcatcttcaggttccttggcacgccaatttcatgcttcttctggcgatagcaaaaagattgttggagttttctacaaggccaacgaatacgcttcaaagaatcctaacttccttggctgcgtcgagaatgctttaggaatccgcagctggcttgaatcacaaggtcatcagtacgttgtcactgacgacaaagaaggtccagattgcgaactcgagaagcatatccctgaccttcacgtcctaatatccactcccttccacccggcttacgtgactgccgaaagaatcaagaaagccaagaaccttcagcttctcctcacagccggtattggatccgaccacattgatctgcaggctgccgcagctgctggactgaccgtggctgaagtcacgggaagcaacgttgtctccgtggcagaagacgagctcatgaggatcctgatcctcatgcgcaacttcgtaccggggtacaaccaagtcgtcaacggggagtggaacgtcgctggcattgcctatagagcgtacgatctggaaggcaagacggtgggaactgtaggagctggtagaatcggaaagcttttgctgcagaggttgaagccgttcgggtgcaacttgttgtaccatgacaggctccagatgggaccggagatggagaaagaaactggtgctaagtatgttgagagtcttgatgagatgctccctaaatgcgacgttgtagtagtcaacacccctctcacggagaagacaagaggaatgttcaatagcgagatgatagggaaaatgaagaaaggtgttttgattgtcaacaacgcaagaggagccatcatggataggcaagcggtggtggaggcggtggagagcggacacatcggagggtacagcggagacgtgtgggatccgcagccagctcctaaggaccatccatggcgttacatgccgaaccaagcgatgactcctcacatctctggcaccaccattgatgcacagctacgatatgcggcggggacgaaagacatgttggagaagtattttaagggagaagacttccctgctcagaactacatcgttaaggatggtgagcttgctcctcagtacaggtaagcttgttttcaactctatctagtcttgttgtatccgaagggctag

SEQ ID NO: 313 - DNA, 1344 bp, Brassica juncea
gccaaaatgggtgcagacgcaatacaaacgaacggccaagaccccgccaagttaaccgtcgtagaagggatcgaacggttgagatgcgccgtgaagaactacgaatggggcaaactcggacatgactcactggttgcgagactccacgaggccaattcagggaaccgtgttgacccggcggttcctcacgccgagttgtggatgggtactcacgagtcaggaccgagtcacgttgtcaaggaagaagaactcgggtcgggtcatgatgggtccgaatgcatgattacgttgaagtcgtgggtttcggataatccggatgtactcgggtctagagtcgtggacaaatggggatgtgatcttcctttcctcttcaaggttttgtcagtgacaaaagcattgtcgattcaagcacatccaaacaaggcattagcagagaaattgcatagagaagagcctcttctttacagagatgctaaccataagcctgagattgctctcgctattactccttttcaagcgctttgtggtttcatatctcttaaggaactaaaggaagtgatcgccaatgtaccagagatcacagagctcgtcggaagtaaagctgcagatcaaatcttcaccgtcaacgaaaaagacggagacgagagtattaaatccattgtccgtttgatcttcacacagttaatgtctgcgagtaacaatgagacgaagcgagtcatatatgagatgaagatgcgtctaatcacggagacaaaccaccgtgaactaacggagaaggagaagttagttttggagctagagaaacagtatccaggtgacgtaggcgtgatctcagctttctttttcaactacgtcaagctaaatcccggagaagctttgtatttggacgcggacgagccacacgcttacatctccggcgactgtgtagagtgtatggcggcttcggacaacgttgttagagctggtctcactcctaaacaccgcgatgttcagacgctttgctctatgcttacctataaactgggctatccggagattttaaaaggatttcctctgactccatacattacgagatatcttcctccatttgatgagtttgaagtggaccattgtgatcttcctacagggaaatcgacgatttttccggctatctcgggaccttcggtttatctggttatagaaggaacagggaaactgcagactggttcatctcaattgttggttaaccgaggagatgttttgtttgttccggctcataacgagattcacttaactggagaaagtgatgtgatgaagctttacagagctggagtcagcagcaggttcttccagacactgtagtag

SEQ ID NO: 314 - DNA, 1554 bp, Brassica juncea
agagaaatggataggagagaagtgtatgtgcttacaattttcgtggctctctctgttagatgcgtcggctgtgttgctaattacaacaggaacgatttccctactgacttcgcttttggatctggcacttctgcttatcagtgggaaggagcttatgatgaagatggaaaaaagcctagcgtctgggacacttacgttcactctcgtaacatggagaacggagacatagcttgtgatgggtatcacaagtacaaggaagatgttcagctaatggttgaaactggcttagaggcattcagattctccatctcttggtctaggcttatacccaatggaagaggtcctgtcaacccaaagggtttagagttctacaaaaacttcatccttgaacttgtaacccatggaattgaaccacatgttacactttaccactacgatcatccccagtatctcgaggatgaatatagaggatggctcaaccgcagaatcataaaagactttacagcttacgcagatgtttgcttcagagagtttgggaagcatgtaaaattctggaccacaataaacgaggctaatatattcactgttggaggttacgacggtgggaatacaccgcctggtcgttgttctacctgcatgtcaggtaactcttccactgaaccatatatcgtagcccataacttgcttcttgcccacgcctctgcttcaaggctatacaaacaaaagtacaaggatacacaaggaggttctgttggcttcagcatatttactataggatttagaccttcaacaaactccaaggatgatgaaatggcaattcaaagattcaaagatttcttctacggatggatgctagggcctctaacatatggagactatccggaaggaatgaaaagaaaactaggaacaagactgcctgttttcacaaaggaggaagcggaacaagttaaaggctcatctgactttgtaggagtcattcactatcttgctgctactatctcaaacgctgaacccaaacctttgcttccaggagactctgctttttttgcagagattggcgcaactttgacatactctgggaacttctcaggtttcgagtatgaagttgctccatgggctatggaagtagtcttggagtatataaagcagagctttggcaatcctcctgtctacattcttgagaatggtgaaccgatgaagcaagatttgcagctgcaagagaaggacacgcctaggattgagttcttagatgcttatattggtgctgtcctcaaagccgttaggaatggatcagacacgagaggctacttcgtgtggtcctttatggatttgtacgagttgctaagcggatacaattttagttttggtttgtactctgtgaatttcagcgatcctcatcgcaaaagatcacccaaactctctgctcattggtactctgctttcctcaagaagggcaacaccaactttcctggcttccaaggtacctcgcatttgcagaccaacttgtcatcttcttcgttagctgcttcctcctagtaatcttgctttttcctt

SEQ ID NO: 315 - DNA, 2135 bp, Brassica juncea
tctgtaactgaggcttctccagccaaatccggtttcatggctatggcgtttcctctttcatatacgcccgtttctgttaaaccagtaactcactctcggagatcgaaactcgtggttttctcttcttcttctaatggaagagatccctcaccctctgaggagaagtcagtacctaatggagtgaaaagcatcgagaagcttcaagaggagaagcgtcgtgctgagttatctgctcggattgcttctggagccttcactgtacgcaaatccagcttcccatcaacagtaaagaatggtttatctaagcttggagttcccagcaatgttctggatttcatgtttgattggaccggagctaacgaagattacctcaaggttccagaggctaaagggtctattcaggctgtccgtaacgaagctttcttcatccctctctatgagcttttccttacttacggtggtatcttcaggttgacctttggtccaaagtcgttcttgatcgtgtcggatccttctattgctaagcatatattaaaggacaacgctaaagcttactccaaggggattctagctgaaattctagattttgtgatggggaaaggactcatacctgctgatggggagatatggcgtaggagaaggcgtgccatcgtccctgccttgcatatgaagtatgtagcagctatgatcagtttgtttggagaagcttcagataggctttgccagaagcttgatacagctgcatctacaggggaagaagtagagatggaatcactcttctctcgtttgacgcttgatattattggcaaggcggtttttaattacgactttgactccttaaccaatgataccggtgtgatcgaggcagtttacactgttctaagagaagctgaagatagaagtgtttcacctattcctgtttgggacataccaatctggaaagatatttccccacgtcagaggaaagttgctacttctctcaagttgatcaatgacaccctcaatgatttgatcgcaacctgcaagagaatggtagaggaagaggagcttcagtttcacgaggagtatatgaacgaaagagatccaagcatccttcactttctcttggcttcaggagacgatgtatctagcaagcagctacgtgatgacttgatgacaatgcttatagctggacatgaaacatcagctgcggttttaacatggaccttttatcttcttacaacgaatcccaaagtagtggccaaacttcaagaagaggttgattctgttattggagatagattcccaaccttagaagatatgaagaagctgaaatacacaacccgagtcatgaatgagtcattgagattatatccacaaccaccagtactgatccgtcgttccctagagaacgataagcttggaccgtatcccataaaaagaggagaggatatcttcatttctgtttggaatctacatcgaagtccccttcattgggatgatgcggaagagttcaatccagagagatggcctcttgatggaccaaacccaaatgagacaaaccaaaacttcagttacttgccgtttggtggaggaccgcggaaatgcataggcgacatgtttgcttcatttgagaatgtggtagcaatcgcaatgcttattcgaagatttaactttcagactgcagcaggagctcctccggtaaaaatgaccacaggagctacaatacacactacagaaggactgaaattgactgtaacaaagagaacaccacctctctctgttcctatccttccaatggaagctcctcgagatgaagtttcctctgctctgtcttgagtcttcttcatctttgcagaactgaagaaataaacaagctcaaagaagactaagaagaagaacaacaacaaatgcttctaattgtttctctgcgttatattatgcagacaagtagaatgtaaagaaaattattattctttgaaaaaagatatacaagtttcaaatattttctaggacatacacacgaagctcgaagttgtctatgatctaggaaagatctctgctcgtgtttggtatgcgcaacatcgagtactataaaacaaatctttcatcggtctgaaaccctcgggttgttaatgttccatgtctatggattc

SEQ ID NO: 316 - DNA, 1760 bp, Brassica juncea
gatatatggctttcaaggttacactcgtctcaacatcccccatcgatggccagaagcccggaacctctggtctccgtaagaaggtgaaagtgttcaagcaacccaattaccttgagaattttgtgcaagcaacgtttaatgcgcttactcctgagaaagtcaaaggtgccacactcgtggtctctggtgatggtcgttattactcaaaggatgctgttcagatcataattaagatggcagcagctaatggtgtacgccgtgtgtgggttggtaaaaacactctgatgtcaacccctgctgtatcagctgtgattcgtgaaagatcaggggctgatggatcgaaagcaactggagcgtttatcttaacagcaagtcacaaccctggtggccctactgaggattttggaatcaaatacaatatggaaaatggagggcctgctcctgaatcaatcactgataagatttacgagaacactaagacaatcaaggagtacccaatagcagaagatctacccaatgttgatatttctgccattggtgtaaccagttttgaaggtcctgaaggaaaatttgatgttgaagtttttgattccgcagatgactacgttaaactaatgaagtcaatcttcgactttgaatccatccgaaagttactttcatctccaaaatttacgttctgctacgatgccttgcacggtgttgctggggcctatgcgcatcgcatctttgtggaagaactcggtgcgcaagaaagtgccttgttgaactgcgtacccaaggaggactttggcggaggacatccagatcccaatctgacatatgctaaggagcttgtagcacggatgggactaggtaaatccgacactggaggtgaacctccagagtttggtgccgctgctgatggtgatgcagaccgtaacatgatccttggtaaaaggttctttgtaactccttctgattcagttgccataattgctgcaaatgccattggagccattccgtacttcagctctggtttgaaaggtgtagcaaggagcatgccgacctcagctgctctagatgtcgttgcaaaaagcttgaatttgaagttctttgaggttccaacaggctggaagttttttggtaatctgatggacgccggaatgtgttccgtctgtggggaagaaagttttggaactggctccgatcatatccgtgagaaagatgggatatgggcagttcttgcgtggatgtccatacttgctcacaagaacaaggaaaccattaacggtgacactaaactggtgacggttgaagacattgtccgccagcactgggctacctatggccgtcactactacactcgttacgactatgagaatgtagacgcaggtaaagctaaggaactgatggagcatttggtcaaactgcaatcttcaattcctgaagtcaacaagattgtgaaaggaatccgttccgacgtggcgaatgtctccagtgcggatgagttcgagtacaaagatccagttgatggatctatctcaaagcaccagggaatccgttacttgtttgaggatggatcacgacttgttttccgtctgtctggaactggctcagaaggagcaaccatcagactctacattgaacagtacgagaaggatgcttcgaagattggacgagagtcccaggaagctctgtctcctctggttgacatagctctgaagctgtccaagatggaggagttcactggccgatcagctcccaccgtcataacataataa

SEQ ID NO: 317 - DNA, 1464 bp, Brassica juncea
cgaatattgtgagggagaagaagagagcaaaaatgagctttaataggaatttgttgaatatcataataatcctttgtgtatgtctcaactgggactgtagcgagggagctcaagaaaaacagaggagggcgattgattctcatactatccaactcagttctctcttcccttcatcatcatcaccttgtgttctttctacaagagcttccagtacaaagtcctcactgcacgtgacgcacagacacggcacgtgctcgcgtataaccagtgccaaagccaagagtccagaccatgccgagatcctcagactcgaccaagcgcgcgtaaactcgattcactcgaaactgtcgaaaaaactcacagatcgagtcaggcaaagcaagtcaacggatctaccagctaaagacggaagcacctacggttcaggaaacttcgtcgtaaccctcggaatcggaacaccgaaacacgatctgtctctgatcttcgacacaggaagcgacctgacgtggattcaatgcgagccatgcgttcgaacttgctattcccaaaaggaaccaatctttaacccgtcctcctcttcctcataccacaacgtctcttgctcatcggctgagtgtagctcactctcttccgctacaggtaattccggaacatgctcggcttcgaactgcgtctacggtattcaatacggcgatcaatcgttctccgttggttttctcgccaaggagaaatttacactaacggcgtctaacgtattcgacggcgttaacttcggctgcggcgaaaacaaccaaggacttttcaccggagtcgccggacttctcggcctcggccgtgacaagctctctttcccgtcgcagacggcggcgacctacaacaagatcttctcctactgcctcccttcctccgctagctacaccggacacctcaccttcggatccgccggagtctccagatccgttaagttcactccgatctccacgatcaccgacggcacatccttctacggtctcgacatcgtcggaatctccgtcggcggtcagaaactcgcgattcctccgacggtgttctccactccgggagctctgatcgattccggaaccgtcatctctcgcctcccgccgaaggcctacgcggcgctgcgaggcgcgttcaaggcgaagatgtcgcagtacaagaatacgtcgggagtctcgatcttggacacgtgttatgatctcaccgggttaaaaacggtgacgatcccgacggtgtcgttttacttcaatggtggtgccgtggtgcagcttggctcgaaaggggttttgtacgcgtttaagatgtcgcaggtttgtttggcgtttgcggggaacagcgatgataataacgctgccatctttgggaacgttcagcagcaaacgctggaagttgtgtacgatggtgcggccgggcgggtcgggtttgctccgaatgggtgtagttaat

SEQ ID NO: 318 - DNA, 2171 bp, Brassica juncea
caatcatgccctctcacaccaacttcctcttcaggtggattggactgttttctcagaaactccgccgggaaacagctggaatctcggaaaacaacggtggagaatcgagcagcagtagcgacgacacgccggtgctgagctccggcgagtgttacgcatgcactcaagtaggcgtaccggccttccactccacaagctgcgatcaagccaacgcgccggagtggcgtgcctcagccgggtcctcactagtcccgatccaggaaggatccgcacccaccaacccggttcgaccccggctcagacgtctcaagggcccgttcggagaagttctcgatcccaggagcaagcgcgtgcagaggtggaaccgcgcgttgcttctagctcgcgggatggccttggcggtggatccgctcttcttctacgcgctctccatcgggagaactactggacccgcgtgtctctacatggacggcgcgttcgctgctgttgtaacggtcgttcgcacgtgcctggatgctcttcatctgtggcacgtgtggcttcagtttaggctggcttacgtctcgagagagtcactcgtggttgggtgtgggaaactcgtttgggatccacgcgccatcgcgtctcactatgcacgctcgcttactggcttctggtttgatgttatagtcatcctcccggttccgcaggctgtgttttggttagtggtgccaaaactgataagagaagagaaggttaagctgataatgacgatccttctgctgatcttcttgttccagttcctccccaagatttatcactgcatctgcttgatgagaaggatgcagaaggtcactggttacattttcgggactatttggtggggttttgctcttaacctcatcgcttatttcatcgcttctcatgtagctgggggatgctggtatgttcttgcaatacagcgtgtcgcttcttgtatcagacagcagtgcatgaggactgcgaactgtaacctgagtctgtcttgccaagaagaggtctgttaccaattcgtgtcacccactagcacaattgggtttccatgcttatctggaaacctcaccagtgtggttaagaagcctatgtgcttagactctgacggaccattccgatatggtatctacggttgggcacttccggtcatctccagcaactctcttgcggttaagatactttaccctatcttctgggggctaatgactctcagcacattcgggaacgatcttgagcccacaagcaactggcttgaggtggttttcagcatagttatggtccttagcgggttattactcttcactctgttgatcggaaacattcaggtgtttttgcacgcggtgatggcaaagaagaggaaaatgcagatacggtgtagggatatggaatggtggatgaaacgtaggcagttgccttctcggttaagacagagagttaggagatttgagcggcagagatggactgccttgggtggagaagacgagctggaacttatacaagatctgcctccgggtcttcggagagatattaagagatatctttgcgttgatctcattaacaatgttccattgttcaggggcatggacgatttgatcctagacaacatttgcgatcgtgctaagcctcgtgtctactctaaagacgaaaagattatccgagaaggagatcctgtacagagaatgatattcatcatgcgtgggagagtgaaacgtaaccagagcctaagcaaaggcgttgtagccactagtacgctcgaaccaggcggctacttaggcgacgagctactctcgtggtgcctacgtcgtccatttatcgaccgtcttcctccttcctccgcaacatttgtctgtctagacaacatcgaagcgttttccctgggatcagaagatcttaggtacataaccgatcatttccgctataaattcgcaaacgagcgccttaagaggactgcaagatactactcctcaaactggaggacgtgggctgcggtgaatatacaaatgtcgtggcgccggtacaggaagagaacatgtggtggtgtaggcggttcgatgagtcctgtgtcggaacatagcgttgaaggtaacagtgaacgccgtttgcttcagtatgcagcaatgttcatgtccatccgaccgcatgatcatctcgagtaataa

SEQ ID NO: 319 - DNA, 1080 bp, Brassica juncea
agaacaatctcgatctcctctctcccggaagaaagagaacatgtgcagcaagatggcgtttactctgacaatccctcgatttcactccccagtttctcgcaaacccaccacgtgttcttctccttctcctccctcgaagacccagtgtgctcacttcagccatggacgatcggtttctctcagacgaagacttttcttacttcccgtcaaagccactaccgatcagtcaggtcaggtgggtggggaagaagttgatagcaagatcttaccttattgtagcatcaacaagaacgagaagagatcaatcggtgaaatggaacaagagtttctccaagcgatgcaatcattctattacgaaggcaaggctgttatgtctaacgaagagtttgataaccttaaagaagagttgatgtgggaaggaagcagtgttgtcatgctaagttctgatgaacaaagattccttgaagcgtcaatggcttatgtgtctggcaatccaatcatgagtgatgaagaatacgacaagcttaaaatgaaactaaagatggatggaagtgagattgtgtgtgagggtccaagatgcagtcttcgtagtaaaaaggtttacagtgatctcgccgtagattattttaaaatgttcttgttgaatgtaccagcaaccgttgttgctctcggactattcttcttccttgatgaccttacgggctttgaaatcacgtacttgctcgagcttccggaaccattcagtttcattttcacatggttcgctgcggtgcctgcaattgtgtatctggcgctatcactcaccaagctgatcataagagactccttgatcttgaagggcccttgtccaaactgtggaacagagaatacatccttctttggaacaatactatccatctccaatgacagttccaccaacaatgttaaatgctccggctgtggaacggcgatggtctatgattcaagtactcgtttgatcacattaccagaaggaggcaatgcttaaaccctatgggccaaggtttcattttcaggtgaaatttatgtaaaattgatacactaatagatgaaggtggagaa

SEQ ID NO: 320 - DNA, 1091 bp, Brassica juncea
ggagaatgacaatgaactcgcttccaaggaggttcgggagagatcaaggatacctagaccgagaccaccgtagagggaggagatccggttcagactccgacgaagagctgaaaggattgagtcacgaggagtaccggaggcttaaacgcctcaagatgaggaaatctggtaagcactgcatttggaggaacacgccgagtccgcctagagatcccaacgaggtggagtccgatgagaacgccgccgacgaggaggttccggagaaggacgaggaagatccgaaatctgagtctggtaagtcggaatctgagtctgatagatctaggaagaagagaaagagtaagagctctaggagtaagcgtagtagacgatatagtgatagcgagagtgatgatgattcggatgaggaagataggaggagaaggaggaggaagaagaagcagaagagtagtaggaagaggagaggacataggaggaagaggagatacagtgattctgatgatgaatctgagattagcgcttcttcgtcttctggagaagaacgtagcaagaacattgactcgaaggggaagctagaagaagcggtgaaggagcctgagcttgacgaagaggagatgaagatgattattgaatcgaagaagaaagctttaccagaagatgaagaagaagaaggtgaggtgggtccaatgccgttacctaaagccgaaggacacatcagctacggtggtgcgttaagacccggtgaaggagacgctatagctcagtacgttcagcaagggaaacgtatcccacgtagaggagaagtgggtcttaacgctgatgagattcagaggtttgaggatcttgggtatgtcatgagtgggagtaggcatcagaggatgaatgctattcgtatcaggaaggagaaccaggtttacagtgctgaagacaaacgtgcgttggctatgtttaactacgaggagaaggctaagcgcgaggctaaggtgatgtctgatttgtcgaggcttgtgcagcgccatatgggagaagagttgggtccgaatcatgacccttttggtgctgggaagactgatggagctgatgattgatga

SEQ ID NO: 321 - DNA, 1950 bp, Brassica juncea
tcatcctccattgaagtaactgaagttgaagaagcttgtgtaagaagagaagaagatctgaagctgtgtgtgtgtatttagtgatggagactaattcttctggagaggatctgattgttaagacgaggaagccatatacgataacaaagcaacgtgaacgatggactgaggaagaacataataggttccttgatgccttgaggctttatggtagagcttggcagaagatcgaagaacatgtggcaacgaaaactgccgtgcagattagaagccatgctcagaaatttttctccaaggtagagaaagaggctgaagctaaaggtgtaccagtggctcaagcgctagacatagctatccctcctccacgccctaaacgaaaaccaaacaatccttatcctagaaagaccggaactggatctctccccatctctaaaacgggtctcaatgatggaaaacagtcccttggatcagataaagtcttggttcctgagatgaccaatgaagatctgcaggaagacaactgttcagattgtctcactcatcaacacctctctgctgcatcttccataaagacatcaaacgctagcacttttcgagagttcttaccttcacgggaacaggggaataacaaggagtcaaactcagccaattacagtgaaaatatagaggcagaacctcagacttatccaaggcatatccctatgctagttccactgggaagctccataacaaggtctctgtcacatgctccagacgagaatagtcatcatccccacacagttgcaggcgatcatcagtcgtttcccgaccatattatgtcaagccttttacagacaccagctctatacacagctgcaagtttcgcctcaacgttttggcctcctgatactagtgttggcccacaagggaacaacttaactccgaatctggctgccatggcttcagccactgttgcagctgcaagtgcttggtgggctgccaatggactgctacctctatgtgctccttttagctcaggtggtttgacctctcaccctccaactattacttatggaccttcttccggtgaagtagacgtcacaaaaacaacggatcaagaacactctgaggcgtcaaaagctcggtcttcattggactcagaggagactaaaaatgggagtaaaccagattgtcatgagcatcatccttgtgcagcaactgagactgatgcaaagggatcagacggagcaagagagagaaaacaagttgaccggtcttcttgtggctcaaacactccttcgagcagtgatgatgttgaagctgatgctttggagaggcaagagaatggtggtaacaatgatgatgaagtgaaagaagtgaatgcagacactactaacaacaatccacaaactacttcagagtcaaatgcaagacgcagtagaatcagctccaacttagctgatccatggaagtctgtttcagatgagggtcgaattgcttttcgagctctctttgcaagagaagttttgccacaaagttttacatacagagaggaaggtcaacaacaacaacaacaaagatatccaatggaacttgatcttaactccacagctgaactaactccagctgatgatgaagaagagaacagaaacatagcgtttttgggtgcttcaaagctaagtagagggagaacaggtttcaaaccttacaaaagatgttcaatggaagccaaagagagtagagtcatcaacaccaaccctatcaccatccatgttgaacagaaagatcccaaacgtattcggttggaaacacaaacttcaacatgaaaaaagttgtaactatctcttgtgcttgttctctgtttcaatattcaaaacttcaagatctcactgatacatcttcttcttcggtcttttgaggcatttgtattttgtcaatagtcttcctgtaacgtttgactctgtattatca

SEQ ID NO: 322 - DNA, 1407 bp, Brassica juncea
gtgaacagtcgggaggaagagatgatgatctctcagttcttcgtcctatctcagcgaggagataacatcgtcttccgtgactaccgagctgaggtaccaaaaggaagtacagagacattcttccgtaaagtcaagttctggaaggaggatggtaatgctgaggctccacctatctttaatgtagatggtgtgaactacttccatgtcaaggttgttggtctatatttcgttgcgactacgagggttaacgtctcaccttctctggttctggagcttctacaaagaatcgctcgtgttatcaaggattacctcggtgtcttgaatgaggattctttcaggaaaaactttgtgctcgtgtatgagttgcttgatgaagtcattgattttggttacgtgcaaactacatcaaccgaggttttgaaatcctatgtattcaacgagccaattttgattgctcctgcacgccttcaacctatcgatcctgctgccatcttcacacaagggtccaaaagaatgcctggaactgcagttacgaaatcggttgtagctaatgatcctgggggtcggagaagagaggaaatttttgtggacgtcatcgagaaaatcagtgttacttttagttcaagcggttatatactaacttctgagattgatggcactattcaaatgaagagttatctttctggtaatccagaaattcgtttagctcttaatgaggacctaaacattggaagaggagaacgatcagtatatgattataggagttcttcaggttcaggggtgatacttgatgattgtaactttcatgagtctgttcgtcttgatagcttcgactcggatagaactttgtccctggttccaccagatggggaatttccagtaatgaactaccgtatgacccaggagttcaagcctccttttcatgttaataccttgattgaagaggccggacgcctcaaggccgaagtgattattaaaatacgcgctgaattcccttcagatatagttgcaaacacgattactattcagatgccattgccaaattatacttccagggctagttttgagttagaacatggtgcggctggacagaaaacagacttcaaggaaaccagcaaaatgcttgaatggagttttaaaaagattgttggcggggctgaacatacactgcgtgcaaagctgacattttcacaggagtttcatggtaacatcacaaaggaagctgggcctgtcagcatgacgttcacgataccgatgtacaatgtttctaaacttcaggtcaaatacttgcagatagcaaagaactcaagtagtaacaatccatatcgttgggtgagatatgtgacgcaggccaattcgtacgtggctcggatatgacctactttcatattatgctgcttcgtctag

SEQ ID NO: 323 - DNA, 2291 bp, Brassica juncea
tctttcctccctttaatggctctatctgcatttgcttttccttcttacataacaaccaaaggaggtttaacagattcttgttgtaaatcaaattctctgtcttcttctcgatctttgtctgcagatcttccatcaccatgtctgaggccaaacaccagtcattcaaacaggaaggcaaaagtgaatgcttcacttgcagagaagggtgaatactattcaaacagaccaccaactccattacttgacacaatcaattacccaattcacatgaaaaatctttccaccaaggagctgaaacaactctctgatgagctgagatcagatgtgatcttcaacgtctccaaaacaggtggacatttggggtcaagcctcggtgttgtggagctcacagtggctcttcactacattttcaacactccacaggacaagattctttgggatgttggccatcagtcttatcctcacaagattctcaccgggagaagaggcaagatgccgacgatgaggcaaaccaatggtctctccggtttcactaagcgaggagagagcgagcatgattgctttggtacaggacatagctcaaccacaatatctgctggcttaggaatggcggtaggaagggatttgaaagggaagaacaacaatgtggttgctgtgattggtgacggtgccatgacggcagggcaggcttatgaagccatgaacaacgctggttatctagactctgatatgattgtcattcttaacgacaacaagcaagtctcattacctactgccactttggatggtccgagtccgcccgttggcgcattgagcagcgctcttagtcggttacagtcaaacccagctcttagagagttgagagaagtcgcaaagggtgtgacaaagcaaataggtgggccaatgcatcagttagctgctaaggtggatgaatacgctagaggaatgataagcggaactggatcaacgctgtttgaagaactcggtctctactatattggtccagttgatggacacaacatagatgatttggtagccattcttaaagaagttaagagcgcaagaaccacaggaccggttcttatccatgtcataactgagaaaggtcgtggttatccttacgctgagagagctgatgacaaataccatggtgttgtgaaatttgatccagcgactggtaaacagttcaaaactactaacaagactcagtcttacacaacctactttgcggaggcgttagtggcggaagcagaggtagacaaagacgtggttgcgattcatgcagccatgggaggtgggacagggttgaatctcttccaacgtcgcttcccgacaagatgtttcgatgtcgggatagcggaacagcatgcagttacttttgctgctggtttagcgtgtgaaggccttaagcccttttgcgcaatctattcttctttcatgcagcgtgcttatgaccaggttgtacatgatgtggacttgcagaagttgccggtgagatttgcgatggatagagctggactagtgggagctgatggtccaacacattgtggagcgtttgatgtgacgtttatggcttgtcttcctaacatgatagtgatggctccatctgatgaagctgagctttttaacattgttgcaaccgctgctgctattgatgaccgtccttcttgtttccgttaccctagaggtaacggtattggcgttgcgttgcctcccggaaacaaaggtgttcctgttgaggttggaaaaggtaggatcttaaaagaaggagagagggttgcgttgttggggtatggctcagcggttcagagctgtttaggagcggctgtaatgctccaagaacgtggattaaacgtcaccgtggcagatgcgcggttctgcaagccgttggaccgtgctctcattcgcagcttagctaagtctcacgaggtgctgatcacggttgaagaagggtccatcggagggtttggatcgcatgtggttcagtttcttgcattggatggtcttctcgatgggaagctcaagtggagaccaatggtattgcctgataggtacatcgaccatggttcaccagctgatcaaatggctgaagctggacttatgccgtctcatatagcagcaactgcacttaacttaatcggagcaccgagggaagctctgtattgagtgtcgaatctgtggaaaacatatacaagaagcaagtcatttggatgagatggtaaagacaatgtgtgtgcaaagattagttgtaatgtaaactttgttaaggggtgtgtgtgattgagatcgag

SEQ ID NO: 324 - DNA, 2441 bp, Brassica juncea
caatcatgtcgaacccagctgaatcttcggactcgaaatcgaagaaggatttcagtactgctattctggagaggaagaagtctcccaacagacttgtcgtcgatgaggcaatcaacgatgacaactccgtcgtgtctctccaccctgcaaccatggagaagctccagctcttccgtggtgataccattctcatcaagggtaagaaaaggaaggacactgtctgcatcgctcttgctgatgaatcatgtgaggagccaaagattaggatgaacaaagtggttagatctaacttgagggttagactaggagatgttatctctgttcaccaatgccctgatgtcaagtatggaaagcgtgtgcacatcttgcctgttgatgataccgttgaaggagtcactggaaacctctttgatgcttacctcaaaccttattttcttgaggcataccgtccggtgagaaagggcgatctcttcctagtaagaggaggaatgaggagtgtggagttcaaagttattgagactgatcctgctgagtactgtgtggttgctccagacactgagattttctgtgagggtgagccggtcaagagagaggatgaagaaaggcttgatgaggtgggttatgatgatgttggtggtgtcaggaagcagatggctcagatcagggaacttgttgagcttcccttgaggcatccgcaactattcaagtcaatcggtgttaagccacccaagggaattctgctttacggaccacctgggtccggaaagactttgattgctcgtgctgttgctaacgaaactggtgctttcttcttctgtatcaatggacctgagatcatgtccaagctggctggtgagagtgagagcaacctcaggaaagcatttgaggaggctgagaaaaacgctccttcaatcatattcattgatgagattgactctattgctccaaaaagagagaagacgaatggagaggttgagaggaggattgtgtctcagctccttacgcttatggatgggctgaaatctcgtgcacatgttattgtcatgggagcaaccaaccgtcccaacagtatcgacccagctttgagaaggtttggaagatttgatagggagattgatattggtgttcctgatgagattggacgtcttgaagttctcaggatccacacaaagaacatgaagcttgctgaagatgtggatctagaaaggatctcaaaggacacacacggttatgtgggtgctgatcttgcagctctgtgcactgaagctgctttgcaatgtattagggagaagatggatgtgattgatttggaagatgactccatagatgctgaaatccttaattccatggcagtgaccaatgaacacttccacactgctctagggaacagcaacccatctgctcttcgtgaaactgttgttgaggttcccaatgtttcttgggatgacattggaggtcttgagaatgtcaagagagagctccaagagactgttcaatacccggtcgagcaccctgagaagtttgagaagttcggtatgtctccgtctaagggagtccttttctacggtcctcccggatgtggtaaaacccttctggccaaagctatagccaacgagtgccaagcaaacttcatcagtgtcaagggtcctgagcttctcactatgtggtttggtgagagtgaagccaacgtccgtgaaatctttgacaaggcacgtcagtctgctccctgtgtgctcttctttgacgagctagactccattgccactcagagaggaggtggaggcggaggtgatgcaggtggcgcagcggacagagtcctcaaccagcttttgaccgagatggatggaatgaacgccaagaagactgtcttcatcatcggagcaaccaacagacccgacattattgattctgctcttctccgtccaggaaggctcgaccagctcatttacattccgctcccagacgaggattcacgtctcaacatcttcaaggcctgcttgaggaaatcacctgttgctaaagatgttgacatcaacgctctggctaagtacacgcaggggttcagtggtgctgatatcactgagatttgccagagggcttgcaagtacgccatcagagaaaacatcgagaaggacattgaaaaggagaagaggaggagcgagaaccctgaggcgatggaggaagatggagtggatgaagtgtctgagatcaaagctgcacattttgaggagtcgatgaagtatgcgcgcaggagtgtgagtgatgcagacatcaggaagtaccaagcgtttgctcagacgctgcagcagtctagagggtttggttctgagttcaggttcgagactaatgctgctggttcaggtgcaaccactggagtcgccgatccttttgccacctcggcagctgctgctgcggacgatgatgatctctacaattagtga

SEQ ID NO: 325 - DNA, 1328 bp, Brassica juncea
tgttaatggcggaatcatccaaagtgattcatgttcgtaatgttggacatgagatttctgaaaatgatttgcttcagcttttccaaccgtttggtgtcataactaagctcgtcatgctcagggcaaagaatcaggctcttctccagatgcaagatgtttcttcagcaatcactgctcttcagttcttcactaatgtgcagccaaccataagaggtaggaatgtgtatatccaattctcgtcccaccaagaattgacaacagccgagcagaatattcatggacgtgaagatgagccgaatcgtattctcttggttacagtccatcacatgctgtatccaattactgttgacgtcctgcatcaagttttttctccctatggatttgtggagaagatcgtcactttccagaagtctgctggttttcaagctcttatacagtatcaggcacaacagtgtgctgcctctgctagaacttctctacagggtcgtaacatatatgacgggtgttgccagttggatatccagttctcaaaccttgaggagctgcaagtaaattacaacaacgaccgatctagggattatacaaatccaagcctgccatcagagcaaaaaggccgtttacctcaccctggctacggtgatgcaggagtggcatatcctcagatggcaaacacatctgcgattgcagctgcctttggcggtggcttgcctccgggtataactggcacaaatgataggtgtacaatccttgtctctaatcttaatacagatagtgttgatgaggataagctgttcaatctgttttctctttacgggaacattgtgaggataaagcttcttcgaaacaaacctgaccatgcccttgtccaaatgggagatggtttccaagctgaacttgcagtacatttccttaagggagcgatgctgtttggtaagcggctagaagtaaactactcgaagcatccaaatataacaccaggcacagactcgcatgattatgtaaactcgaacctgaaccgcttcaaccgcaatgctgcaaagaactaccgctattgctgctcccctaccaagatgattcacctgtccactcttccgcaagacgtgacagaggaagaagtggttaaccatgtccaagagcacggggctatactgaacacaaaagtctttgagatgaacgggaaaaagcaagctctggtgcagtttgagaacgaggaggaagctgcggaagcactggtttgcaagcacgcgacctctctaggcggatcaattatcagaatctccttctctcagctacagacaatttaaagtcgacaaggcctctctctctaa

SEQ ID NO: 326 - DNA, 400 bp, Brassica juncea
gtgctctcgtcttcgatctccctccaggaaacaatggaagcgattaggaatctgaagataaagacatcaacttgcaaaaggatcgtgaaggagcttcactcctatgagaaagaggttgagagggaagctgccaagaccgctgacatgaaggacaaaggtgctgacccttacgacctcaaacagcaggagaatgtgttgggtgagtcgaggatgatgattcctgattgccacaaacgtctcgagtctgctttagctgaccttaagtccactttggcgggattggaagagacgacaggtccagaagttgaagatgcaaagaagactgtcgccgatgtggagaagcagtttcccactgaagatgcctgatttttatccatcctgtgagtcttgtttggcatgt

SEQ ID NO: 327 - DNA, 1264 bp, Brassica juncea
gaaactacccttgtctcctccagttcttcttagcttcaccgttaatgctagcagcagccgtacgaatctctatctaatggctaggccagctattcgagacggcgacgaagggatctcgctgctcgtgtttaacggtcacggcgaccgttcatggcagctgaacttcgacgatttccaggtgtctccggagcacaaggagaagaaatctccgagcaaactccataactgtcttggctgcttgggtccggaagacaatgtggcagattactaccagcagcaggtggagatgcttgaaggcttcactgagatggatgaactcgctgaacgtggctttgttcctggaatgtcaaaggaagagcaagacaatctagctaaaagcgagacgttagcgatcagaatatcaaacattgcaaacatggttctcttcgccgctaaagtctatgcctccgtcacaagcggctctttagcgatcgttgcttccacgttggactctcttctcgatctcctctccggcttcatcctctggttcaccgccttctcgatgcagacgccaaacccctatcagtatcccatcgggaagaagaggatgcaaccacttggaatcttggtctttgcatcagtgatggccacacttggtttgcagatcatcctggagtctcttcgcacgatggtgtccagtcacaaagagttcagcttaacaaaagagcaagagagttgggtggttgggatcatgctctctgttacattagtcaaactcctcctcgttctttactgcagatcgttcagtaacgagattgtcaaagcctatgctcaagaccacttcttcgacgtcatcacaaacatcatcggactcattgcagtaatcctagctaattacatcgataactggatggatccagttggtgctatcattcttgcattgtacacaataaggacatggtcaatgacggttctagagaacgtgaactctctcgtcgggaaatcagcaacaccagagtatctgcagaagcttacttacctgtgttggaaccaccatagagagattaggcacatcgatacggtgagggcgtacacgttcggatcgcattactttgtggaggttgatatagttcttcccgctgatatgcctctgcaagtggctcatgatattggagaagcgctgcaagagaagctggagcagctgcaggagattgaaagggcttttgtgcatcttgattatgagtacactcacaaacctgagcatgctagatcccactgttagtag

SEQ ID NO: 328 - DNA, 1203 bp, Brassica juncea
caacacccttttggattcagagaaaaatgggtggtggtgaggaagagatcaaggaacgtttacaaccagcaacggagaagaagcaacacaacgtgaaagggaagagactatggcagaaggtgaagtatcagctggttgagtaccacgcattgcctgcttacctgagagacaacgagtacatccttggtcattaccgatccgaatggcccattaaacagatcctcctcagcatctttactatccacaacgagaccttgaatgtctggacgcacttgattgggtttttcctgtttctagcgcttactatatacacagctactaaagtccctagcgttgtggatcttcactcccttcaacaccgtttacctgatgtcctgaggaaaacagatcttcacaaacttcactctgacctcatgtctcgtcttccttctagtccttctaagtggcatgtcatggagcttctttacaactgtttgcctgagagattctctcatggcaactccaccgacatgtgtgttctgcattctgtgaaggaagatcttgcgaacatgatagctcctttgatcttcagaccaatcactcgatggcccttctacgcattcctaggcggtgctatgttctgtctattagcaagcagcacttgccacctcctctcctgtcactcagagcgagtctcttacataatgcttaggctcgactacgctggaatcgcggctctcatttctacttccttctaccctcctgtctactactccttcatgtgtgatcctttcttctgcaacctctacttaggattcataacaatcttgggaatctccacggtgctcgtctcgctcttaccggtcttccagagccctgagtttcgtgttgtgagggcctctctcttctttggaatggggttctctggagctgcgccgatactgcacaagctgatcatcttttgggaccagcctgaggcacttcacacgacggggtatgaggttctgatggggttgctttacgggttaggagctttggtttatgcgactaggattcctgagagatggatgcctggtaagtttgatatagctggacatagccatcagttgtttcatgttttggtggttgctggtgcgtttacacattatagagcagggcttgtgtatctcaagtggagagacattgaaggatgttgatgatttgatgtaacctttgatgttttga

SEQ ID NO: 329 - DNA, 1209 bp, Brassica juncea
cagacgaagaaactaattcaaaggatcaagaaaccgcttcacttttaaaaagagatggtgatggtagtaggagaaacatccatggagctagaccagtgttttcagatgatgatgatgaagatggaaggagtttcgatcaaagagtggaaagacatccctgttgagcttcttatgagaatcctctcccttgttgatgatcggaatgtcattgctgcttctggtgtttgctgtggttggagagatgccatctctcttggtctcactcgtctccgtctctcttggtgcaacaacaacatgaacagcttagttctgtctcttgctcccaagtttgtaaagctgcaaactttaatactgcgccaagacaaacctcagctagaggacaatgcggtggatgccatagcaaatcactgccatgagctacaagagcttgatctcagcaaaagcttgaaactcactgaccgttccctctacgcacttgctcatggctgccccaacctcactaaactcaaccttagcggttgcacttcgttcagcgacaaagctattgcgtatctgaccaggtcctgcagaaacctgaaagttctgaatctttgtggatgtgtcaacgctgtttctgactataccttggaggctattgggaacaactgcaaccagatgcagtcactaaacttgggatggtgtgagaagatcagtgatgatggggttatgagtttagcttatggctgtccagatctcaggaccctggacttgtgtggttgtgttctcattacagatgagagtgtggtagctttagctgattggtgcgtccacttgaggtcactggggctatactactgcagaaacataacggacagagccatgtactcgctagctcaaagcggggtgaagaacaaaccaggggggcaatggaaatcatcagctaagaagagcaaattcgacgaagaagggctgcgaagtctcaacatcagccaatgcactgcgcttacaccttcggctgttcaagcggtctgcgatacgtttcctgctcttcacacgtgttcgggaagacattcgcttgtgatgagcgggtgtttgaacttgacgtctgtgcactgtgcttgtatccttcaggctcatcgctcggttcctcactcggctcactgaaagagagaggaatgggtaatgtttgtatatagatgcttaatatgttgatgaagagattagatgcca

SEQ ID NO: 330 - DNA, 1424 bp, Brassica juncea
ataagatggaaggaagaaggatcacagctagccctagaccttgcagcggaagaagagtcgtggccgcggagaaaaagaggtctcgtcccgatgggttcgtcaacagcgttaagaagctccagcgaagagaaatctcgtctcgcaaagatcgagctttctcaatcagcaccgctcaagagagattccgcaacatgcgtctcgtggagcaatatgatactcatgaccccaagggacattgtttagttgcgttaccgtttctgatgaagagaactaaagttatagagattgttgccgcgagggacattgtctttgcgcttgctcattctggtgtctgcgctgccttcagtagagagacgaacaaaagaatatgttttttgaatgtaagtccagatgaagtcatacggagcttgttctacaacaagaacaatgattccctcatcactgtctctgtttatgcttccgacaatttcagctctttgaaatgcagatccactaggattgagtatattctgagaggtcagccagatgctgggtttgctctttttgagtctgagtcattaaagtggcctggttttgtagagtttgatgatgtcaatggaaaggtgcttacgtattctgcgcaggacagtgtgtacaaggtttttgatctgaaaaactacaccatgctgtattcgatatcagacaaacatgttcaagaaattaaaatcagtccagggataatgttattgatcttcaagagagctacaagtcacgtccctttgaagattctgtcgatagaagatggcacagttctcaagtccttcaaccatctgcttcaccgaaacaagaaagttgatttcattgaacagttcaatgagaaacttcttgtgaagcaagagaatgagaatctccaaattcttgacgttagaaacgctcaactaatggaagttagtagagcagagttcatgacaccttctgcgttcatatttctgtatgagaatcagctgtttctaacgttcaggaaccgaaacgtatctgtgtggaactttcgcggagagctcgtgacttcctttgaggatcatctcctatggcatccggactgtaacacaaacaacatctacataacaagtgatcaagatctgatcatctcgtattgcaaagcagataccgaagatcagtggatagaaggaaatgcgggatcgatcaatatcagcaacatattgactgggaaatgcttagctaagataacgtcaagcagtggacctccaaaagaagatgagagcagtagcagtagcagcagttctttggggaacaactcaaagctgagaagaaacgctgtggctgaagctttggaagacataacggctctgttctatgacgaagaacgcaatgagatatacacaggaaacagacacggctttgttcatgtgtggtccaattgatga

SEQ ID NO: 331 - DNA, 425 bp, Brassica juncea
gggactcacaaacacaagaacacactttttataaactctcaaaccaaacaaaagaagaacaagaagaagaaaaatgctgatggtcaaggccacatgggtgtccattttggccctcgctgcgtttctcctagtggttctagtcccggcggcagaagcggtgacgtgctcgccaatgcagctaagcccatgtgcggcggcgataacctcgtcttctccaccgtcagcgttgtgctgcgcgaagctgaaggagcagaagccatgcatatgtgggtacatgagaaaccctagcctccgtcgctacatcagctctcccaacgctcgtaaagtctctaacacctgcaagttccccatgccaaggtgttgaaaaaagtgtgtttgcaattatatatgatcatcctataaactatgtgtcgtttgaatcctgc

SEQ ID NO: 332 - DNA, 1595 bp, Hordeum vulgare
gatattagggcaatgtgcaagggaggaaacgatttctacttcatcaataaggagacaagtgcggattcaatcaggcaaaacaattccaaaaattctcatcggatggcatttgatacagcaagaataactaaaacagagacatcaaagttgaagaacgtcatttcagcatcattcaaacccttgtctctgacaattcccataggagacggattccacgaatcgttccattcgagccattgctatttatagtatctactaaggttcataagtaagccaaaggttttcagtactattggctaagaaggggaggcaaacattgagctgcttgctgccacattttgcaatggttacaatcgttggtacacgggaacagtttgttcaaccacagtcgtgtctccgtgctacaatgcagctcaagtccccaacaaggccaaaactttccttctgctttacgccacaaggggattgcgatcaatactgtgctttaatccctggcttgccagaagacctggcaaagatatgccttgcccttgttcctcgaactcattttcctgtcatgggtggagtatccaagaggtggatgtcattcctagagagcaaagaattaattgctgtaaggaaagaggttcggaagcttgacgagtgtgtgtacgtcttgaccactgatgctggagcaaagggttctcattgggaggttttgggatgtcaggggcaaaagaacacccctcttccgcctatgcctggaccaaccaaagctgggtttggtgtggttgtccttgatgggaagctcgtggtcattgctggctatgctgctgaccatggcaaggaatgtgtttctgatgaggtttaccagtatgattgtttcctcaacaggtggactgccatttctaagatgaatgttgctcgttgtgacttcgcgtgtgcagaggtcaatggtgtgatatatgttgctggtggatttggtcctgatggtgatagtttatcaagtatcgaagtttatgacccagaacaaaataaatgggcgttgatcgggcgccttcgcaggccaagatggggttgctttgggtgtagctttgaagacaagatgtacgtcatgggtggccgttcaagcttcaccattggtaactcccgtttcattgacgtgtacgatacaaatagcggtgcctggggtgagtttaggaatggctgtgtaatggtcacggctcatgctgttcttggtgagaagctcttctgcatcgagtggaagaaccagaggtctctggcgattttcaacccagcagacaattcctggcagaaggttcctgtgccgcttactggtagttctagcacgcggttttctctcgggacacatgacgggaaattgctgctcttctcactggaggaagaacccggctatcagacactgatgtatgatcctgctgcgccaacaggctctgaatggtgcaagtctacgctcaggccatcaggatcatgcttgtgcagcgtgaccatcaaagcctgatatttcagctcggggtcgctgaaggatgatacccaagttacttcctgccttgtcttccgtggttaagatcaggctttgtttggtttatcgttgg

SEQ ID NO: 333 - DNA, 2490 bp, Brassica napus
ttaccttctacgcaggtttgtaatctgcaaaatcacctttcaatggcggcttcttcctcttcttcttctccctcgtctctcctcttaccgaacatcagtttccattccacaaccactcgttccgtttcaatccccggaatcttcctgcctagaaatcgcttgagacacagtcacactctcccgcttcgaatcagagcttccagagacgataatgtcgcagtggaagatcgtgaaaacgcagtgatcaacggaaacggaagcgtacgtctgaacggcaacggagctgcgagaaaatccatcaacggagatttaaacggaaacgtccctttaaacggcaacggtagtttggtgaagtacgtgaacggaagcgtaacggaggaagtctcgaagaagagagaagaagaaaagaggcagaagagagtagaagacatcggtcaagaggatgcttggtttaagaaaactcaacagaaacaacaagtcgaggtttctgttgcacctggtggtcgatggagtaggttcaagacttactcgaccatacaaagaacattggagatttgggggtttgttataacgtttatcttcaggacatggttgagcggtcagaagttttcatacaaagggggaatgactgaggagaagaaggttttgagaaggaaggttttggctaagtggttgaaggaaaacatattgaggttaggtcctacgttcattaaaattgggcagcagttctctaccagagtggacattcttcctcaagaatacgttgatcaattgtcagaacttcaggatcaagttcctcctttctcttctgctacggctttatcaattgttgaagaggagcttggagcatctgttgatgacattttcgaccgttttgattatgaacctatagctgctgctagtcttggccaagttcaccgtgcaagattgaagggtcaagaggttgtcattaaagtacagagacccggtctcaaggatctttttgatatcgatcttaaaaatttgagggtgattgctgagtatctccaaaaggtggatccaaaatcagatggtgcaaagagagattgggttgcaatttatgatgaatgtgccagtgtattgtaccaggaaattgattacacaaaggaagcagctaattcggaactttttgctaataacttcaaaaacttagaatatgtaaaggttccatccatctactgggagtacaccacgcctcaggtcctgacaatggagtatgtccctggaattaaaattaacaaaatacaagccttagatcagttaggtgttgatcgaaaaaggctagggagatatgctgttgaatcttaccttgagcagatcttgtctcatggattctttcatgccgaccctcaccctgggaacattgctgttgatgatgtcaacggcgggcggctgatattttacgactttggaatgatgggaagtatcagcccaaatattagagaaggtttactggaggccttctatggtgtttatgagaaggaccccgataaggtcattcaagcaatggttcaaatgggtgtgcttgtacctactggtgatttgacatcgatcagaagaacagcactgttttttctcaacagtttcgaagagcggcttgctgcacaaagaaaagagaaagaagaactagcagcagcagaagagcttgggttcaagaagccactaaccaaagaggaaaagcaagagaaaaagaagcaacggttagctgcaatcggagaagacttattagccatttcagctgaccaaccgttccggttccctgccacattcacatttgttgttagagccttttcagtattggatggcatcggcaaaggtctagatcctcgctttgatataacggagattgcaaaaccctatgctttggaattgctacggttccgggaagctggagtagaagttgtagtgaaggacctgaggaagagatgggacagacaatcacaagcattctacaatgtatttagacaagctgatagagttgaaaagctagctgtaatcatccaacgacttgagcaaggtgatttgaagcttagagtccgagcattggagtctgagagggcgtttcaacgtgtagcagctgttcaaaaaacagtaggaagtgctgttgctgcaggaagcttagtcaatctcgcaacgattttgtatctgaattctttaaaaacaccagctactatagcatacacagtatgtgctttcttcagcctccaggttctgattggggttataaaagtcaagaagttcgaccaacgtgaaaaactgatcactgggacagcttaaaagaaatcttgtttgatatattaaaaaacttcttcttcagtctccataaaatcttttgtgctaagaagccacaaagatttctcccataaagctttccgtaggagtgatgatgatctcttgttctgccatagaaaaaatcttatggaagctttagaggctagatatgttaaaaccagtgaacgaccagactcatct

SEQ ID NO: 334 - DNA, 755 bp, Brassica napus
atctcctcctagcttcttcctcttcctcctcctaaaagagaccgaacacatccaagatggtcttgtgggtgttcggatatggatctttgatatggaacccgggtttcgattttgatgagaaactcattggctatatcaaagactacaaacgtgtcttcgatctcgggtgcattgatcatagaggcacgcctgaacatcctgcaagaacttgcacgttggaggattccgccggagcaatatgctggggtgcagcttattgtgttcgtggaggacccgagaaggagaagctagcgatggagtacttggaaggaagagagtgtgaatacgactcaaaaacactcgttcaattttacacggaaactgacaccaccaaacagtccaaaccaatcttgaccggagttatagtattcacgtcaaccccagacaaagtgtcaaacaaatactacttgggccctgctccaatggaggagatggcgatgcaaatcgccacagctactggaccttgtggaaacaaccgggagtatctttttaagctggagaaagcaatgcacgacatagagcatgaggatgagtatgtgattgaattggcaaatgaggtcaggaaacatctcgacttaccaaaggaagttaaggcattgctgaaacctgttgtttctcgtgtatccatcaagtctcattctcaagctcatgtttccactcttcaacgagtctttgcatcatgagagtcaagcaaagtcatggagctaaccaactag

SEQ ID NO: 335 - DNA, 3134 bp, Brassica napus
tctccgtatctggtgatgagtgtgtgtggatgaatgttatggaaagagtgggtgaagaaacagtagggagtaacaacgtgcaattgaaaggaggaagagttgatgatgttccttgcactacgcttcatactgaatcagatgctgggaggagcgattgtcctggaagctcagctcctccaggggataagatctccgttgaagagctgacttatagagctgctgttcaagggactagtcataatcatatggagagttctaggcccgctggcaagtttgagcatctctaccgtctcggctcttctgcgtttaggggaggagatgttgattctcagccacgtgatgtggatcagatgctgtcgaggatcaggcagcagctcgcgggagctccttccgagaggcagaacttggtgaagccttttgtgaacaagaggagcgatcagaatcttgaggctttctccgagcgtctgagagcagctggtggagagaacagcgtggggcttgcgtggatcagcgacggtgtccagttgaaaatgactccgttgagttcttccagtttttctcagctgatacttaaaagagctatgaaggggaaaggcgtggttggtaaacaccaggatgctccccctcctgagtttgtttgtgagcaagatggtgtttgcaaggataaaaagttggatattagcagcaagtcgcctgttgctcaagaaccgatcccgaaaggtaatgggattgtatcgcatggtcaagggaatcatactaataactcttcttctagtggaatcagtttgagggagtttattagatcgagttatggtaaacgagagaaacgacacagcctttctctatttaggcagctggtggagctgattggctcagctcattcgcaaggattgtttttgcttgaactgagaccatcacttttcgctttggtcccgtcgaagaaacttagatataatggtactttcggaaagagcaatgtagagtcggatgttgacgaagatttgaataggaagaggcacgtggttcaggaatcatctgttgtgggtagggatttgaagaagagaagaatggacttgaacgctccagggaatcaacttcttcaggccactttgactgggagaccttgcaaaaggaaaagtcccttgattgatttaaacgtggttgatgtacgtaatccagacagttgtgaacttcaacagcaaagctatatgaaaaatttaggcgtgccttcagtgacgagaaaacagtccatgtccacttggctagaagagcaatggtacacttgtccagaggaaataaatggagaagatatcggagaaaagtcgaatatatatgctcttggtgttcttctatttgagcttctatgccattgtgagtccagtgagatgcatgctgcaatgatggcagatttacgtcatcgtattctcccaccagcatttctctcaagatacccaaaggaagctggattttgtctttggcttctacatcccgagccttcctcccgaccaacagctagagaaatactgaagtctgagttgatatgtgtggaggattcagttaaatcgactgcggctgacgaggagatatctgagctgttacttcattttttgtcttcacttgaaaagcagaagaagaaaaatgcatctaagcttttgcaagacatccaaaccttggaggatgatatcaaagaggccgagcgaagatattcttcaaaagcatcgctggtgagatctcatgaaattattgaaagcaaagtgcaatcatctcccataggcgagcgctgtacaacaacttctggcgccttgtttgtaccaactgctaatacagacaggctgatgagtaatattcgtcaacttgaagaggcatatttcttcatgaggtcacaaatgaagttatcggattctgcggctagtgcccgttctgacaaaagccttctaaaggacaaggacaagtggtctgaaaaccaaaataaagatcaggatgcgagaaccaaaggaaaatcgtcagatcaacttgaagtgtttttcgaggggttgtgcaaatttgctcggtatagcaagttcgaaacctgtggaacaatcagaagtggagaccttttaaactccgccagtgtggtctgctcattgagtttcgaccctgatgaggaacacatagcagctgctgggatatcaaagaaaatcaagatttttgacttcaacgcatttatgaatgaatctgtcggtgttcattatccactagtggagatggtcaacaaatcgaaattaagctgcgtttgctggaatagttacatcaaaaactacttggcctctactgactatgatggtgtagtccagatatgggatgctgggactggacaaggattttcccaatacacagaacaccagaagagagcctggtcagttgatttttctccatctgaccctacaaaatttgtcagtggaagtgatgactgttcagtaaagctttggagcgtcaatgagaaacggtcattaggaacaatctggagtccagcaaatgtgtgttgcgtgcaattctcttcatattccaatcatttactggcatttggttcagctgattacaaggtctattgctatgatcttcgttacgtcaaaactccttggtgcacattggctggccacgagaaagcggttagctatgttaaattcatggattcagagaccatcgtcactgcttccactgataactctctcaagctttggaatctcaacaagacaaattccactggtttgtctactggtgcttgttcaatgacgtataaaggacatacaaatcaaaagaactttgtcggattatcggtcttggatggatacatagcctgtggttcagagaccaatgaggtatatagttactatagatccttaccgatgccaatgacttcatacaagtttggatcggtggatcccatatctgggaacgaatactttgatgacaatggacagtttgtgtcgagcgtctgttggagaaaaaaatcgaatatgcttgtagctgcgaattctaccggaaacatgaagctactaaaactggtttgacatttgtgggcgagtgagttcttttggaaaacaaatctctcaagtctgtatctaagacaacagtttgacttgaacctacgttag

SEQ ID NO: 336 - DNA, 2031 bp, Brassica napus
aaagatatcatcagagaggagagtgatttggggtctgtgattggactctgtttctctagtcatgtttgattgggacgacgaagagcttactaatatgatatggggtgacgacggagagacaggcgaccatattgtgccttttaaagtaagaaacaggaaggaacagggcgatgaatctaataaggcagttaagccagctgagcagaagacaactcaccttcatgatagtaagctgggggggagcagttcagggcaaaatattgagtgtatgagctcatggcctgactcatcagtatctaatgctagaaaagctgatccaggaccaggttcgagtgagccagctagatatgattcaacaagaagtgagaaaacgtctgaacttgggaaaggccctgatatttttcatagcactgatgagagtaaagagcatggtgattttgatgagtatggatgggctaacattggtagctttgatgatcttgatcgaatgttcagtagtgatgtccctatatttggcgatggcagtctcagcggtgcagatgaattatggtcttcttctaaagatgtatccaagccgttaccatccattttggactctcaagatctaggattggacattagaactcagtttgagcaacaagagaaccagcagtttccattgactggagaaaccaatggtggtccatcatcccaaagtgcgcctagagttcgtgtaaccccaaaagctgaggaatatcatgagcataagagtcaatcctcagttgatgaccagccatatcaacaacacaaaatgatgaagctttcggaaatgttggggacttgtgaggcaggatcgtttcaagatccatacggtcagaggtcaaggagaaaatttgtaaaccagttggcaccgtcacgatcaactttgatgggtgtcaatctgcggagtgagtctcaagggtctgggacatcacattatccacagatgccaaaccaatacatggctacttctggttttggtaatccatattctgctgtgcatgtagtttcagccttccaatgtcctgatgttaacaagaatcagctgatgcatccttcctacaaccctgcttctgctatctctgcaaacacggtaacagatgtctgtgcacgaccttcaacaatgacgccgcaggaaaaactagaaaaacttaggcgcagacagcaaatgcaggcgatgcttgctattcagagacaacaacagcaatttcgtcaccaggttcctgtagcagatcagtccattactcagcttgtcgacaaaactagtcttcaagggctaactgcaataccttcctttgatcccaattcatctctggaactagatgattctggaaactttgctgctgctgttgataatccatcagaattctcggttctttatcggcttcaagatgttgtagcaaagttagatatggaaacaaggacttgtataagggatagcttattccgtttggctgatagcgcaggtcagagacatcacactagtgatacaccccacagtaataagagtagccaagatgaccgggaggttattcctcaagaaaaatccagatatagatatgcagggatgctagacacagaaacagtaaccaatcccacagacagaactgtggctcatttgctctttcataggccttttgatatgtatgcggcaaagcatacggaaggactagaatcaccatcttcttcgaagatgggagctgaagtaaaagggagttttcctagcacaagagagagtcgcatgattaagcagaaggcaaaagaggaagatgtacctgcaggttcacttgctttagggtatgcatccaactcaggatccagtagcactgttgctgagagggttgttgaagcatcccaaggaaacaaaagaaagttgtgaagtatataatattgtcccatgccatttcatattcgttcatatatgggcttgtatacagatgtattggtgactaatgttcaggtgttgcttttgtcaactatcagtttaggtttgcggtgttagagctcgagttt

SEQ ID NO: 337 - DNA, 1503 bp, Brassica napus
caaacaatggcgttgcttgtggagaagacgtcgagtggccgtgagtacaaggtcaaggacatgtctcaggccgacttcggccgtctcgagatcgagctggccgaggtcgaaatgcctgggctcgtctcttgccgcaccgagttcggaccttctcagcccttcaaaggcgctagaatcaccggttctctccacatgacgatccaaaccgccgttctcatcgaaacgctaaccgctcttggcgccgaggtcaggtggtgctcatgcaacatcttctccacgcaagaccacgcagccgccgccatcgctcgtgactccgccgccgtgttcgcatggaaaggagagactcttcaggagtactggtggtgcacggagagggctctcgactggggtccgggaggtggtcctgatctgatcgttgacgacggtggtgatgctactctcttgattcacgaaggagttaaggctgaggagatctttgcgaagacgggtcaggtccctgatccgagttctactgataatcctgagtttcagatcgtgttgtcgattattaaagatggtcttcaagttgatcccaagaagtatcataagatgaaggagagattggttggtgtttcggaggagacgaccactggtgttaagaggctttaccagatgcaggagactggagctctcttgttccctgccattaacgtcaatgactccgttaccaagagcaagttcgacaacttgtatggatgtcgccactctctccctgacggtctcatgagagccactgatgtcatgatcgctggaaaggtcgctgttatctgcggttacggtgatgtcggaaagggttgtgccgcagccatgaaaacagctggtgcacgtgtgatcgtgactgagatagatccaatatgtgcccttcaggctctcatggaaggcctccaagtcctaacccttgaggacgtcgtctccgaagctgacatattttgcaccaccactggaaacaaagacatcatcatggtcgaccacatgaggaagatgaagaacaacgccattgtctgcaacattggccactttgacaacgaaatcgatatgcaaggacttgagaccttccctggtgtgaaacgcatcaccatcaagccgcagactgataggtgggtgttccccgacaccaagtcaggcatcattgtgctagcggagggtcgtctgatgaacttgggatgcgccactggtcacccgagtttcgtgatgtcgtgctcgttcaccaaccaggtgattgcgcagcttgagctatggaacgagaagtcgagcgggaagtatgagaagaaagtatatgttttgcctaagcacttggacgagaaggttgctgcacttcacttgggaaagctcggtgctagactcaccaagctcaccaaggaccaatctgactatgtcagcatacccattgaaggtccttacaagcctggtcattacaggtactgagagaacaaaggactgagcgttcttcgtgtggtttaaagg

SEQ ID NO: 338 - DNA, 756 bp, Brassica napus
catagaccaacaacaacaacaatggcaatatcaagaacattcatgtccgttaatctcttcatcttcttcctcgttattgctacaaccaatggtcaggctccagctccaaccccttcaggtccaaccaacataaccgcagtcctagaaaaagccggtcaatacacaatgttcataagactcctcaaaagcacccaagccgcagaccaaatcaacactcagctcaattcatcatcgagccaaggcctaaccgtgtttgccccgaccgataacgcatttagcagcctcaaatccggaacattgaactcattatccgaccagcaaaaagttcagcttgttcagttccacgtccttcctacactcttaaccatgcctcagtttcaaactgtaagtaaccccttacgcacgcaagctggtgatggacaaaacggtaagttccctcttaacatcactagctccggtaaccaagtcaacatcaccaccggagttgtgagcgccaccgtggctaactccgtctacagcgataagcagatcgccgtgtaccaagtggatcaagttttgctgccattagcaatgtttggttcaagctcggcggctcctgctccggcgcctgaaaaaggcggctcggttacgacaggttcagcttccggtagcgacggtggaggagattctactgattcatctgatgcagagaggatcagatacgggataatcgccaccgtggcagccattgctgcttcttctctgtggatataataa

SEQ ID NO: 339 - DNA, 2696 bp, Gossypium hirsutum
atacgatggcagttaaaaagcggaaagagagagccgttggcggtgaatccggaaacagcaagaagttcaaaaagtattccaactccaaaggaccgatgaagaaaaacaagaacgatacgagaaagaaggggaaaggtcctcgcttgccttctgcgctacgaacggagcttgatcgcctggaccctaaaatagcttccgatagtgatgacggtatcgatttagatgttggaaacgatgtttatgagtatgaggaagaagttccacaagaagagtcccggaagaaccgccgtttcgatcctgtcgagaactatgagtatgagctacctgaggattttgaggatgagaatgtaccatcagatgacgacgacgatgatggtgactttggtgttggtgggaacaagggtagtctaaatgatgatgttgatgcgagtgatggggatgaagaggaagatgatgaaaggcacttgaggatgttgcaaggggtcactggaatgtcaactgatgcctttggaggcaagaagaagaggaatagtgtggttatatccgaggcacatcctgagtcagaatacaaccctactcgtgatgttcttgagggtgacagccacattacacttcaagatcttttggatcctattcaaggaaaagcggggtatagcaaacttagaaaaagagtgcaacacatggacagaaagtctacatctgttcaagctccattgccgaaggtagatagagagaaattggagaggatggcagtttatgaacattcaaagaaagatattactaagtgggagcatctggtcaaaaggaatagagaagctcctactgttttttttggtggagatgtagacttggggttttcaactgtaggggcaatagcttctgaatttgagcctagaactgagtttgagaagaaaattgcttctttggtttatgatgacaaagttatggaagctcacaaagcagatggttccaaacttctggagttaaataagatatctgaggaagattatatgaagcaccaggatcatgttgctaaaatgcgcggccttcttttccgccatgaaatgaagcagaagcgcataaaaaagatcaagtccaaaacctatcatcgtttaaagaataaggataaactgaaagtggaatctgcagaaatgctgatggatccagaggcagccaaagagcaggctaggaagcaagagttcaaacgagctgaggagcgaatgactttgaagcacaaaaataagtcaaagtgggcaaggcgtatcttagaacgaggtttgaatgcccaggatgaaggcactcgagcagctatggctgaacagcttcaccaacatgctcttttgacaagaaaaattaacactgttaaagacagtagtagtagcagtgatagtagtagtgacgatgatgatgagggttcaaacgaggatagggcatctgagttgctagaaaaagcaaaagagaaaacgctgaaagtattagaagacgatgaagaattgcctaattctggagttctttccttacctttcatggttcgtggactgaagaaaagaagggaagaagcgattgaagaagctaagcttgctcttcaagagtatgagcaattggagggtacaaatgatgcagaaaattcaaaaccagccactgcaagtggtagaagggtctttggcagggcaaataatgaagttccagattctaacaagaagaccaaaactgataataagatgaaaatggataattattatggtaatagtgatagtgaagacgatttgaaagccaaagagaatgttaacattgagggcggcaaaagaaatgatgttgagaaggatgttggccctaattatgatcgtaaagaagcagctgatgtttccatattcaagaattttgatgacaatggagaccctggttcaaaaacaacatatgaagttgctatttttgcttccgactcgcggagaaagatgaaaagtgagaatggaattgataaaaatgcgaaaaagttgcaacaagtgaaggaagctattgtgcataataaagacatggaggagggagaagaggatagtgattcggagagcaaacaaatggtggatgggattttgtcctcagcccccaaggaatcatatgaactcccttctcagtcagaactcattcgacatgcttttgctggggacgatgtggaagaagaatttgaaaaggataaacaggaaatcctgaacgaggaaaaccctgaaccggataaacctgttttgctccccggttggggccaatggactcatgtacagcaaaaaaaaggtttgccttggtggatgcttaaggaacacgaagacgctaagcgaaagagggaagaaagtcttaagaaaaggaaggatgcacagctcaagcatgtcattatatccgaaaaggtggataaaaaagctgagaaattgcagacaaaatctttgccctacccgttcacatccaaggaactttttgaacaaagtatgcgaatgcctattggatcagaatctaacccggagacagcaatcagaagtcttaatcgaccagaagtggtgaagaaacctggggtaattataaaaccaataaagtttgtggagatgcatcatcacgaaaaatccgaggataacaaacggagtgggcagaaacagaagaaaaataaaagcaaaggtgccagtggcaagaacaagaaacagagcaactaataa

SEQ ID NO: 340 - DNA, 1469 bp, Gossypium hirsutum
agtgtcagtttgaaagtgttcttcagatatggctatgaaacaagttgctaattctgctatcaaagcaattgccaattctgggtcatcctctcttcttaccagacaactccatgcttctccagggagcaaaaagattgttggggtgttttacaaggccaacgagtactttacgaagaatcccaactttgttggttgtgtggagggagccttggggttgcgcccatggctggaatcacaggggcatcagtatattgttaccgacgacaaagaaggaccggactgcgaacttgaaaagcatatccctgatctccatgtgctcatatcgaccccattccacccggcttacgttacggctgagaggatcaagaaagccaaaaacttgcaactgcttctcacagcagggattggctccgatcatgttgatcttaaggcagctgcagaagctggtttgactgttgctgaagttactgggagcaatgtcgtctcggttgctgaggacgagctaatgaggattcttattcttgttcggaatttcgtacctggttatcatcaagttattactggagattggaatgttgcaggcattgcttatagagcttatgatctcgaagggaagacagttggaactataggtgctggccgtatcggcaagctcttactccagcgattgaaaccattcaactgtaatctcctatatcatgatcgagtcaagatagatccagaattggagaaacagaccggagctaaattcgaggaggatcttgatgcaatgcttccaaaatgtgacattattgtcataaatatgcctctaactgagaagacaagagggatgtttgacaaagatcggatcgcgaagatgaagaagggagtcctgattgttaacaatgctcgaggagcgatcatggatactcaagctgttgctgatgcttgttcaagtggacacattgcaggttacagtggagatgtttggtacccgcaacctgctccgaaggaccatccatggcgttacatgccaaatcaagctatgactcctcatatttctggtaccaccattgatgcgcagttgcgatatgctgccggagtcaaggatatgcttgagaggtacttcaaaggtgaagactttcctgaacagaactacattgtcaaagcaggtgagctcgctcctcaataccgatgatttcgtggtttcttcgtccatgaaagagagtccaaatgtgttcggttggtagttaaacgtagctactattgaaataatgtgatgtttagtatgttgcaaataatgtgccatctatattgtgctttgaacttgatgttacgttgtaatgagttcagcttttgatggttcatctttttgagtggtggttgtcattccatgaaggagggcctctatgtaccttttcgtttttcttcaagtatcttcataataataattttttgcgaaaactttgaaatacgaatatccgaaatag

SEQ ID NO: 341 - DNA, 5229 bp, Gossypium hirsutum
tcagctccattttcattcaagtttttgaatttgggtttttattatatctgtagccttttctttttccatataagaaatggccccaaggtcagggaaaagcaagtcaagtaaagcaaaagctgagaagaagaggaaagaggagaaaattgttccttatgttcttgacatcactgtcactactccttatgaaactcaagttgtgctcaagggtatctccactgacaggatacttgatgtaagaaggctgttggcttctcatgtggagacatgtcaccttacaaactattcttttgctcatgaggtcaaagggaagagattgagtgacaaagtggaaatggttaccttgaaaccatgtttgctcaaaatggttgaagagaagtatgcggaggaagctgaggcggtggctcacgtgcgcagactggtagatattgtagcatgcacctccaggttctcgaggcctaaacgtccccgatcacaatccttatcagcgccgtcagattcaaaagccgaaaaggtcaataggcccaacaacagcgctcttccacctgcgccctcggatggcgaaacgacgccaattccggagaacttggacatggctgccattcatcccaccccgaaattatcggaattttacgatttcttctcattctctcacctctctcctcccattctcaatttgaggaaatgtgaccccaaggatgtagaagggtggcgtgacggtgactattttgtaatgcagataaaaatctgcaacgggaagttgatacaagtggttgcatcagtaaaagggtttttcactgttggaaagcacttcttccagagccactctttgttagatcttttgcaaaacctcagtcaagcctttgccaatgcatatgaatcccttatgaaggcatttgtaggacacaataagtttggtaatcttccctatggatttcgggcaaatacatggcttgtccctccccctgttgctgagtgtccagcaaacttcccctctttcccatcagaagatgaagaatggggtggtaatggtggaggtcagggaagaaatggtgaatatgatcttcggccatgggctacagatttttcaattttagccagccttccttgcaaaaccgaagaggagaggattattcgagaccgcaaggcctttttgctccatagccagtttattgatgtctcaatctttaaagctgttgctgcaatacaacatgtcatgaattccagattaaatgtcaagggccatccagactccgtccttcatgaggatcgcacaggtgacttgtccattttagtaaaacatgactcggaagatgtgaaacttgagtgtggggtaaaggttgctggccatcaatcatctgacatgactaccaatgaaattgctcgaaggaatttacttaaagggataactgcagatgagaatgtagttgttcatgatacttctgcattgggcactgtcattgttagacattgtgggtacactgcaattgtaagtgttgttggtgatgtgaagaaggaaaaatctggtgctccggatattgaaattgatgatcaaccagatggaggagcgaatgttcttaatattaacagcctaagggttttacttcacaaatccagccctgcggaagtaactggtggaggacagtcaaatcagtccaacttgattgattccaaatcttctagatgtcttgttcagcgagtaattaaagagaacttgaaaaaattagaggagaatttagctgcccctgaaaggactattagatgggaacttggttcttgttgggtgcagtatctacaaaagcaggaaacttcaacagatgctacttcaaaaggacctgcaaatgatcaggaggctgaagctgctgtcaaaggtcttggaaagcagtttaaatttttaaagaaaagggacaaaaaaccaagtaatatcagtagcacagttgagaaggaagacaatggttctgagttatgcagtgaggatgtgaagtctaatctaggacaggaaagcaacgttgagttgagcagtgagatggaattgaagcacctaatttctaaagaagccttctcacgtcttgaagaaagtggaactggtcttcacttaaagtcagctgaggagcttattaagatggcatgcaagtattatgatgacattgctttaccaaagctggtaacagattttggatcgcttgaactttctcctgttgatggtcgtacgctaactgacttcatgcatttaaggggattacagatgcactctttgggtcgtgtggttgaactttctgagaagcttcctcacatacaatcactttgcatccatgagatgattactcgagctttcaagcaagtagtgaaagcagttgtggcatcagttgagaaaattgaggatttacctgtggttatagcttcaaccctgaatttcttacttggaagttgcgaagtggatgttaatgccccaagtgcaaatgatgactatttactcaaactgacgtggttaagaaagtttcttgcagcaaaattcgattggaaactgaaagatgaattccaacatttaaggaaactttctgttcttcgcggactttgctataagattggtctagagttggttcctagagattatgatatggaatgccaagaaccgttcagaagttgtgatattattagcatgtatcctatttgtaagcatgtaggatgctcttctgctgatggccgaacattgttggagtcatccaagattgctcttgataaaggaaaactagaggatgcggttaactatgggacaaaggcattggcaaagatgatagctgtatgcggtccttatcatcgaactactgcgagtgcttacagtcttcttgctgttgttctctaccatactggagatttcaatcaggcagccgtatatcaacagaaagctttggatattaatgagagggagctcggtcttgaccatccagataccatgaaaagctatggggatctttctgtattctattatcggctccaacacatggaaatggctttgaaatatgtaaaccgtgccttattccttcttcattttacttgtggattgtctcaccctaacactgccgcaacatatataaatgtggctatgatggaagaaggcatgggaaacgttcatgttgctcttagatatctacatgaagctcttaagtgcaaccagagactgctaggagctgatcacatacagactgccgcaagctatcatgctattgccattgctctttcattgatggaagcttattcattaagtgtgcaacatgagcaaactacactcaagatacttcaagcaaaactcggaccagatgaccttcgtacccaggatgctgctgcctggcttgaatattttgaatcaaaagctctagaacagcaagaagcggcacgaactggaactccgaagccagatgcatcaattgcaagcaaaggtcatcttagtgtatcagatctcctcgattacattagtcctgatcaaggttctaaaggaaacgatgtgcagaggaagcagcggcgttccaaggtgttacagattagtgataaaacccatgatacacatcacaacttacaaacagatggtgctgtgtttattgatgcaacagataaagctacagcaactgtggatattaatgaaataggtaccctgacttctattcatcccgaagaaccagaggaaaccgataatatttctagtattgaggcaactgttacaactgaagttgttgaagatacaactttagatgaagggtggcaagaagccaattcgaaaggtcggtcaggaaatgccactggaaagaagtatggaaggaagaaaccagtttttgcaaagctaaaggtgaatggttgtgaatattcaaatggtagagagagtgggagtaggcgagacattatctcaccagcaggaaaaactgccccgaagaacattatacgggaaatgcaaacagtaaagcaatccaagtcttccagcttgaatcctagagggacttcaattggtttacctgcttctgtttccagaggttcctccccttcagcaaatcttagtgccattgcttcaaaatcactttcttacaaagaagtagctgcggcacctccaggtacagttctaaagccattattggaaccaagtgagggaaaaatggaacagtcaatgtgcgctgagacagcaaatgtagagcatgggaacaacatctctgttgtcgatgatgtagtggatgacaatggtgaaactgaaggaactcatgatacagaaagtcagtcggaagaaactgctcctgaaattgataaggtgtcttcttgtagtcaggaaaaaggtttagaagcaaaggggagtaagctatcggcatcagctgaaccattcaatcccggagcactctatcaccctttaaactcagtttctgttacatgtgtttatgatgtaacagctagtcaaggcatgcttgttgagcctgttgtacctccagttgctgctcgagttccttgcgggccaaggtcgccattgttttacagaaacaataattcttacggtagctttcttagataccaaactcctattttggaacaaaatggatttggatctccgagagttatgaaccctcatgcacctgagttcgttccaagcaaaatttggcaaatgactggaactggtgatttgagtggctctgaagaagctatgaacacagaagtgaaggaagttgataagaagttgagtagggaagttaacggttctaatccaaaaaagagcagcgcagaggagaaatccgaggtggcaaggcagattttgcttagcttcattgtccggtccgccaagcagaacatggatggtgaatgtgaggctttaatcaatgacaaaaggctcaaccattcccaaaactcttcggatgcagttacaagcgacactgcaataataaaaattctatatgggaatgaaggaaaggacttggattctcaatccagtagcaatgaagaaccaaaagcgttggatataaataataagaaacccggagatggcgaaggatttacagttgtaaagaaacggcggaaaaacgggcagcagcttactaatggagtcactgggctatataatcagcaatccatatctgcttctgtaaggtgaagaaataaccttaggaaaataacagtgtaagtgtcatcatgttccatttccagttttatttattatcatatccttgcttccatatcaacaaagcaatttagagtgaagcc

SEQ ID NO: 342 - DNA, 930 bp, Gossypium hirsutum
agcattagatagagctcccttgcaaataattgaaggagctaacaggaaatattgagatagaaaagaaaaaggaaagggaaactatgacacacttcgttctagttcatggtatgtgtcatggagcttggtgttggtacaagattgtgtcgctgctcaaatcaggcggccaccgtgtcactcccttggatcttggtgccagtggaatcaaccccaagaccatcactgacttggcttccttgtccgattatgcggagccattaatggcattaatggcctctttgcctgaagacgagaaagtgatactagtgggtcacagttacggtggggttatcatttccttagccatggaaagcttccccatgaaagtattggccgctgtttatctcacagcttttatgccgaatcatgattcttctattgcgactggagtagctgagtacttcagaagggttatggcggagccgctcatggatttccagttattgtttgaagatgggtcggaaaatccaccaactcatgccttatttggaccaaaatacatggaggcaatggtttatcaactctcaccaaaagaggatatagaattggccaacacgttgctgagacaaggaaagtggttcatgaaagatttgtccaaggaatctctgctatcaaaagagaaattcggatctgttgatcgggtttatatagtttgcaaagatgatttgctgataaaagaaagcttgcagaaatggtacatcgaaaatagccctacagatgatgtgaaattcatagctggtgccgatcatatgcccatgttttccaaaccccaggaggtctgcaaatgtctccaagaagttgctgagaagtataactgattctaccatcaaatatttcacttagccaacttcgtaatcaataaataaaacaagtgttctatgatgtacggaa

SEQ ID NO: 343 - DNA, 1643 bp, Gossypium hirsutum
cttgttgggtttagggtgaaacttaagtgaaaccactcagatgggatccggtgggagcaagggttgttgtagagtagaaggaggaggaagagacactgcacctgctgcttcctcgtctagcagcggtgggctgaggggaagatccaaggttaagaatagagttttccggtcctcttgtttgggagcgttatctagatctgcttctcctaaacccaactttgatcaccggaaacaacctgcgtcggaatcggatctggtgaaaagagaaagtaacagaaagcttgaaggcgaagcggcatctaatgaggaaatgcaattgccattgccaaccccatgcatatcttccggtggtagcacctctggtgcagctgtaacagctgctcatcgctctccttctcgctgcctctccggcattagcttccttcctggtaatttgagcttccggttcagcagagctaatagcatggggtcctccgcggagatgttgaaccctgatgacgattctgagacacttgaacctcaacaacctccccgcaattcttgttctccgattatcttcaatgattcagatggaagtggagagactctcgaaagcaacgctcgttttagcagagccttaagtgttggaaggcttcgtgatcgtgttcttggtagagctcccacattctgccctttgcaacaagacatacaaattactcagcagcaattagctacctctccatccaccactgcttccgctcatgcttcctccgttatttcccacgatgaaattgaaacttctcgatccagagaagcccggtatcatgatttgctccacaatagatccaatttccttgaaaggcggagaagaatacgatctcaggttcgagctcttcaacggctaggaagccgttttgagaacttttcagggcatgaaagatcctgcattttatctggccaacatagaagtggtcgatgcacatgtcgtgtaaataatcgagattctagttcaaatgatgacaccactggtgctaggtctagtgtatccagaatcgttatgttagctgaggctttatttgaggtcctggatgaaattcaccagcagtctatggttttatcttcgcgaccgtccgtgtctccaattggttctgttcctgcacctaatgaagttgtggaatcacttcctgtgaaagtgtacaagtcacccaaacttaagaatgatgaggctgtgcaatgttacatatgtcttgtggagtatgaggagggggatagcattcggagattgccttgtaatcatgaatttcatagaacatgtatagacaagtggctcaaggagattcacagggtctgccctctttgtcgtggggatatatgcggacctgatttgatgcctggggagaagtagagcttctggtttttatacgagaggagcattggcaactgactttggttacaaaagggaaaaagaaagagaagagaagtgataattatatactattattattgaggatgaatgtgaatgagtttgtttaatataccatctgtgatcagggtgatcaccttttggctgcacaataaaataatacaggaatgggttgggagtagtaaggggctattgaactttgtgatttgcagtgtaaggctgtgtgtaagccttcttgcct

SEQ ID NO: 344 - DNA, 1702 bp, Gossypium hirsutum
ggaagttgtttaacaccaatcacttaacaatatgagcatcgagccatttaacaggttggttaaacttgctgctcgggggttttatgatgacgtgacaacaaaaggagacaatcagccaaagacgggtcgaggggataatagagggattgctgttgtagttcttgatgctcttacaaggagacaatgggttagggaagaagatttggcaaaggagttgaaactccattcaaagcaacttcggcggattttacggctatttgaggaagaaaaattagttacccgtgatcatagaagagagacggctaaaggggcaaagatttatagtgctgcagttgctgcgacggctgatactcaaatgggtgggaaagagggagaggagaagattaaattgcacactcactcttactgttgtctagattatgcacagatatatgatgttgttaggtatagaatgcatcgtatgaagaaaaaaataaaggatgaacttgaggacaagaatactgttcaggagtatgtctgccctggctgtgggaaaagatacaatgctttggatgcattgagattagtttctttggaggatgaatattttcactgtgaaagatgtaatggagaattggtggcagagagtgacaagttagccgcgcaagatgtaggagatggagatgacaatgcacgacgacggcggcgtgaaaagttgaaggacatgcttcagaaaatggaggtacagcttaaaccattaatggaacaactcaacagagtaaaagatatgcctattccagaatttggaagtctccaagcatgggaagctcgagcaagtgctgctgggcgtgctgtaaatggtgattctggttctaatgatccttccaaaaattctcagggttatggtggcacacctatgccatttcttggggagacaaaggttgaagttgccttttctggtcttgatggcaaggaagatgtcaagtctgaaagtgctagcacatccctgaaagttttgccaccttggatgataaagcaaggtatgaacctgacgaaggaacaacgtggagaggtcaagcaagagtcaaagccagatggcagctcagcacaaccagaattttcagatgacaaaaagtccactgttgaaaatgacgataagaagaagatacaggacgagtatcttaaagcttattatgctgctttgtataagaaacaacaagaactagaagaagctgctaagaaacaacaagaattattggacattcctctagccactggtctttctgactcttccaatcgtcaagttggtatgaaagctaaacgtgatgacaatgagggagaagatgatattgattgggaagaagctcctgttgctggcaatacaactgagagttataaggtcaatgatttgaatgtggaagcagaagaatctggagatgatgaggatgatgtagattgggaggaaggctgaattaatggttcagcttcctgtgatgtgtatggcattgacaaagggtaatgggtggtttatatgtcgcactcgttctcgtataattatgtgctctttcaaagatatgaagccccctctaagtgttcgttagtaacaatcagtttcatctatcatttttctgacattgtgccaacagttgctgagggaagtccaaaagatgatttttatttggtcttaataaatggatttggcgaagttgttgtgaactatgga

SEQ ID NO: 345 - DNA, 2360 bp, Gossypium hirsutum
aaaaaatgacagcagagacagcgctaagagtatcgagttcgagttctactgtgtgcaatctaaatgggtttcaaaggagaccaacccctttatcttcttcaactcgttttctgggtcttcgtcctcgagcttcttcttcttcaatttcctcttctttatcccagttcatggggagtgtcagaattggctcaagacttcctatttcacgtcaacaaaaggggaagagaaggaacttctctctctttgctatggccgctgatgagtcaaagcgtgctgtacctttgaaagattatcgcaatattggaattatggctcacatagatgccggaaagacaacgacaacagaacgtattctatactacacaggaagaaactataaaattggtgaggtacatgagggaactgctacaatggactggatggaacaagagcaggaaagaggtattaccataacatcggctgcaactactacattttggaaagaccaccggattaatattatcgacacccctggccatgttgacttcacacttgaagtggagcgagctctcagggttttggatggagctatatgcttgttcgacagtgttgctggtgttgaaccgcaatctgaaaccgtatggagacaagctgataagtatggggtacctagaatttgctttgtcaacaagatggatcgtctaggagcaaactttttccggacgagagatatgatagttacaaatttgggtgctaaaccgctggtgattcaactaccggttggtgcagaagataattttaaaggtgtcattgaccttgtaaagatgaaagctgtgctttggtctggggaagaattgggtgcaaagtttgagtatgctgatattccggctgatcttcaagagttggctgaagagtaccgatcacaaatgatagaaacgatcgttgaattagatgaccaagctatggagaactatctggaaggagttgagcccgatgaggaaaccattaagaaattaattaggaaaggcaccattggaatcagttttgtacctgtattatgcggctcggcttttaaaaataagggtgttcagccattactcgatgctgttatggattacttgccgtctcctcttgagttgctggcaatgaaggggactgatcctgagaatcccgaagtgataattgaaaggacagcaagtgatgaagaaccgttttccggattagctttcaaaatcatgaccgatccgtttgtgggatcccttacatttgtgagggtgtattcaggaaagcttgctgcgggatcttatgttttgaatgctaacaaagggaagaaagagagaatcggtagactattggaaatgcacgctaatagtcgagaggacgttaaggttgcattggccggtgatattgttgctcttgcaggtctaaaggatactattacaggtgaaactcttagcgaccctgaccatcctattgtacttgaacgaatggacttccccgatcccgtgattaaggttgctattgaacctaagactaaagctgatgtcgataaaatggctaatggtttgatcaagcttgctcaagaagacccttctttccacttctcacgggatgaagagatcaaccagaccgtaattgaaggaatgggagaattacatctcgagattatcgttgatcgtttgaagagagagttcaaggtcgaagccaatgtcggtgcaccacaagttaattaccgggaaagtatttccaaagtttcagaagtgaaatacgtacacaagaaacaatcaggtggacaagggcagtttgctgatattactgttcgtttcgagcctatggaggcaggtagtggatacgagttcaagagtgaaatcaaaggtggagccgtgccgaaagaatatattcctggagtgatgaaaggactggaggagtgtatgtgtaatggtgtccttgcaggttttcctgttgttgatgtacgtgccgtgctagtagatggttcttaccacgatgtcgattctagtgtattggcatttcaactggcagccaggggagccttccgagaagggattagaaaggctggccctaggatgcttgaacctataatgaaagttgaggttgtcacacccgaagaacatttaggtgacgtgatcggtgatctcaactcaaggagaggccagattaacagctttggtgataagcctggaggactcaaggtggtggatgcccttgttccgcttgcggagatgttccaatacgtcagcactctccgaggtatgacgaaaggtcgtgcatcctacaccatgcaactggccaagtttgatgtcgtccctcaacatatccagaacgagcttgctactaaacaacaagaagttgttgcttgatga

SEQ ID NO: 346 - DNA, 678 bp, Gossypium hirsutum
taaccctagccacatcttcacccaaatctttaattatttgcgcttttctcatcaaaattcatcaaatcatcggaatcgatggcagctaaaccgcttacaagtgaagcaatcgctctgacagaaaagaagatggacatgacattggatgatatcattagaatgtcaaaaactagttcaaataaaaccaagaagcagcaaagggtactgaataaaggtcagaaaccttttaataatgctgctaaagcaaaggctttgaaggttcaacagtatatggattcgcggtcctctgtcagacagggatttctagctcaaagaagatcaaacatcccggggaatcaatttcctttggcagctgaggctgcacgcagggctgcagttgccccagttcgaattaagaatgtaaatggtgtcagggtggctaatttgaacaaacctaggactggagtaccacctgttcagaggagggctaagaatggaggttttgcagcaaagccacgccagcaccagccgcaacagcaacaaggagggaatgttgttacaaagcaaaggcctcatacactggattcgttgtttgccaatatgaaaaaagagcgaatgaatggtcctgcacaacgtaacggcagcagtcgacaaagaatgccatggagaagaggccgatttggcaactgatggtgttga

SEQ ID NO: 347 - DNA, 1109 bp, Zea mays
ccaggatggtggcgatcgagaaccagaaccagagccaggccgcggtggcggtggcggcggaggcggtgccggcgccggcgtcgcggatccccagggaggcgcggcgcctgctgcacgagctggcggcggcgtgggcggacgtggccgactgccgcgcgctggaggtcgtgccgctcaagggggccatgaccaacgaggtctaccaggcgcgctggctcactgcaggccctgccggccaggaggaggagcccagggcggagagggaggtgaggaaggtgctcgtgcggatttacggcgacggcgtcgacctcttcttcgaccgcgaggacgaggtgcgcaccttcgagtgcatgtcacgccatggccagggtccccgcctcctcggccgcttcccgaacggccgcgtcgaggagttcatccacgcaaggacattgtcagctgccgaccttcgtgatcctgaaatttcagctctggtggcttccaaactgagggagttccacaaccttgacatgcctggtcccaaatctgtgctcatttgggacagacttaggaactggctcagaactgccaagagcttgtgtccacctgaagaagccaaggaatttcggttggacagtctggagaaccagattactgcattggagaacgagtgttcaggtgattaccagtggattggtttctgtcacaatgatcttcagtatggcaatatcatgattgatgaagagaccaacgtgctgaccatcattgattatgagtatgcaagcttcaacccagttgcatatgacattgctaaccatttctgtgagatggcagcagactatcattcatcaaagcctcatatactggactacagcagatatccagatgttgacgagcagaagcgttttgttaagacctacctgaacatttctggtgaggaacctgatgcggaagttgtggagaacctgctccaaagcattgagaagcacacgctcgccagccatctagtatggggcctctggggaataatttcggaccatgttaacgacattgacttcgactacaaggagtacgcgaggcagagattcgagcagtactggcacaagtctgcgatcttaacatcttgatga

SEQ ID NO: 348 - DNA, 1512 bp, Zea mays
tggactgtggagagtttctgtcggtggtcgccccgcttcatctgtctcatcttccccagcgcagcccctcccccctgtagcctgtatccgccccccacactctgcgtctgcagtcttctttctcgcgtcggcagtcagcttggcagggccgaaccaatggcggtcgacccgcggcaggtggtggcgggcttcctcaccctctccatgttcgtcatgctcggcaacatgatcaagcacgaccacttctctcccgtcaccgaggagctgggcttggaggcaacaggtgtggtgtcgaacacaaggaagcttgacagcaatgctgaaatgagcagcgtcgatacggctggagtggaggacctgatggacgctgtcgaggaagttaaaccttgctggaccaaaccaagtccaaaaaatcagccgtctaatggttttgttacattctccttgactatgggccctgagtatcacatctctcagatcacagatgctgtggttattgcaaggtatctaggtgcaacacttgtactcccagacatcagaggaaatgaattaggaaataagcgaaaattccaagacatgtacaatgtggataagttcgtgaggagcctggatagtgttgtcgaagtaatagaggatatacctgatgaagtgagtgctaagaagccagcagtcatcagagtaccgaaccgtgtgactgaaagcttcatcacaggcaccattcagcccatcttccaaaaaaacaagtacttaagactagcggtcattttctcttccataagtttaaggccaaaggagacgaacaacaaggacatggacacaactgcttgccttgcgatgttcggtggcctcgagctgaagcacgaatattctgaggtggccagaaaaatgctggataggcttcaagaattaagcaagaagtcagatgggaaggtcttggcgatcgatttgcggaccgacttgctggaacagaagagttgcaagacaacccgcggcgctcgaagaaaaggctgctatagccctgatgaggtcctggctttcctgaggagtgttggcttctctgctaacacaaccatctacttgacagagacttcgtggcacaaaggcctggatgttctgaaggaagaattcccaaacacttggtataagggtgacattatgccagccgagaacaaagctgaattcctgaaatccagcaatgcagacctagcaagggctctggaccttgagatctgttcgcagagcgacgtgttcgtccctgccgtcgctggcctgttctacgggcatgtcacgggtaagaggatcgcgtccggacgcacccagatccttgtgccttcccagtccagcacctcgacacatgcttcagacttcatctccacctacatctccaacaagaaccaccttgcctacgcgtgctactgctaagcatccttttgtacggccgttaataagatcagctgaagggaaagtgctctgggtgcatatacaagtacctctcgtggacatgaatgatgt

SEQ ID NO: 349 - DNA, 1608 bp, Medicago truncatula
gctatccctaattcatgaacaaaagcatgtcaccccttattcttttaccctttgctctcttgctattcttcttgttcaaaaaacacaaaacatctaagaaatcaacaactcttccaccaggtcctaaaggccttcctttcattggaaacttacaccaacttgatagttcagttcttggtttaaatttctatgaactctctaagaaatatggccctataatctcccttaaacttggttcaaagcaaacagtcgttgtttcatcagcaaaaatggccaaagaagtaatgaaaacacatgatatcgaattctgtaaccgacccgcgttaatcagccatatgaaaatatcatataatggattagatcaaatatttgcaccatatagagaatattggagacacacaaaaaaactttcctttattcattttcttagtgtcaaaagagtctcaatgttttactcagttagaaaagatgaggtgacacgaatgatcaagaagatatcagaaaatgcttcttccaacaaagttatgaacatgcaggatcttcttacttgtcttacaagtactttagtttgtaagaccgccttcggcagaaggtatgaaggggaaggaattgagcgtagcatgtttcaaggtctgcataaagaagttcaggatttgctaatttcgttcttttacgcggattatttgccctttgttggagggattgttgataagctcaccggaaagacgagtcgccttgagaaaacgttcaaggtttcagatgaactttatcaaagtattgttgatgaacatcttgatccagaaaggaagaagttgcctccacatgaggatgatgttattgatgccttgattgaactgaagaatgatccttactgctcaatggatctcactgcagaacacatcaagcccttgatcatgaatatgtcgtttgctgtgacagaaacaattgcggcagcggtagtctgggctatgactgcactaatgaagaatccacgagcgatgcagaaagtacaagaagagattcggaaagtgtgtgcagggaaaggttttatagaggaagaagatgtcgaaaagcttccatatttcaaggccgttataaaagaatcaatgagattgtacccaattttgcctatacttttaccaagagaaacaatgacaaattgcaacattgcagggtacgacattccagacaagacattggtgtacgtgaatgcattggcgatccatagagacccagaagtatggaaggatccagaagagttttatccagagagattcataggaagtgatatagatttaaaaggacaagattttgagctgattccgtttggttctgggcgaagaatttgccccggcttaaacatggctattgctaccatcgaccttgtactttctaatcttctctattcatttgactgggaaatgcctgaaggagctaagagggaagacattgacactcatggtcaagccggacttattcaacacaagaaaaatcctctctgtcttgttgctaagaagcgaattgaatgcgtgtgatcttcaacttgcatgttatgctatatttatgtgaagaaaataaagcatgcatgatgaggtctttgaagagtgt

SEQ ID NO: 350 - DNA, 709 bp, Medicago truncatula
aaatcataggaatgaaactgtgaacacagttactacttaaagttacaaactttaattcttaaaacattaacacccaaaaaattgtattcatcacttgcttaacagtacaaaaggttttggtttcaaccctttttctggtttttgcttcagagttatagatgatagctagctccttctgcaatgctgattctatgttttctagtgaagaagggatagatgttagaaagatgatgggacataaaaggagcccctgctctgttgatcaaagcaattataattctattgcatctaaaaagcaaaagcctgatttgtcgatcagcactaaggataggaaggaaaagattggtgaacgaattgttgctcttcaacagcttgtttcaccatatggaaagacagatacatcttctgttctaaaggaggcgatggactacatagggttccttcataaacaagttaagctgcttagcgctccttacctcgaaactgcaccagcaacccagttacaggatacagagtcatgcagcctgaggagtagagggttatgtattgttcctgtctcgtttactaatggagttgctgagggaaatggtgcagatatttgggcaccaatcaagaccacttcacctaaacatgagaaagatgtctcgcaattttagtgattaattctgtcagcttagccgccttaaggttgctaagtcactaaaccggt

SEQ ID NO: 351 - DNA, 1304 bp, Medicago truncatula
agtcagacttcacacagcaaagaccaaagagctgtttttgttttgtctgtcttcttttccgaagaatagctatgagttctgaaggtgttggtgaagattgccttgcatgggcagcaagagatgcatctggtgttctgtcgccttacaaattcaatcgaagggagctcgggagtgaagatgtttatgttaaaattacacactgcggtgtttgttatgctgatgtaatttgggcaaagaataaacatggggattcaaagtatcctgttgtacccggacacgagattgctggggttgtggcaaaggttggtcccaatgtccagcgtttcaaggttggtgaccatgtcggagtggggacttacatcaactcatgcagggaatgtgagtattgtaacgatcgattagaagttcattgtgtcaagggatcagtttacacctttaatggtgttgattatgatggcacaattacaaaaggaggatactccacttccattgtagtacatgaaaggtattgcttcttgatacctaaaagctatcctctagcttcagcaggtcctttgctctgtgctggaatcactgtttattctcccatgattcgacataatatgaatcaacccggcaagtctcttggagtggttggtcttggtggcctcggtcatatggcggtaaaatttgggaaggcatttggtttgcgtgtaacggttttcagcactagcatgtcaaagaaagaggaggcgctgagccttcttggtgcagaccaatttgttgtttcatctaatcaagaagagatgagggcgttggctaaatcattggattttataattgacacggcatcgggtgatcacctgtttgatccttacatgtcacttctgaagatatctggtgttctggtcttagttgggttcccaagtgaagtcaaattcagccctgcaagccttaatttaggatcaagaactgttgccggaagtgttgcaggtggtacaaaagaaatacaggagatggttaacttctgtgctgcaaatgggattcacccagatatagaactgattccaattgggtactcaaatgaagctcttgagagggtcgtaaataaggacgtgaaatatcgttttgtaatagacattgaaaactccctcaagtagaattagagaaacatgaagttgattctgaagttagacatggaaggactacctttttagatattacacaccagcagcaaagagaaatgttgagtgttcccataatgattgccggatatagagatgattcaaatttcatatatctagtgatgcaaataaagctcttga

SEQ ID NO: 352 - DNA, 1080 bp, Medicago truncatula
cacataccctctttcttcaattcattcaatggcggatcagaacaaaaaacctgagatctttgaactcaacaatggcaccatgcagctcctagttaccaatcttggttgcactatcacctccttttctgttcctgccaaagatggtgtgttatccgatgttgttcttggccttgactctgttgaatcctatcagaaaggtctagctccttattttggctgcattgtgggtcgggttgcaaaccggattaagaatggaaagtttacacttgatggggttgagtactcgttgcctctcaacaaagccccaaacactctccacgggggaaatgttgggtttgataagaaggtatgggatgtacttgaatataaaaaaggcgaaactccatcaattacttttaagtatgacagtcatgatggagaggaaggttatcctggcgacatcactgtcactgcaacttacacgctcacctcaagcacgactatgaggctcgacatggaaggagtggcaaagaacaagccaaccatcattaacttagctcagcatacctattggaacttagctggccatagctcagggaatattctcgaccattcaattaagatatcggctaatcatgtcactcctgttgatcagaacaccgtgccaaccggtgaaattgtgcccgtgaagggtactccttttgatttcacatctgagaaaagaataggtgataccattaatcaagttggtttaggatatgaccacaattacgtgcttgactgtggcgaagagaaagccggtttgaggcatgctgcaaaagttagggatccatcaagttcaagggtacttaacttgtggacaaatgcacctggggtgcaattttatactggaaattacgtcgacaatgtaaccggtaaaggaggagctgtatatggaaagcatgccggattatgtctcgagacacaaggattccctgatgcagtaaacaaaccaaattttccatccattgttgttaaacctggcgagaagtatcagcattctatgttgtttgagttttcgattgaataaacattgttggagagttggagtgagtactgata

SEQ ID NO: 353 - DNA, 1061 bp, Medicago truncatula
ccaaaatggccacaacacaaactgaattaattcctcctcctcaggtcccacttggaacccaaggctttcaggtttcaaaattgggtttcgggtgtatgggactcactggagcttacaatgatcctcttcctgaacaagatggtatttccgtaattaactatgctttcagtaaaggcattactttttttgatactgctgatatctatggaggtagtggtgctaatgaaattttacttggaaaggcattaaagcaattgcccagagaaaagatccagttggctacaaaatttggtatatctagaagagacttttctcgtctcgctgatgtgaccatcaagggttcacctgagtacgtgcgctcgtgttgtgaagctagcttgaaacgtctcgatgttgaatacattgatctctattatcagcacagaattgatacttctgtgtctattgaggatacagtaggtgaacttaagaaactggtggaagagggaaaagttaagtatattggactatctgaagccagccccgatacaataaggagagcgcatgctgttcatcccatcactgctgtacaaatagagtggtctctttggactcgcgacattgaggaggagatagttcctctctgcagagagcttggtattggaattgtaccatatagtcctcttggtcgtggtttctttggtggcaaaggggttacggaaaatgtgcctgctgttagctccctgacttctcatccccgcttccaagctgagaacttgaacaagaacaaaaacatatatgataagatcgaaagtcttggcaaaaagcatgggtgcactcctgctcagttagcattagcatgggtactccaacaaggaaaggatgttgtgcctattcccggaacaacgaagattaagaatctggatcaaaaccttggtgccttagcagtgaaactatcagaagaggacctgagagaaatttctgcagcggttcctgtggatgatatagcaggtagtagatactacaatggatttgatcatatttcctggaagtttgctaacacacctccaaaagtttgatga

SEQ ID NO: 354 - DNA, 923 bp, Medicago truncatula
tgttacacctagagagagaaagagagagacaaagaaactatgaaatttgttgttgttggattttgattgaaaaaagaaaaacagtattttgaggaaacatgtacataagtggtggttcttcttccatgggaaggtcttttaaggaatctcttaaactgcttgaagctgatattcatcatgccaataccttggcatctgattttccgagggaatatgatggtgcttgtcttcaaatgagaatgtcatacagtccagcagcacacttgtttctttttctggttcaatggacagattgcaatcttgctggagcccttggattattaagaatcctaatttacaaggtgtatgtggatgggactactaccatgtctacacatgaaagaaaagcaagtattagggaattctatgcggtcatatatccgtctttgttacaacttgaaaaaggtgtcactgatgctgaggataaaaaacagaaggttgtatgcatggagcgatatcgtagaagagaagatgaggagcacaaacaattctcagacatagactttgaaagagaagaagagtgtggaatatgtatggagatgaatagtaagattgtgttgcctaactgcaaccatgtcatgtgcctgaaatgttaccatgaatggagagcaagatcacagtcatgccccttttgtcgtgacagtcttaaaagagtgaactcgggcgatctctggatatttaccgatagtagggacatagtagacatggaaacggtaacaagggagaatcttagaaggcttttcatgtacatagataagttacctttgatcataccagaatccctttttgacccttatgactctcacttaagataagtaactgtgacacacagaaatgtgttctttgatggatggacacacagaaatgtgttctttgatggatag

SEQ ID NO: 355 - DNA, 1931 bp, Medicago truncatula
taatggcgaagtgaatgaatacccgatctgaaatcatttagatccattccaaatgggtttcttcagtacaatttttggttttttcggatttggtgttggaatttcaattggtctcgttgttggttattttctcttcatctactttcaacctacagatgttgaggatcctaagattacgccaatagtggaccaagacgatgagactttgcaaaaaatgcttcctgagattcccaattggattaaaaatcctgactttgatagggttgattggttgaacaagtttatagaacttatgtggccttatcttgataaggcgatttgtaagaccgcgaagaacattgcgaaacccataattgaagagcagattccaaaatataaaattgattctgttgagtttcagacgctcactctcgggaccctgcccccaacttttcaaggaatgaaagtttatgtgactgatgagaaggagttgattatggagccttctataaaatgggctggaaatcccaatgtcaccattgctgttaaggcatttgggttgaaagcaaccgttcaggttgtggatttgcaagtttttcttttgcctcgcattacattgaagcctttggttccaagctttccttgctttgccaacatctatgtcgctctcatggaaaagccacatgttgactttgggctaaagcttttaggggctgatcttatgtctattcctggtgtctacaggattgttcaggagcttatcaaagatcaggttgcaaacatgtatctgtggcccaaaaacctggaagttcagatattagatatggcaaaagctatgaggaggcccgttggaattttacatgtaaaggttctgcatgctatgaagttaaagaagaaagatcttctgggtgcatctgatccttacgtgaaactaaagcttactgacgataagatgccatcaaaaaagactactgtaaagcacaagaacttaaatcctgaatggaatgaagaatttaatttggtagtcaaagacccggagacccaggttttacagctcaatgtttatgactgggagcaggttgggaagcatgacaagatgggtatgaatgtgatcactttaaaagaagtttcccctgaagaacctaaacgttttactctggaccttctaaaaactatggatcccaatgatgctcaaaatgagaaatcgcgaggacagattgttgtggaagtgacttataaacccttaaatgaagaggagatgggcaagggctttgatgagacacagacaattcctaaagctcccgaaggcactccagctggtggaggtcaacttgtagttatagtccatgaagctcaagatgttgaggggaagcatcacactaatccacaagcacgtcttattttcagaggggaagagaaaaagactaagcgcataaaaaagaacagagatccaagatgggaagatgagttccaatttatagcagaggagcctcctaccaatgataaactacatgtggaggttgtcagcagttcctcacgaaccttgcttcatcaaaaggaatcactgggttatgtcgacatcaatctcggggatgttgtttctaacaagagaatcaacgagaagtaccatcttatagattctaagaatggtcgcattcaggtagagttgcagtggagaactgcataagcatgatggtgaaattctccatacatatgtacttctgattccaccctcaccccccaaaaccatctcttaaattttagtctccgtgcagtgtaacaaaaacagtgagaagggcatttcttgtattcttgagttagactgattttatttgtcaatcatgtacatgcctgtgataaaaaaaaaaggtttgtttgaatagcaaaagaacatttgttttgatttggatatataccagcaagggtttcggtcccgtggataaatattctgt

SEQ ID NO: 356 - DNA, 791 bp, Medicago truncatula
ccttcccttcactctagtcagtctacaccactgtctacctcatttctgcacattttcggcgacacacactcttccaggatgaagatgatgtcattggttcggccactcttgatgaggcgaggattcagcacgagctctgagaaaatggttgcctctgtgctgtttgagagattgcctgtggttattcccaaaattgaccctaatgtttatgcttttcaagaattctcgtttcgatggcggcaacaatatcaacgcagatatcctgatgaatttctagacagatccgatgcaagggggaaaggtgattatcagattgactatgtgccagcaccgcgaatcaccgaagcagacaaacaaaatgatcgaaggtcactacaaagggctcttgatagaagactttaccttcttctctttggtgatgcttatggggctccaagtggaaagcctgtgtggcattttccagaaaaagtatatgaatcagaggataccatgcgtaagtgtgcagaatctgccttgaaatcagtcttgggagatctttcaaatacatattttgtcggaaatgctccgatggcccatattgttgttcagcctaaagaagagcagacaggatcaacatcttttaagaaattcttcttcaaatcacaagtaattgctaaaaacaagttcgacattggcaaaggtgaggactttgtttgggtgactaaggatgaattgatggagtattttcctgagcaagctgagtttttaaacaaaatgatcattagctgatgacagtggagatggttgtttaa

SEQ ID NO: 357 - DNA, 1754 bp, Medicago truncatula
cgtttcaacagtcatcatcttcaacaccatggttctattctaagcacttaaacgacgacgtcgttttaacactgatcttcgttacaatggagtgcgttggagcgagaaacttaacggcaatggcgttttgcataagtccttctttgcggttaaggagaaagaagatttgttggagaagaagagaagcttcatcgaacgtgattcggttgcgttcgatgaaagtgtatgcgaaagcaggtggtgcaggaagtgagagctgtgttgttgctaaagaggattatgctgatgaggaggattttgttaaagctggtggttctgaacttgtttttgttcaaatgcagcagaaaaagtctatggacttgcaatctaagcttgcggataagttgccacctatctctgttggagatggtatactagatttagttgttattggttgtggtcctgctggtcttgctctagctgctgaatctggcaagttaggattaaaagttggacttattggcccggatctccctttcacaaacaactacggtgtgtgggaggacgaatttaaaggtcttggacttgaaggttgtattgagcatgtttggaaggataccgttgtatatattgataataaaaatcccatttcaattggacgttcttatggccgtgtcagtcggcatttgcttcacgaggaattgttaagaaggtgtgtcgagtcaggtgtctcatatcttggctcaaaagtagaaaggattgttgaggctagcaatggtcataatcatgttgtctgtgaatatgatactgtagtgccttgcaggcttgctactgttgcatcaggagcagcttcagggaaactattgcagtatgaggttgggggtccaaaggtgtgtgtacaaacagcttatggtgtggaagttgaggttgaaaacagtccttatgatccaaacgtgatggttttcatggattacagagactatatgaagaacaatgttcaaagtctagaagctaaatatccaacatttctttatgcaatgcccatgtcccgttcaaaagtgttctttgaggaaacatgtttggcgtctaaagatgccatgccttttgatttattaaagaaaaagctcttatcaagattaaagacgatggggatcaaagttacaaaaacttatgaagaggaatggtcttatatcccagttggtggatccttaccaaacacagagcagaagaaccttgcgtttggtgcagctgccagcatggtgcatccagccacaggctactctgttgtgagatcgttgtcagaagctccgcaatatgcttcagtaattgctacaattttgaatgacggtaatgcaagggacattgttacttatggaagaagtaaggagaatccatccatgcgagcttggaatacactttggccacaagaaaggaaacgacagagatcattctttctttttggattagcactaattgtgcagctggacattgaaggcactagaacattctttcgtactttcttctgcttacctgagtggatgtggcaaggatttcttggttcttctctgtcctcgaaagatcttctattgtttgcactctacatgttcataatagcaccaaataacttaagaatgtctctagtcagacatctgctttcagatcctacagggtcaactatgataaaaacctacttgacgatatagtacgtttctataaactttttcctcttgttaggtaccctctattgggagacaggctagattacattaggagcc

SEQ ID NO: 358 - DNA, 1212 bp, Medicago truncatula
tggtgaaatggcagctactaccgccactcccgctgctctcaggtttcttcctccaaatcccacaaccagaaaaacattcaacttcttctcaattctaaaaccaaatttcaactcacttcgttcattctctcattcatcattattttctctatctcacaaataccctctttctccctgcaaatgctccttcactgcccccgtttccactacaacttacgagttttctgataatgcttcagagatggagttaagattaaatataggaagcatggatgtaagaagcgcaaaagacatatcggttgatgcaaacgatacatctttaactatcagagtgttgcagtcgggatctccaattacgttgatagacaccaatcctctttttgacaggattaaaccctcagaaacaatatggtatatagatgatgatcatcttgtggtgaatttcaagaaaaatgatcctgagttgaaatggcctgacatcatggaatcatgggaatcacttgctgctggatcatcacagcttttgaaaggaacatccatctatcttgttggtgattccactgaaatcaaccagaaagtggctgaagagcttgctactggtctggggtacacgccactaagtacaaaagagttacttgaaacttattcaaaccaaaccgtggattcatggctgcttgctgaaggttctgactcagtagccgaaggcgaaggcactgtacttgaaagcataagtagtcatgtaagggcagcagttgcaacattaggaggtaaacatggtgctgctggaagatctgataaatggcgacatctctatgcaggatttactgtctggttgtcacagactgaagcatcagatgaagattcagcaagggaggagacacacagaaacgtcaaagatcgcataactgcatatacaaatgcagatgtggttgtgaaattacagggatgggatcctgcttatgctaaaagtgtggcacagggatgtttgagtgccctaaaacagttaatcctatcagacaagaaacttccaggtaaaaaaagcctatacataagattgggatgtcgtggtgattggccaaacatcaaaccccctggttgggatccatcaagtgaaggtggtgaaactcttggcacgcaataataatgcttgtaatattaataacaacgggtaacatcaaattttttcagcagcagttggagttcttggttgca

SEQ ID NO: 359 - DNA, 1790 bp, Medicago truncatula
aataaaccacttttctttctaagtctgttaattcagtttatttaccatggcaatttccgatacaccggaaaccactgcaaccgccacagccaccgtaacaaccatcgaaaccgacacagatctcaaacgctcttcactccgacgacgaccgagcgccacatcaaccgccggtggtctcttcgacgcggaaagtgcagctgcagatgcggttcgagattcaggctccgatgattcgttgaacggtaagatcaacaacgaagaagaggttaaagatcgaaaaacggatcatgcagaaggaattgttgatgataatgcggttaagaagaatggtggtaatgacgtcatcaatgatcgtgaaaatgttactgtcgatttcaaattcacttatcgtccttcagttcccgctcaccggagaagcaaagaaagtcctcttagctccggcaatatttttagacagagtcatgcaggactgttcaatctctgtattgtggtgcttgttgcagtgaatagtaggcttattattgaaaatctgatgaagtatggatggttgattcgatctggcttttggtttagttcaaaatcgcttagagattggcccctcttcatgtgttgtcttagtcttgcaatatttccacttgctgcctttgtagtcgaaaagttggcccaacaaaaacgtatttctgaaccagttattattctacttcatattgtaattacgactgttgcgatcatctatccagttttagttatcctctggtgcgattctgcttttttatctggttccacgttaatgctattgacttgcatagtgtggttaaaattggtgtcatatgcacatacaacctatgatatgagagcgcttgctgtttcaaatgaaaagggagaaacaatgcccgatactttcaatatggaggagtacccacacaatgtgagcttccagagtttagcatacttcatggttgctcctacattatgctaccagccaagctatcctcgcacaccttcggttcgaaagggttgggtctgtcgacaacttctcaagctggtcatatttacaggagttatgggatttataatagaacaatatatgaatcctattgtccaaaattcacaacatccattgaagggaaaccttctatatgccattgagagagttctgaagctttctgttccaaatgtttatgtgtggctgtgcatgttctattgctttttccatctttggttaaatatacttgcggagcttctccggtttggtgatcgtgagttctacaaagattggtggaatgcccaaacggttgaagagtattggaggatgtggaatatgcctgtgcacaaatggatggttcgccacgtgtattttccctgcataaggtttggtatacccaagggtgctgctgctttgactgctttcctggtttctgctgtgttccatgagttatgcattgctgttccttgccgcatgttcaagttgtgggcttttattggaattatgttccaggttcctttggtcttgatcaccaattacctgaaaaataaataccgaaactcaatggttggaaatatgattttttggttcatattttgtattcttggtcaacctatgtgtgtactactatactatcacgacttgatgaataggaaaggtgaaattgactgaggtagcattacatcattacagttatgtggatgagcttttacttttgcagagctaaatcgatgtacatatgttgctcaatgttatctctggtgactatcatctgctatgacggtggttcatatgggttaagcat

SEQ ID NO: 360 - DNA, 1553 bp, Medicago truncatula
tcatcatggggtttcttgtgcttctttctctcttgccaatcttaattctattcattatacacatctacaaaataaggagtactagtagagcatcatcaactccaccaggtccaaaaccacttcctctaattggaaatctacaccagcttgacccttcatccccacatcactccttatggaaactttccaaacactatggacctatcatgtctttgcaacttggttacataccaaccttaattgtttcctcagcaaaaatggcagaacaagtgttgaaaacccatgaccttaaatttgcaagtagaccatctttcctaggactaagaaaattgtcttacaatggtttagatcttgcttttgcaccttatagtccttattggagagagatgagaaaactttgtgttcaacatctctttagctctcaacgtgtccattcttttaggcccgttagagaaaatgaagtggcccaattgattcaaaagttgtcgcaatatggtggtgatgaaaaaggtgcgaacttgagtgaaatattgatgtctctcacaaatacaattatatgtaagatagcttttggaaaaacatatgtttgtgattatgaagaagaagttgaattgggaagtggacaaaagagaagtagattgcaagttttgcttaatgaagctcaagctttgttggctgaattttacttttcagataattttccattgttgggttggattgatagagtcaaaggaactcttgggaggcttgataaaacattcaaggagttggatttgatataccaaagagttattgatgaccacatggataattcagcaaggcctaaaactaaggaacaagaagtagatgatattattgatatcttattgcagatgatgaatgatcactcactctcttttgatctcactcttgaccacatcaaagctgtgcttatgaacatttttatagcaggaacagacacaagttcagcaatagtggtttgggctatgacaacattgatgaacaatcctagagtgatgaacaaggttcaaatggaaatcagaaacttatatgaagacaaatattttataaatgaagatgatattgaaaagctaccttatcttaaagcagtggtgaaagagacaatgagattatttccaccatcaccattactagtaccaagagaaacaatagaaaattgtaacatagatggttatgagattaaaccaaaaactttagtgtatgttaatgcatgggccataggaagggatcctgagaattggaaagaccctgaagagttttatcctgaaaggttcattatgagttcagtggactttaaagggaaaaattttgagctaattccatttggaagtggaagaagaatgtgtcctgcaatgaacatgggagtggtcactgttgagcttacacttgctaatcttcttcactcttttgattggaagttgcctcatggttttgacaaggaacaagtgttggatacaaaagtgaaaccaggaataactatgcataagaaaattgatctttgcctttttcctaggaaaagaaaaccatagtag

SEQ ID NO: 361 - DNA, 723 bp, Medicago truncatula
gttcacacatctctcaaacctcaccaaacacaaaagagatccacaaactctaaaatcaaattttagagtttattcaacaacaaagaaaatggctagtatcagaatcatcacttttgtgtcattgatggtgttgttgatgatcaacacaacagaggcacaatcaacagacatcccttcatgtgctacaaacctaatcccatgtgctgattaccttaattcaaccaaaccacctagttcttgctgtgatccaatcaaaaaaacagttgaaactgaactcacatgtctttgtaacctcttctatgctcctggtttgcttgcaacctttaacatcaatactactcaggctcttgccttgagtcgtaactgtggtgttaccactgatcttaccacttgcaaacacaatgggtcagctccagctcctacttctggcgggtccccaccggctacaacaggtggtgataaagcagctgcaagcagagtctcattcactggattctcttttatactcttattggcatccatgatattcaattagaaaagtggctctttacccttcttaaacctctactttattttttaaatttatctatgtaatttcatacattgattggctactgagctatttcagagtgcgtttacttttcctccttcgattttttttagtgaactctgattcaatttgggttaaaaactcttagttagtgaaagtgcgttattcttgtg

SEQ ID NO: 362 - DNA, 1261 bp, Medicago truncatula
ggccttacctcatctcttctctattcttctcaaaccagcttattttattgcaactattaccatcacttacaatatattatccttttaaaatccaaacaaaccattgggatcaataaacaaaagaaaattgatttgtaatgaaaggagaatacgtagagcaacattcttcaaatcccaacaaaggaaatgaaacaccaccaccttctttactattctcaaagccatttcacccttttcaactttctcatcatgaatgtcaaccaatcggtgaagatgataacaacaacaccagcggcggcggtgctaccactcagaaacctaacacctccggcgacggtgcaactatcgaggtttctagacggccgagaggacgtccacctggctcaaaaaacaaaccaaaaccacctattatcatcaccagggatccagaaactgtgatgagtccttttattttagatatttctggtggaaatgatgttgttgaagctatttcagagtttactcgtcgtaagaatattggtttatgtgttttaactggttcaggaactgttgctaatgttactcttcgtcaaccttcaactacaccaggaaccaccgttacttttcacggccgttttgatattctttctataactgccacttttgttcctcaacaacacggtgtttctccggcgattccgagtaacttctcgatctctcttgctggacctcaaggacagattgttggaggaattgttgctggaaatttgatagctgcagggacggtgtttgtgatagcttcttcgtttaataatccgtcgtatcataggttgccgttggaagaagatgaaggtggaaactcggtgtctggtggtggtggtgaaggaaactcgcagaatgtttccggtgcggtggacagtggacaagttcagggtggtggtggtgagtcgtgtgggatgtcgatgtacaactgtcatttgccgtcgtcggatgtgatttgggctccgtctgctagaccaccaccaccttactgatatcatcatcattcacattttcataaactttgttgcaaaatcttttctgttatgctggtttttttgtctctatttttatttttattatggttatctctgtttaattattattatatttataattagtagctttgtttagtttgtgaacagaaattaacaagactagcttagtatgttagttatatgtagctagctaggttggtttattttcattgacatatcatttgttgcgttgttcatcatgtatt

SEQ ID NO: 363 - DNA, 853 bp, Medicago truncatula
agtctgaacaaactcaactcacacaccgatcaccgataagatgcaggtaatagcaaaagcaaaagctgaggagaagaaaatcggcttgacagaaacatggttgaggaaacaccgtcctatctacgacgcagcaaccagacacccttttattcttagcatccgtgatggcaccgttcaatctcattccttcaaaacatggctcgctcaggattacttgtttgttagagagtttgttccatttgttgcgagtgtgctgattaaggcttgtaaagaatcagatgacagtgatgatgttgaagttatattgggaggtatggcttctctcaaggatgaaatattatggtttaagagagaggccaacaaatggggtatttcactctcagatgttgttcctcaaaaagctaacataagctattgcaggttgctggaaagtttgatgagtccagacgttgattataccgtgactcttactgcattttgggcaattgaagtggtgtatcaagagagttttgcacattgcattgaagaaggctcaaaaaccccaccagaattgaaggagacttgtgaaagatggggaaatgagggatttggtcagtactgccaatctctgcaaaagatactcaatcaccgcttgcagaaggcttctgatgatcaactcaaaaaggctgaagttatgttactcactattattgaacatgaagttcatttctggaatatgagccgtggaaatgtctgattttgtttaaaagaaatctttgatgtttgtgtactgtgtaaaataatgaaaccttgtttatcttgttaagtgtatggaatgtctagattaattgagtgggaagtaattaagcagcag

SEQ ID NO: 364 - DNA, 2477 bp, Medicago truncatula
aaacaaagaagcacaaaatgaaggttgaatcgaggtcacataatgttcatcatgcacatggggaagaagagaaggtgatgacaagaaagcagaaggcagaatctaaggcacatgaagtagagcattctcctaaaaaggctaaggtggaagatgaaaaaaatggtcacactaatggaaaatctgcttctgatgttgtacaagaatatgatgagttttgtaaggccactaatgagcaactatctttggatcaaatgaaagagattcttgaagctaatggtcttgattcctctggctctgatcttgaaattacacgaagttgccaagacttgctgttttttggtgcattagagaaatgcatggtttgcaatggcaacatggagtttgatggaagacgttatggatgcagaggtttctacagtgaatggtctagttgcactttcagcaccagagaacctccaaggaaagatgaacctattaagctaccagattctgttcagaactctccagtttcagatttgctgaaaaaataccaggatccaagtaaaaggcctcaaagggatttaggcttagctataaagccttttactggaatgatgatttctttgatgggtcgtcttaatcgaacacatcaatattggaaaaaaacaattgaaaagcatggagggaaggtggcaaactctatcattggagcaagttgtttggtggcttcacctgccgagcgagatcgaggtggaacatccaaacttgcagatgccatggagaggggcatacctgtggttagggaggcatggttaaccgatagcatcgaaaagcaagaaccacaacctttagaatcttatgatcttgtttctgatctttctgtggatggaaagggaatcccttgggacaaacaagatcctggggaggaggctattgaatcactctcagcagaactcaagctttatgggaagagaggggtctacaaagataccaaattgcatgagcaagatggaaagatatttgaaaaagatgggatattatacaactgtgccttctctgtttgtgaccaagggagaaaacttaatgactactgtgtcatgcaactgattgtcgtcccagagaattctttgcatttgtatttcaagaaaggaagagtgggggacgatccaaacgcggaggagcgactagaagagtgcgagaatgtggacaatgctatcaaagagtttgtgaggctctttgaggaaataacaggaaatgagtttgaatcatgggaaagagataagaaatttcaaaagaaaccactgaagttttaccccattgacatggatgatggagttgaagttagacacggggcattaggtcttcgacagctggggatagcagcgacacactgtaaacttgagcctatggttgcaaattttatgaaggttttgtgcagccaggagatctataagtatgcattgatggagatgggttatgactctccagaccttccaataggaatggttacaaatcttcacttgaaaagatgtgaggaaattctgttggaattcatagagaaagtgaaaacattgaaggagacagggcccaaggctgatgctatttggtctgattttagccagaaatggttcactctgatgcactccacaaggcctttcatttttagagattatcaagagattgcagatcatgctgctgcagctttggagggtgttagagatataacccttgcttctcacctcataggagatatgagtggctctaccattgatgatccattatcagacacatacaagaaattgggttgctcaattactcccctggagaaaaattcaaatgattacgagatgattgtgaaataccttgaaaaaacttatgaacctgtcaaagttggtgacattgaatatggggtgtcagttgaaaacatcttctctgtggaatcaagtgcttgcccttcttatgaagacattgtaaagatgccaaataaggttcttctatggtgtggatcacggagctcaaatcttttgaggcacttgcacaaggggttcttgccagctatttgttcactacctgttccaggctacatgtttggcaaagccattgtttgctctgatgctgcagcagaggcagcaagatatggttttactgctgttgacaggccagaagggttcttggttttggccattgcttcactaggaaatgagattaccgagttgaaaagtccacctgaggacacaacatctttggaggaaaagaaagttggagtgaagggacttggaaagaagaaaactgatgaatcagagcattttgtttggaaagatgacataaaagttccttgtggtagcataattgcctcagagcatgaagatagccccttggaatacaatgagtatgctgtctatgatcccaaacaggtacgtataagctacttggtgggggtgaagtatgaagagaaagatgccgtgatagacacggcagagtgaaaggcacaacagtaa

SEQ ID NO: 365 - DNA, 525 bp, Medicago truncatula
cattcctcacatatcaaccaacattttccacatttgacattatatatatataatggagagagtaacaaagatggtttcagaaaggccagtggtgatattcagcaagagttcatgttgcatgagtcatacaataaagacactattttgtgactttggtgtgaatccagcagtatatgaacttgatgagataccaagagggagagagattgaacaagcacttatttcaagacttggttcttctccatctgttccaactgttttcattggtggtgagcttgttggtggagccaatcaagttatgagtcttcatcttaaccgttccttaattccaatgcttaaaaaagctggtgctctttggctttaatctcatcactcatcatcatccactcaataaactaacccgttttggttatatatatatatctaatgagatcatatgtagagaggaaaaatatatatatgatgagctaatagagtttatggcataaggtaataagtctaacttaattgatagatttgggtacc

SEQ ID NO: 366 - DNA, 904 bp, Medicago truncatula
ccaaacatcatcaatcttcgtggacatggcaacatccttgtccacaaccactctactttcctatagaagaaacccacaacacatgtatatccaaccctgttcagttaaaaatgaagtttcaagaactatgcatgcttcagtctcaatagacagtttatcaatcaatgaagagagtgataaatgttcatctttgttggtaaacagaagagcaattttggcttctggagtttccttgttgggttttccaggagtgagtttggctgtggtgaaacaaggtcttttagcagggagaattcctggtctgtctgagccagatgaacaaggttggaggacatatcgcaggccagatgagaaatcaggaggacatggtgttggatggagtcctattattccatacacctttaaagtgcctcaagaatgggaagaggtacctgtatcaatagcagatcttggtggaacagagttagatttgagattttccagctctaaggaaggacgtctgtttgtcattgttgctcctgttcttagattctccgacattattggtgatgatgctacaatagaaaaaattggacctccagacaaagtgatcagtgcatttggtcctgaaatgattggagaaaatgtggaagggaaagttcttagttcaaatgttgcagaacatgaagggagaacttactatcagtttgagctagagcctcctcatattttcattactgccaccgctgctggcaaccgcctatacttgtttggtgtaactggtaatggccttcagtggaagagacactacaatgatttgaagaagatatctgactcttttcgagttgtataattggaatttccaataaattgaaaattttaaattttcttatgtgtagaatagtgctgtaatgcagaaatttcc

SEQ ID NO: 367 - DNA, 839 bp, Medicago truncatula
aaggaatgctgagatttataacatcatcatctgtgcccaaattcttccccacaaaaccttttcacatcatttcacccttttcatctcgcttatcagttcgttccatggctgactctgctgctcctttcagcaaaatccagattcaaagggatgacaacacaacatttgatgcgtacgtcattggcaaacacgatgctcctggaattgttgttctccaggagtggtggggtgtggattttgaaattaaaaatcacgctgccatgatatctcaacttggccgtggatttaaagctcttatcccagacctgtatagaggaaaggttggtctggatgttgcagaagcacagcatttgtttgatggtcttgattggccaggtgctgtgaaggacattcatgcttcagttgactggcttaaagcaaatggttcaaagaaggctggtgtaactggattctgtatggggggtgctcttgcaattgcaagctctgtcttggttccgcatgttgatgctgttgtagctttctatggagttccttcttcagaacttgcagaccctgctcaagccaaggctcctgttcaggctcactttggagagctggacaattttgttggcttttcagatgttacggctgccaaggctttggaggagaagttgaaggcatctggaattccacatgaggtacacatataccctggcaacagtcatgcattcatgaacaggtcaactgaaggaatcaataggaggaagaacatgggattgcctgatgaagatgaagcttcagttcagctcgcgtggtctcgcttccaatcgtggatgacacagtacttgtccagctagtag

SEQ ID NO: 368 - DNA, 1490 bp, Medicago truncatula
gagagagggaaagcgttgaagcttttcttcttcattctcttctttcattcctttcacatacgtattccttttttcttcctttcaatcttccattaccgatcaatttctcctacgaattcacactcttcctccttattgatcctctctttttcctcaacttttttccaataccattttttctgggtttcgttcaaaaatcaaaaacaatttttttagaaaaaaaatcgtattttgaaatttgggtcttgtttataacaacccaattaagtttgggggagaaaaatttgcgaaaaaaaggattggaaaatgctgggtactacactgcaatttggtggtgttggtggtgatgatcggttttacattccggtgaagacaaggaagaatcagaatcagcgtaagcaagctcagagagacaagaatgttgaagaggaatcaataacagttgcgtctgtagaagagtctgttagtaacattgataggttcttggattccacaaagttattggttccagctcagtatttctccaagacgacaatgagaggttggaagacttgtgatgtcgagtatcagtcttactttgctctgaatgatctatgggaatcgtttaaggagtggagtgcttatggtgctggagtccctttactacttgatcaaagggaatctgtagtccagtactatgttccgtatttgtcagctattcagctatatggtcaacctacagaaaagtcgagtgccaagccaaggtacataagtgaagatagtgatggggattactacagagattcatgtagtgaaggaagcagtgattgcgaatctggaaaaaggacagaatgttttacagcacagagaagcagtaaacacctgacaagtggtgtctcttctcaaatgagcacactctctatacatgacaaacacaatacagtacaagaaggattttctagtagtgatgacagcgaaactgggaatcctcaagaactgctttttcagtatttggaacaaggtcatccttatggccgtgaaccgctggctgacaagatactagatcttgcacgcgactatcctgccctcatgtcgttgagaagttgtgatttattgccaaacagttggatgtctgttgcatggtatcctatatatcgaatacccacaggccctactttaaaagatttagatgcctgctttctaacctaccatacactccatacacccttgacaggaagtggtcctactcctggtcctgtactagtttatcccagtgagatggatggtgtaccaaatatttccatacctacttttgcaatggctgcctataaattaaagggatctatttggatgaaaaaagaagttagtgagaatcaagtaatgaattccctcgtgcaggctgcagataaatggttaaggctagttcaggtgaatcacccggatcatcagttctttaaatcgcatggcacatactacaaatgaattgaatgatatggcgtgccagttatatt

SEQ ID NO: 369 - DNA, 1655 bp, Medicago truncatula
catagcacacctggtgacaactattgctcaagtgaagctcactaaattcctatctaccaaccaacagggaaaaataatatcatggcacctgctaatacttctgctgctgctttatctgaaactgaatatgaaatggtgaaaaacatcattgacattgaagttctagaagagttaagtttagcagattgtagcatctacaaggttcctcacaatctccgaaaagtgaaacaagaagcttacactcctcaactaatctcaattggtccaattcaccttggaaatgaagaacttcaaccaatgcaacaacacaaaaaaaggtatttccatttcttctatgagcgtctatctcaattcaatcaacaatccatgatcaagaactacaaactctatctcgaaaacaaagaacaagaaataagaaaatgttatgcagagaaatttcccgacataagcaaagagaaatttgtggaaacaattttgttggatgctgttttcatcatggaacttttgttgagaaacagttcatggaagtcggatacatcaaaacatgaacatgaatacaagcaatccaagtcatttagatggaaacatagtgatgattacattctaacacaagcttggctcagcaaaagcatcacaagggacttgattttgttggaaaatcagatacctttttttgtattgaagcatctttatgacactgtcgtcccgaacgacgacaaaaaaccaaatcatgaagattttcttgatcttgcactcgagtattttgcattctacgacactcagaaatcgtcatcacttgaaacgaagtttgttttggataagaatcagacaaaaaaatattattatgtgagtggcgtaattggtgatgttggtagtggtaattcagtttccaagaaaaaacattctgataaatctatgagcagtaaccatgggtttcaaggtcccaaacatttcactgatctgataaggtttttttaccttccagctgatttaggaaagagtggttgttctcatattttcccaagaacagtaacaaagttaatggattctggtgtgagttttgagaaagttgtggggagaagattactagacataacatttgagaagaaaccatttctaagtaattttctctgcttaggttgtttaccttcattttcatgtttgaatcatttcaaagcgcgtcttaggattccgcaattgaaggttgatcacacaacagaatgtgttttaaggaacctcattgccctagaacaatgtcaatatcaagaacaaccttatatatgcaattatgtttcacttgttgattctcttatacatacacaggttgatgttgatttgttggtcgagaaggaagtgattgtgcatgaaatgggaagtgataaagaagttgcaatgcttgttaatggtctttgtaaacatgttgtggtgaattcaacttgttactatgagattattaatgagcttaataagcattaccagaatatttggaaccgtaccatggctgcattatggttggtgtattttagagatgcttggagagctagttctactttggttgggattgcttttcttgtttacactgcattcaactttgtacgtcttgccaagattctcttctagtagagaaacttgaaaatgtataattcgtggtttgg

SEQ ID NO: 370 - DNA, 1303 bp, Medicago truncatula
cacctttcaacgccattcccttcccttcttaaataaataaataatcacttattcctttttcagttttctttcatctcttcactaacaagtaaaaacgcgcgcgcgtttcattaatcacttttcttttcaatttcaattatgcaaacgcgcgttttctctctttagctcaaccatgtcagcacgacaaatcatcgaagtaccacaaacaccgcttctccgctcacaccatgaaggcaacggcggcggtcgccgtacttccctcgctcagctactcggacgcgccaccggacggagaggaccatccgtcctggtacgcgaaacggcggcgcgtgaactcgaagagcgtcgtgccgattggggatactcgaagccagtggtagcgcttgacatgtcgtggaacatggcgttcgttgttgtatcggcggtgatgcttgcgttcaccgttgacgagcgtccgaacatgccgatccgcgtttggatcgtaggttacgcgttgcagtgttttgttcatgttgtattggtgtggattgagtatcaccgccgtaataggagggattcgcggcggaggcagagggatagtgatgctgaattcagttccgacggtaacgatagtgatgacagcgatggcgacgtgaactcgactcagtccagattcaccaagcgatgtgaatcaataaatactggggtttcgttcctttggtggatggtgggcttttactgggttgtctctggtgatgatatccttctgcaagatgctccacgcttgtactggttggctgttgtctttttggcattcgatgtcttctttgccatcttctgtgttgttttggcatgcttgattggcattgctctctgttgttgtttgccctgcatcattgctattctctatgctgttgcgggacaggaaggtgcgtcagaagcagatcttagtatacttccaaaatacagatttcgattatcaaacaatgaggagaaggatagtggtggagctggatcaatggttcccatagaaaccaccagtgcatacttggcaactgaacgaatacttttacctgaggatgcggaatgctgtatatgcctttgcccatatgaggatggagtagagctccacactcttccctgcaaccatcatttccattcttcatgcatagtaaaatggctgaagatgaatgcaacttgtcctctttgtaagtacaatattctcaagggaaacgaacaggtataacacgttatgggagttttcaacgctgctgtgtacttgtgtatatgtagaaattcaagacaagaaacaccgatttgctag

SEQ ID NO: 371 - DNA, 1029 bp, Medicago truncatula
ggatccgaagtgggaacagttggtggtttgttatttcaatggagaaagcagcaagcagtgtgttgaagcagatgaacatcagcagtcgtcttgttcttcccggcagttgctgctgttcttcctttcaatcttcatcttcttcatctctccactttccattctcaatctctgttccattcaaattccgcagcagaagatcaactaactctgtttttgacgctgcttttcctgttccattgattaaggttgttgcgacggatttatctcttgcggtgaagaagaaagcagcagatgtatcccctgagctgaaagggtcatccatatttttgattggtatgaaaagctcactcaaaaccaatctgggaaaacagctggccgatgtattgcgatattattattttgacagcgataatttggtagaagaagcaataggtggtgcatcagctgcaaaatccttcaaagagagtgatgagacgggcttctatgaatctgagactgaagtacttaagcaattgtcgtccatgggtcgactagtagtttgtgctggaaatggcgctgtacaaaattcaactaatctggcgctcctgagacatgggattacattctggatagatttgcctttagaaattgtggctatggatgtaaccgaaaaccagactcaatttccttcgtttgagatatcaacgtcaggatcttacccaaaggtaatggatgaactgggtgctctatacaataagtacaaagatggatatgctacagctgatgcaattatttcacttcaaaaagtagcttctcggttgggttatgaaagcttagatgacattacaacagaagacatggctttggaggttctcggggagattgagaagttgactagagtaaagaagatgatggcagaagctgcaagaccattttaatcaacccgacaaatacttcagttacgaatttcggaattctaaaagctcttagggagattgagaagttgacaagagtaaagaagatgatggaagaagctgcaaagaccatttg

SEQ ID NO: 372 - DNA, 2083 bp, Medicago truncatula
acgcacacagaaacactctccgagaatgttcggtctcgccgccgcctcctccaccacccgtgttctctgtgcaaccctttactctccttcttcttcgtcttcttctttcactactacacatcacttttcttctcatcatcttccatcaactttggtttctttatcttcactgcgattcaggtgtattcctatcaaagctatgtcagagactgatgccccaaaatctgcttcatcttctcatggcaacaagcaagctttgatatcgttgtcagacaagaaggatctcgcatttgttggaaacggactccaggaattaggattcactattgtttcaactggaggaacagcttctgcattggagagtgctggagtggctgttactaaagttgaacagcttacgcatttccctgaaatgcttgacggtcgtgtcaaaactcttcaccctaacatacatggaggtatccttgctcgaagagaccaaaagcatcatatggaagctctcaatacacatggaattggtacttttgatgttgtgatagtgaacttgtatccattttatgataaagttacttcagccggtggcattgaatttaaggatggaatcgaaaacattgacattggtggtccagccatgattcgagctgctgcgaagaatcacaaggatgttttggtagtggttgattcagaagattaccctgcccttctagaatttcttaaaggaaaccaagacgaaaagttcaggctaaagcttgcatggaaagcttttcagcatgttgcttcatatgattctgcagtagctgagtggttttggaagcaaactgggggagataaatttcctcctagtttgacagtgcctctttcactcaaaagttctctccgttatggtgaaaatcttcatcaaaatgctgcaatctattttgatagaagacttgcagaggtcaacgctggtggaattgctacagccatccaacaccatgggaaggagatgtcatataataacaacttggatgctgatgctgcttggaactgtgtgtgcgagtttagaaaccccacatgtgtagttgtgaagcatactaatccttgcggcgtagcttcacgtgatgatattctggaagcctacagacgagctgttaaagctgatcctgtcagtgcatttggcggaattgtagctttcaatgtggaagttgatgaggttcttgctaaggaaataagagaatttagaacccctaccgatggggagacaaggatgttctatgaaatagttgttgcacccagctatacagagaagggacttgagattcttcgtggaaagtcaaagactctaaggattctcgaagcaaaaaagaatgaaccaggaaagctttcactcagacaagttggtggagggtggttagctcaggattcagatgacttgactccatccgacatcaagttcaatgtagtctcagagaagactcctcaggatggtgagcttcgcaatgcagagtttgcatggttgtgtgtgaaacatgtcaaaagtaatgctattgtgatagctaaggacaattgtatgttaggtatgggaagcggacaacctaaccgtgtcgagagtttaagaatagcaatgaggaaagctggagctgctattaaaggagcagccttggctagtgatgctttcttcccctttgcttggaaagatgctgtggaagaagcatgtgaaagtgggattggtgttattgcagaaccaggtggtagtataagagatcaggatgctgtagactgctgtaataagtatggtgtttcactactctttaccgatgtgaggcacttcaggcactgatcatttttgttttgggagaactttctgtttcaaacgtctataagaaatgctactgaatcctgtttttgacatcaagtaggtctataaggaagttgtaccatatattttatcggcgttgttaaatagtggctattgtggtgctatagtgctacaacgcagaggaatttgaacaaatcgttgttgtttcatatgctatttagtttaaaatagtcaaatggcggctaaagcgacgctatatcattgatgtgtagccgaatttgaaca

SEQ ID NO: 373 - DNA, 1672 bp, Sorghum bicolor
gaggcttcatctcgtgtcgacgccttcctcgccctctccgtccgtctcgtcttccgctcctccgcagctggactcgtgcgctattccccaggccgccactcccactagggttttccggattaggtttctagaaccttccgtcgccgcctccccatgcacgcgccgccgctggtcgcgttcgcagggggcgcctgccccgccaccgccgcctcgtcctcgccgtcgccctggctggcctcgccgcgggccgccatcctcgccgcgccggcgaggctcctacggtcccgccgcggggcacttcggctggaagccaaggccgcgtggagggctgccggagggggacggggcccgagggtcccggccaagggcgctgtgctcgcctcctatatgggcgccgaggaggtggtgggaccttcgtcgctgctcgacgaggaagagctcatttcacatatcagaaaggaactggataatggaaaactccctgcagatgttgccagtaatctggaggagttgtattataattacaggaatgctgttctgcaaaatggagatcctaatgcatatgagatcatgctttcaaatatgacggctttgtttgatcgtgttctactggatgtacagaatccatttacctttccaccttatcacaaagctgtgcgagaaccgttcgactattacatgtttggtcagaactacattaggcctctggtagatttcaggaactcctatgttggcaacatttcactttttcatgacatggaagagaagctgcaccagggccacaatgttgttttgatgtctaaccatcagacagaagcagatccagcaattatctccttgcttcttgaaaaaaccaatccatggattagtgaaaacatagtttatgttgctggagatagggttgttatggatccactttgcaagccatttagcatgggaagaaatctcatttgcgtgtactcgaaaaagcatatgaatgattttcctgagctagttgagatgaagaggagatcaaatacccgaagtctcaaggaaatggccttgcttttacgtggtggctcacagttaatttggattgcaccaagtggtggtagagaccgcccaaatccttcaacaggagaatggtacccggcgccattcgattcatctgcagtggacaatatgaggaggcttctggagcatgctggcgttcctgggcacatatatccactatcattgctgtgctatgaggttatgcctccaccacaacaggttgagaaagagattggtgagcagagggtgatatccttccatggagtaggcttgtcagtaactgaagaaataaaatatggggatattactgctcataccaagaatgctgatgagggaagggagctattcacaaatactttgtacaactcagttgttaatcagtacgatgtgctcaaatctgctatctttagagatcgtggagcagctgtatcaaacaatgtcatctcattgtcacaaccatggagatgaatgttagctttctcagtttgggtccagatttattactgaagttaccttttcagaagagcaggtgaactgccattgtgcaatttcactggagaaactcttgaactttaatctttttgataccactcgactttatcagtcatggtggagcctgtcattgtcatgcagatccttg

SEQ ID NO: 374 - DNA, 1443 bp, Sorghum bicolor
gatcgaagaggagtgcatcgccggcgacgggtacgtgtatgcctgcggcgatccccagagaaggccaagaccgacgcctcctcgagtgacgctgccgctgccactcctactgccgccgagcccgatccgcttctgtactgtgctgactgctgatatgagggccgcgcagatcgatccgtccctcgccgcgccgcccaagtcgcggctcaagcgcctcttcgagcgccaggtgctgcgggtctcgccggccgagcgcctcccgtcggcgcctcccggtggcggggagaagcaggatgaggtgtcggagcccagctcgctgtgcctggacggcatggtgcggagcttcctggaggacggaggcggcgccgccgagcggggagctgctgcgcggtgctgcaactgcttccacgccggcgacacgtccgacgacgaggacggccccgctgcagccgacgccgcagccgctgacatcgcggagaccatcaaggggctcgtccactgcgccagcctccgggagcggaacctcctagccgacgtctccaccctggtggagcgccaccgcgcgtcaggagcccgcaagcgcgacctcctccgcctgcttgccgagtccctccgcgcagccggccacgacgccgcggtgtgcctctcccgctgggacaagtcggcgtcccaccccgccggggagcacgcgtacctggacgtgctcctcccggccgcgtcggagcgcggcgagcgcgagcgcgtgctggtggacgtcgacttccggtccgcgttcgaggtggcgcggcccaccaaggcgtaccgcgccgtgctgcagcgtctgccgtcggtgttcgtcgggcgggacgatcgcctgcgcctcctggtggcggccgccgccgacgcggcgcgcgccagcctgaagaagcgcggcctccacctgccgccgtggcgcaagctcgagtacatgcgcgccaagtggctgtccccgtacgatcgcgaggctccacctccgcctgaggccaccaccggtgaactcgccggcaacggcgagggaggtgggcccagtgcttaatcatcaccgaggtcgtttttggaataattttctttcttttttgctctttgttcttcgggaatttgcagtgtggtccttgcgtgtacagggactggacgcaaatgtcctgctttgtttttttttccacgctttcttttattctttctttccttttcacccttttgatgggtgtctattccccgcggcgtagtagttgtagtaagtagtgccggtaattatggaggagagaaaaggcacaaaaaaattgtagctttagtttgatgatgaagagataaaagaaaaaggagattccggacagagacctgtctgattcttttggtctcaatcgttgttccaggcagcggaacctgacaacgaacaaaggaaaccatgatttgttgctgtgaatc

SEQ ID NO: 375 - DNA, 522 bp, Sorghum bicolor
cgccgattaacatccgacagccatggcgaagcaccacccagacctgatcatgtgccggaagcagcctggcatcgccatcgggcgtctgtgcgagaagtgcgacggcaagtgcgtcatctgtgactcatatgtgcgaccgtgtacactggtccgtgtctgcgacgagtgcaactacgggtccttccaggggaggtgcgtcatctgcggtggcgtgggcatctcggatgcctactactgcaaggagtgcacgcagcaggagaaggaccgggacgggtgccccaagatcgtcaacctcggtagcgccaagaccgacctcttctatgagcgcaagaagtatgggttcaagaagaggtgatgatgtatcacaggatcagtcaggttcgcttggcctcttgttgagtaatgctcatggatactgggagtaggatgttgcggcaacgtttgcgttatgtttattgatggtgatggataccggcttaaaacatgaactgggatggcctctttcgttctcagacgtgaaca

SEQ ID NO: 376 - DNA, 2384 bp, Sorghum bicolor
atctgatgtcaggagggggtggctcatccgggcgcgcggccccgcggtacgccccggatgacccgacgctgcccaagccgtggcgcggcctcgtcgacggcaccaccggctacctctactactggaacccggagaccaacgtgacgcagtacgagcggcctacgccccccgataaccagctactaccgcccccgcccccgttgcctcccccgcctccccggagtcgcgaccgccgcgacaggtccaggtctcgatcccgatcccgcaccccgccccggcgcgaccacagggaccgcgaccgcgaccgtgacaggcgccacgatgagcacgcgtcctccaagtcggcgtctgcccaccaccatccggctccggtagccgccgccgccgccgatccgtcgaccgaggcatatcgccgacgccatgagatcaccgtcacgggggataacgtgccggctccaataacttcatttgaggctggtggcttcccgtcagaaattctgaaggagttacaacgtgctggatttgcaagcccaacacctatccaagcccagtcatggccaattgctatgcaaagtcaagatgtagtagctattgcgaagactggatcaggcaaaactcttgggtatctacttcctggatttatgcatatcaagcgcctgcagaacagcactaggaatggtccaacagtcctagttttggccccaacaagggaacttgcaacacagattctggatgaagctgtgaaatttggaagatcttctagaatttcttgcacgtgcctatatggtggtgctcctaaaggtcctcagttgagagatttagatagaggggttgatgttgttgttgcaacacctggaaggttaaatgacattttggagatgcgaagggtaagtcttaagcaagtgtcatatcttgttctggatgaggctgatcgcatgctggacatgggctttgagccacaaatacggaagatagtgaaagagatgcctcaccgtcggcaaacccttatgtacactgctacttggccgaaggaagtccgaaggattgcagatgatcttcttgttcatcctgtacaggtgacaattggaagtgttgatgagcttgttgctaatagtgctattactcagcatgtagaggtcataacaccctcagaaaaacaacggcgcctggagcagatattacgatcccaggattcgggttcaaagatattaatattttgtaccaccaagaggatgtgtgaccaacttgcaaggacactcaccaggcagtttggagcttcggccattcatggtgacaagtcccagagtgaaagggagaaggttctgaatcattttcgatctgggcggtcacctattttagtggcgactgatgttgctgcacgaggtttggacatcaaagatatcagggtagtgatcaactatgacttccccactggtgttgaagactatgttcacaggattggcaggacaggaagggctggtgccactggtgttgcatatacatttttctgtgatcaggattcaaaatatgctgcggacctaatcaaaattctggaaggggcaaaccaaaaggtgccccgtgatttagaggatatggcttctcgtggtggtgggcgaggtaggaagaggaaccgttgggcatcccactctgacaggggtggttcacgttctgaactggattcaaggagtggtcgtggcagtcatggaagggatgattatggtagccgtggcaggtatgactctggtgaaactgatgggcgatctcgtaggtctgctagaggtcgcagtagaagccgtagcagaagtcacagtagaagccgtagcccaagtcccaagaggtctcgccgacatgaagctagacgtagcaggactaagagccggagtaggagcaggagcaggagctatagaaaccatcgtgctagccgcagcaagagtcgcagccctgttgctagccgaaggtatgaaaagactgctgctatttcaggatctgctcggcctaactcggggcatgcagagcacaaaagccctccaagatctcactctgtggatgaccatgtgaaccactctgaccacaaggatgaccacatggaagatgggaagatggaaagggttgatcttgatcgctcgcccagcccacaagatgacaagtctgctccatatagtcctgtgtacaatggcaaagccagtggctcgatgagccccaacgttcagccagaggcagatgccaaatatgtcaaaccttctgggaaacctgagcctgcatctccagtgcgccacagcaaaggcagagatgatgatgaggaaggtatcatagacgaggatggagagattgctgaggatgatccacgtgcaaatgcagctgtgcagaatggtaataactgatga

SEQ ID NO: 377 - DNA, 1289 bp, Sorghum bicolor
agtctccgaagaggcgagagcgacggccaagaaacgtggccgcgaacagagacgaccgcggcgacagccacgagctcttcctcgtcccccctgctcccaccccacaacccctcgccgcggcctcttcctccctccgcccctgagaccgctccaggccgctgccccgcttgcatcgcgcattcgcgggaggtggtttcagtttccctttctcagggcattatggaatgcttaacaacaagttttgcaagaaatgtgggaaaagagcacagcttcgtatgttcaagtaagttggtgtctgaaaaccaatgggttcccagaaggatttgctgctatgtctctagttcaacaaactccagtcaatggtgcaagttcactaatatggcataccccatgagcccaattatccggaaaaggtcacactggagatcctttgctgcaagtttgaacttagaagatggccctgcaccctctgactcaacgtcatcttcatcagagcagactaccgccgatgctgatggaactaccaacggtgatgcatctgaagatctgctttctcgaaagctgagctctgatgagttaaaggctcttttggctgattcggaacgaagtaagcttttgagaagactcagcgaagcaaatcaatataaccgattcctcaagagacagttgcaaataaaggatgatgcagttgtaaagttcaaaggtgaacttgctgttttggaactagaactgcaggctctggttggcctagctgaagagattgctaattttgatgttccgttagggtctaggaggataaatggaaaatatattcaatctcatcttctctccagattagaagctgttcatgataagattgtggaacatataaaggatgttgactctttaaagaccaaagaaatttctgtctactgggttggcatggctgagaatgtgcaaattatgggttcattcgacggatggtcccagggtgaggcaatgtccatggagtattcaggtgattatggaagattctctgcgactctgaagctaagacctggaaggtatgagatcaaatttttggttgatggggaatggagattgtcacctgaatacccgactgctggagatggaatgacgcagaacaatattcttattgtggagtaacagaactttctcatgtagcattttagtcatccaaacaatgccaaagtgtaccttcacttcatgccttctaccatctgtaaaattatgctaccatgtggttgcctcacagaaaccagtgttcgttgaaatgcaaggtttccagt

SEQ ID NO: 378 - DNA, 3038 bp, Sorghum bicolor
ccgcgatggacgccgcggaggcgtcggagctgcaggcgcggctggccgcggccgtgcacgcgctcaaccacgacgcgagcccctccgcgcgcctcgccgcaaaccagtggctcctcgcgctgcagcggtccccgcaggcgtgggcagtcgctacctccctcctggccgccccggacccgcccccgcccgccgacctcctcttcttcgccgcgcagatgctccgccggaagatccagtcccccggctccgctttccccgcgctcggcctggcgccgcagctcctcgacgcgctgctcctggcagcgcggcggttctgcgccgccccggccccgcgccagctgctcacgcagatctgcctggcgctcgccgcgctcgcgctccgcgccgagggcggcgtcgacggcctcttcgcgcggatgccgcacctgccgcccccagccgtgctggagctgctcaccgtgctccccgaggaggctgcgcaggaccagggcggcgacacgggggtcgacgccgccgcgcggtgccggttcacgcgcgagctgctcgcgcacgcgcccgccgtgctcgagttcctccacgggcaatccgagaaggcacccaccgatgacgatggggttcccctccacgagcgcaaccgcagaatcctccggtgcctactgagctgggtccgcgtggggtgcttcttggagacgccggcagccgcgcttgccacgcacccacttctcacttttgcgttcaactcgctgcaggtgtccttctcgtttgaggtggccatagaggttatgattgagcttgtcagccagcaccaagaaatacctgaggcctttctgagtaagacaccttatataagggaagttcttcttctaccagctttagccaaccgaagtgagaagatcattgctggtcttgcctgtttgatgtgtgaagttggccaggcggcacctgctttggttgcagaagggggtggccaagcacttgctctcactgatggacttttgagatgtgtagcttttactagtgaagattgggaaattgcagagtcaaccttgcaattttggtgcagtttggcacattttattcttggtattgatgtgaagacagccaaaagaaatgtggtacgagagttgtttgtgcctgtgttttcttcactgctggatgctcttttatttcgtgctcagatggacactgattctgatggagcaccttgtatacctgagggactaacacagttcaggatgaatttggaggagctcctcatcgatatttgtttgcttctaggtgcccctgcatatataaacaagctcttttctggtggatgggacttctcaagccaaacaattccttggaaggaggtagaagttagaatgtatgcactcagcatggttgctgatacgattttacaagatgaaagctccttcgatttttcaatcataatgcattttgtaaacattttgtccagcagaacacctgttgaactgaatggaagtttgtttttggtatataaatcgtttggtgatgtcattggttcgtactcaaagtggctatcgtcttctcaaagtaacattaagcccttactcctgttttgtgcgtcaggaatttcaaaatctatatcatcaaatgcttgctcgttagccttgcgcaaactttgtgaggatgctccttcattcatccatgaacctcagaaccttgaaattcttttctggattagtgagggcatgaataaagggaacctgcagctagaggatgaagaagagataattagtgcaatcacacatgctttaagttctgttagtgaaaaagagttgaagaaaagttcactggccaggttactttgttccagttactcagcagtggaaaagattattgacatagacagagatcaatcgctaaggcaaaatccagctgcttatacacaatcgttggatcttgctgtccgtggtctttacaggatgagtgctttgtttcatcatttggctacatcagtcacatctggtctggttgatgatgatataattatagttcttcttggaatactttggccacttcttgaaaagcttttccgatcatctcatatggagaatgtgaacttatctgcagctgtatgtcgttctctttcttctgctatgcattcttgcggacaccactttcatattttattacctaaagttatggagtgcttatctgcaaatttcttgctgtttcaaaggcatgactgcttcttgaggacagctgccaatgttattgaagagtttggccacaaagaagaatatggggctttatgtgttaggacttttgaaacacttagctctgcatcttcaatatcagctctgaattcttcttatacctgtgatcaagaaccggacctagttgaagcatatacctactttacatctatgtttattcgctgctgtcaaaaggaagctattgtggcatctagctccctgcttgagttatcatttcaaaaggcagctatatgctctacagcaatgcaccgaggagctgcacttgcagcaatgtcatatatgtcgtgttttcttgagtctgtccttgctgctgtgctagaatctcctgagtgcatccctaatgggtcacctggtgtggccttaatccaaatattggcacgctgtggtgaaggtttattatctaatgtgctttatgctctacttggtgtatcagcattgtcaagggtgcataaatctgccacaatattgcaacaactggcggcattgtgcagtttctgtgaggcaacggcatggaaggctgttcttagttggaattctctttgtgggtggctacaatcgacggtgaaatctttgccttcggagtatctaaagcaaggggaagctgaaatgatagttccattgtggctcaaggtgcttcaggatgcaggctcagactatctttacagcaggactggtgataatataagaagccatcaaggttacatgcaagggaagggtggcagaactcttaaacgcataattagagattttgcagaaagccaccggaatgttccaattcccagtacttcatgataa

SEQ ID NO: 379 - DNA, 1875 bp, Sorghum bicolor
tgaggtcaggagtgattgattggtttaagttcagtgcacgctgcaagcggtggcatcatgggtagtgcctgttcgaggaagaggggccagttggtccaagaggatgatctctacagtgcgaggttctccaagagcggcagcttcaagtggctgctgcacacgctgccccgcagcaactctgccgatgtgcagcggagaacacagggcccagcgccaggccggtgcccgtctcttgtggagctatgtgtggccaaagtctgcgaggacataaataggtattctgatttctccctcctgcccagagatcttagtcagcagatattcaatgagctggtggaatgcggatgcctcacggaggcatcgcttggggctttccgtgattgtgctttgcaggatgtttgtctaggagactaccctggagttactgatgcttggatggaagtagtggcttctcaagggcagtccttgctatctgttgacctctcttgctcagatgtgactgatagtggattcaatcttcttaaagattgctcaagcatgcaaagtttggcatgcgattattgtgataaaatctcagaacatggacttaagacattatcgggcttttcaaacttgacatcgctgagcattaagaaatgtgctgctgttactgctgaaggagcaaaagcctttgcaaacttagttaatttggtaaacttagacctcgagcgatgtccaaagattcatggcgggcttatacatttaaaaggcttgaaaaaactggaaaaactgaatatgagatactgtaattgcatcacagattcagacatgaaatatttatcagatctcacgaatttgagagagctacagctctcttcctgcaaaatctctgattttggtgtttcttatctgagaggtctgcacaagctaggtcatctaaacctggagggctgttcagttactgcagcttgtttggaggttatatctgaactggcttcgttggtcttgttgaatctaagtcggtgtggcatatgcgatgaaggctgtgagaacttggaaggtcttacaaaattgaaggctctaaatttagggttcaaccacatcacaggtgcatgtttaattcatttaaaagatttgatcagcttggagtgcttgaacttggactcatgtaagattggtgatgagggtctatttcacctgaaaggcctcatacagctaaaaagcctggagctttcagacactgaagttgggagcaatggacttcgtcatctgtctggtctacgtaatttgcagagcatcaatctctcttttacattggttactgacattggtttgaagaagatctctggcttgagctcactgaagtctcttaatcttgacaatcgccaaatcacagatactggtttagcatctcttacaaatctcactggattgacacaccttgacctatttggagctcgcataactgattctggcatgaactgcttcagatttttcaagaatcttcagtccctggaggtctgcggtgggttgattacggatgccggtgtgaagaacatcaaggacctgaaagctctgacgttactcaacctatctcaaaatggcaacctcacggacaaaaccctagagctgatctctggcctgaccgcgctggtgtcgttgaacgtgtccaactcccgggtgtccaactcaggcctccaccacctgaaaccgctgctgaacctgcgctccctatccctggagtcctgcagggtgacggcaagcgagatcgataagctccggctggtcgccctccccaacctgatcagtgtccggccggagtgataggaccagcacttccacagcgacctgtaactgtaaggtaccttacagttacaggtcgccttgtacatactt

SEQ ID NO: 380 - DNA, 910 bp, Sorghum bicolor
aaagtcgacattagaatctccgtccgacaccgcttggatccgatagagatggaatcaccacccctcacagctgaagcaattgcttttaccgagaaaaagatggacatgactttggaggatataatcaagatgtcaaagaaaaagaatcctggaggcaagaaacctcccaggcagccgatcaaaaagcgtccattccagaatggcaactctaataaagggaatggcaaggttcaacagtttatggaatctagatcaaccattagacaaggtgttcttgcacagagaaggtcaaatcttggtggaagtcagttccctgctacaaagcaggctgcaaagaaggctgctgctatgccaatgcgcaacggggctgtgcgttggaacaagccaagtggaagtaccttagtgcagaggaggcctgtaggtgatgcttttcagaattccaaggtcgagtcgtcgcagaaccaggcagcaccaaggacgatggatgcactctttgcacagatgaaggcgcaacgcatgaggaccgtaccacagcagcaggcaaaccctgcccctgggcgtcatttcaaccagcagcgacgtgttcagcagcagcagaggcgaggtagaggatatggtggccggaatgttggcaaccaatgaattcaactaagcatatctgctgcatcgaagcccattctcttcactggtcttacggaccttggaagaaaagacgcccctgggaaaatctaacttggctttgtttttttagaggaaaggttgtggacagaatatgaagcgaagtttgtgtggagttttctagttacctgcttccgtttcaacatgtataatgacctatggaaattatttggtgctacattatgatgtcgtgtttcttgagttgattaggttcatctcttctgatatcttt

SEQ ID NO: 381 - DNA, 2291 bp, Sorghum bicolor
ccaaatctcccatggcttcttcccctcccccaccgcccatccgcaccgtcctcgccgccaccctgctcctcctcctcgtgtacctcctcccgcacaatgccgccgccgccgccgccgtagccgacgcgtcgtctgcggtgaacccgttcacggcgaaggcggcattcatccggtactggaaccgcaaggtgcccaacaaccgcccgcacccggccttcttcgtcgccaagctctccccgctcccggccgccgactccgcctccttccccaccgcgctgcccgacatccgcgcccgcctccccgagctctgcaccaaggccgcgctcctctgccccggcccggctaccaccgacgcggcatcgctggcggcatcgggccccagaggcgggggcccgttcaagggctacagcaacgccaacttctccaactacggcaccggcggcgtagcgggggccgactcgttccggaactactccccggacctcaacatcgccgccgacagcttccgccgctacggccgggactcgtcgggacgcgccgacagcttcgcctcctacgagtccgacggcaacgtcgtgaccgccaacttcacctcgtacgccggcggcgccacgggcgggtcgggctccttcgccgcgtacgccgcggagaccaacgtcccggactccaccttcaccaactacgacgccggcgccaacggccgcggccggagcttcgcgtcctactcccaggaggccaaccacggggagaacggcttctccggctacggcaagagcggcaacggcgtgcgggagacgttctcgtcctacggcaacgagtccaacgtgctgggctccggcttcgccaactacgggcagtccgccaacggcgccacggacacgttcacggggtacggcgtggaggggaacgtccccgagaacacgttccggaactacggcgccggcgggaacgccggcgtggacaccttcaagaagtaccgcgacgacgccaatgtcggcgacgacaggttcacctcctacgccaagggcgccaacggcggcgcggcggagttccagagctacggcaactcggcgaacccgggcagcaccaccttcaagggctacggcgagggcagcaaccccaaccaccacattgggttcaaggagtacgccggcgagaacaacaccttcaaggggtacgccaagaccggcgtcagcttcaaggagtaccacaacacctccagctctactgcggcgctgacggtgtcggcggaggcggcggcatcgatgcagcaccacgaccacctgaagtggtcgccggagccagggaagttcttcagggagcaggagctggtgtccgggaaccgaatgccgatgccggacatcagggacaagatgccgcccagggcgttcctgccccgcgccatcgcggcgaggatccccttcgatccccaggccgtgtcggaggcgttcggtctccccctggacacggcgctggggaaagccgtgtcgtcgacggtggcggagtgcttgcgcgcgccgagcaagggcgagacgaagcggtgcgcgacgtcggccgaggacgtggtggactttgcggtggagacgctgggcgacgacatcgtggtgcgcagcacggcgtcgacggcgggcagcggcggcgacgtccggctcgggacggtgacgggcgtggacggcgggaaggtgacgcggtccgtgtcgtgccaccagagcctgttcccgtacctggtgtactactgccactcggtgcccaaggtgcgggtgtacgaggccgacatcatggccgccgccgccgccgccgatgatgatggtggctcggacgccggcgagaaggagatcatcaaccacggggtggccatctgccacctggacacgtcggactggagcccgacccacggcgcgttcgtggcgctgggcgggaagcccggcgaggtggaggtgtgccactggatcttcgagggcgacatgacgtggacagtcgcggattgagtgacgacgttcgttctcctgccctgctgctagcgggctttgcaagatcacaacaagactgaactactaagaagaattattttctctctcgcaattaatttttttttattttcactcctttcttgatctaccttatataacgaacgaaggtggtaagaattgtgcgattggtgcaggaggagaaaaaaaaggtttggtgatgatgaaaactgtaaaactgtaaaaatcttgggtgggggatggaatggaatagctggcgatgtgattgtcttgatcaaattgctgcttatggtcaatggtggt

SEQ ID NO: 382 - DNA, 1115 bp, Sorghum bicolor
actgcagaagcttcccaaatcctctcctctcctctgcccccctcccctctcgcgcctcccacctctctccagccggttccccgcgcctcgcctcgcctcgccgcgctttgcctttgcgcagggcgcactcccggcccggtatattatataacccgccggctccggtgagattcgacccaagtcgatggggctcgagatggaggtcatgtctgaggctgctgctcctacgacggctgttgtgcctgcggcggcggcgagggagccgggggtggatgtggatatttacccgctcacacgctactacttcggcgccagggacgccgccgccgccgtgccccgcggcctggagaccgccgctgaccgcgcgctacggctcaaggcaaacttcgcggcgcgcgggctccgcaccagcgtccatggcgtcctcctggtggagctgttcgatcacccgcacctgctgctgctgcaggtccggaactcctcctttctgctccccggaggccgcctcaggcctggcgaggaagaggtccaaggcctcaagcgcaaactctccagcaagctctcctttgtcgatgcagatgatgatcagaccattgaagaagaggatgactggcagattggagagtgcatcgggatgtggtggagatctgaatttgaggccatcccatttccatacatgcctccaagcttccgtgcaccgaaggaatgcatcaagctgttcctggtcaggctgccgatgtctcggcagttcatcgtgcccaggaacatgaagctcctggccgtgcctttgtcccaggttcatggcaatgctcaggtttacggtccaattatatctggcattccgaatctactgtccaagttctccttcaacgtcatcagtgactgaaatatgggaaccggaatctgagggtttagtagacagacgtgcatatttggctaatcgtagtcatagagcagtatgcgataccgatggaagcatgtatcgattgagaagtagcttatccgtactgtgtgtttgtatagcgtatccccccaccccctcgctgatacattgagatgtactgtgtgtatttcttgcgacatgtgttcgaccgtgagaggatgattcggttctg

SEQ ID NO: 383 - DNA, 1813 bp, Sorghum bicolor
ggtagagcccgatccgacggcccccgccgcgcccatgggccgcggcggcggctcgcgcgcggccccggccgccgcggcgccgccgtggcacgtgctcccggacgaggtctgggagcacgccttctccttcctccccgcggactcggaccggggcgccgccgccgccgcctgccgctcctggctccgcgccgagcgccgctcgcgccgccgcctcgccgtcgccaactgctacgccgcgtccccgcaggacgccgtcgaccgcttcccggccgtacgcgccgtcgaggtcaagggcaagccccacttcgccgactttgggctcgtcccgccagcctggggcgccgccgccgcgccatgggtcgccgcagccgccgacggctggccgctgctcgaggagattagcttcaagcgcatggtcgtcaccgacgactgcctcgagatgatcgccgcctccttcagaaacttccaggtgctgcgcctcgtctcctgcgagggcttcagtaccgccgggctcgctgccattgccgccggttgcagaaatctaagagaacttgaccttcaggagaatgagattgaggattgctctattcattggctcagtctctttccagaatccttcacttctttggtaactctaaatttttcatgcctagagggggatgtcaatatcactgtacttgaaagactagtaaccagatgttgcaatctcaagactctcaagctcaacaatgctatacctcttgacaagcttgctaacctccttcgcaaagctcctcagattgtagaacttggaacaggaagattctctgcggattaccatccggatctcttttcaaagcttgaagcagcatttgctggttgtaaaagcttaagaaggctctctggggcttgggatgccgttccagaatacctgccagcattttactgtgtatgtgagggcctcacatcactaaatctgagctacgctactgtacgaggccctgaactgattaaattcattagcagatgcaaaaatttgcagctcttatgggtgatggacttgattgaagaccatggtctagctgttgtggcatcatcttgtaataaactgcaggagttgcgggtcttcccttctgctccttttgatgcagctgagcaggtttctttaactgaaagaggtcttgttgacgtctctgctagttgcccaatgctggagtcagtcctctacttctgcagacggatgaccaatgaggcccttattaccattgcaaagaaccggcccaactttacttgcttccgcctatgcatcattgagcctcacactccagactacactacacaccagcctcttgatgcaggttttagtgccattgtggaatcatgcaagggccttaggcggctttctgtttcaggccttctcacagatagtttatttaaatccatcggggctcatgctgatcgtcttgagatgctctcgattgcctttgctgggaacagtgatttgggcctgcattacatcctatcgggctgcaagagcttgaagaagctagagatcagggactgcccatttggtgataagcccttgctggcaaatgctgccaagctggagacaatgcgatccctttggatgtcgacgtgctcactgaccctgggcgcatgccgacagcttgcacgcaagatgccccgccttagtgtggaggtcatgaatgatcctcgacggggatgccccttggactctctcacagatgagagccctgtcgagacattgtatgtctaccggacaattgcaggtccaaggtctgacacaccagcctgtgtccagattgtctaataa

SEQ ID NO: 384 - DNA, 416 bp, Glycine max
ctcaaactccttgcattctttctttctttacaacaatgactttcgaagagaaaacaatttatcaaaccactttagcctcaattccccactacacccttctagagtgtgtcttggggatttgcttcacagtgatcaccatcctccttcagcttccttatgagtacatagacaacaatccagttcccaccatagtcttcaagggtcgcccgagaacattccatgccttcataatatgcataatcttcgccttctcgggtgccaccaatgcacttgtggcattcaataagtcaagattttctaggctttgtgggtattatgcaatggcttctatggcttcggctttggcaattctcttgtgggcattgtgctgcacatgtatcaattagaaaggctggactttgattctggaactgtag

SEQ ID NO: 385 - DNA, 528 bp, Glycine max
gcaagcattcataaagcataactgaagaaaactaaggaaggaaggaaggaaggaagagtgagcgtgaaagatgccttcggcgaggctttcagggtcaccaaggctcgacgttgctattgacatgggcaatccatttctcaatctcactgttgatggtttccttaagatcggagctgtcgcagccacgcgatcagctgctgaagatacttatcatattatccgaaacgggaatatctcaagtcatgatttcgagaaaacgttgaagaagatgtgtaaagaaggtgtatattggggaactttagctggtgtttatcttggaatggaatatggggtagagaggatccgtggcaccagagattggaagaatgccatgattgggggtgcagtaactgcgactctgttatctgttgccaccaccaacaacaaagacaaaattgtacctgatgccattactggggcagcaattgctactgctgcagagttcataaattaccttacctgaatgaatgaaagtggatgtcttgctta

SEQ ID NO: 386 - DNA, 2707 bp, Glycine max
tccatcattgcttataattctctggtatcttctatgaaagccaatttttctggtgtcagctgttgaaaaattggggtgcttaatattctacaaggaaattttccatctggtaattatgcatgtctggccccgtgaccatagctgattattcaaatggaggagcactttcttgtgcagagagaacaaaatctgttgatgcgattcctgaattagaccatctgtcaatattgacaaatggtgaaattgacggctttagtgttggacaactcttactttttaatggggagtcatattctggatccctttatggcaatgtttctgaaggccatggaacgtacgtgtggtgtgatggttgcgtatacgagggtgaatggaggagagggatgagaaatggttatggaaaactaagatggccttcaggagcagtgtatgaaggtgatttctctggtggatatatccatggtacgggcacatacattcgttctgataaattgaaatataaaggtagatggaggttgaatcttaaacatggtttggggtttcaagtttatcctaatggagatacctttgaagggtcttggatgcaaggaacacaagaggggcctggcaagtatacctggaccaatggaaatgtgtatgtagggaatatgaaaggtgggataatgtcaggaaaaggaactcttacttggataaatggggactcatacgaaggaaactggttaaatggcatgatgcatgggtttggagtttatacttggagtgatggaggatgctatgttgggacttggacatttggtctaaaagatggcaaaggaaccttttacccgagaggtagccgtcttccttgggtgcaagaaatttacctcagtgccttgagaaaaagagggttgctgccagatttgagaaaacagaaacaggtgagagatgtcaaggtaccagagaaccatatgtcaagtcatgtttcatctgataagtttgcaaaaggaaacctgttaaatctggaagagtctaatagaagaaatgtctctctcgaaaggcgttggagtcttgaggtgtctattgagaaggtgattggatatgattcagcattaagatttgcagaatctgtaccagaaagtagagatggagaagttgatgcaatgatcccaattttggaacgagagtacatgcaaggtgtgttaataagtgaggttgtgttaaataatatgttttcatcaatgtctagaagggcacggcgacttcaaaaaaagcttgtcaaagagattaaaagacctggtgaggcaatcattaaaggtcacaggagttatgatctgatgctcagtttgcagcttggaataaggtatactgtgggcaagataacacctataccgactcgaggagttagagcatcagattttggtcccaaagcaagcttttggatggattttcctaaagaaggttctcaattaacacctactcatcaatcagatgattttaaatggaaagattattgtcccatggtgtttagaaatttgagagagctgttcaagattgatgctgccgattacatgatgtccatttgtggaaacgatactctgagggaactatcttctccggggaaaagtggtagtgtcttcttcctgtctcaggatgatcgtttcatgatcaagacactgcgaagatctgaagtcaaggtccttctaagaatgcttccagactatcatcatcatgtgaagtcatatgaaaatacacttatcacaaaattttttggtctgcacaggattaaaccttcaagtggtcaaaagtttcgctttgttgtaatgggaaatatgttctgcacagacttaaggatccatcggaggtttgatttaaaaggttcttcccttggaagatcatcagacaagatagaaattgatgagagtactacgctcaaagatttggatctgaactacagcttctacctggaaccatcttggcgagagtctttactaaagcagattgaaatagacagcaaatttttggaagcacagcacattatggattacagccttcttctaggtgttcactatagagctccccagcatctacgttctcacgtttcatacaaccaaagtagaagtgtggatggattagcaatgcttgcagaggaagatcctctagaggatgaagtattctatccgcaaggccttgttctagttcctcgaggaggagatgatgacagtgttgttgttggctcacacatgaggggtagccggttgcgagcttcatctgctggtgatgaggaggtggatctacttctacctggtacagcaagactccaaatacagcttggtgtgaacatgccatcaagggcagaacagatttcaggaaaacaaaaacaagaaaagcaaatgtttcatgaagtgtacgatgtggtgctgtaccttggtatcattgacatattgcaggactacaacatgactaagaggattgaacatgcttataaatctcttcagtttgattcattgtctatctcagctgtggaccctacgttctattcgcatcgcttcctggaatttattcagaaggtgtttccaccaaatgcaacgacaggttaatcaagataattttggggttatatttaaccagtaagtttatttagaaagtgtgaatattgcacttttcatgcttgctccagaatttttatagtaggtggccacgtgggcaccttgttgatggtggtaatagg

SEQ ID NO: 387 - DNA, 1245 bp, Glycine max
aactagaaaggagaataaagaaatgggcgcaacgaagagtggacgagttaaacttggaacacaaggccttgaggtttcaaaattgggattcggatgtctgggtcttactggagcgtataatgagcctctcccggaacaggatggcatatctattatcaagtatgcattcagtaaaggaatcacattttttgataccgctgatgtttatggagccggtgctaatgaaattttgcttggaaaggctctgaagcagctacctagagaaaagatccagctagccacaaaatttggtattgcgagattagatttttctaacatgctgatcaagggttcgcctgaatatgtgcgctcatgctgcgaaactagcttgaaacgtcttgatgttgaatacattgatctctattatcagcatagggtggacacatctgtacctatagaggaaacagtgggtgaacttaagaaactggtggaggagggcaaagtgaggtatatagggttatctgaagccagctcagatacaataaggagagcgcacgcagttcatcccatcacagctgtgcaaatagagtggtctatatggactcgtgacattgaggaccagatagttactatctgcagggaacttggtattggaattgtatcatatagtcctcttggtcgtggtttctttggcggcaaaggaattctggaaaatgtgtctgcaagtagctccctgaaagtacatccacgctttcaagccgagaacatggacaagaacaagaatatatatgaacgaattgaaagccttgcaaagatgcatcggatcactcctgctcagttggcattagcgtggctactccagcaaggcgaggatgttgtacctatccctggaacaactaagattaagaacctggatcagaatataggtgccttagcagtgaaactgtcagagaaggacctgagagaaatttctgaggcggttcccattggtgatgtagcaggcggaatacactactatggactggaacacattacctggaagtatgctaacacacctccaaaagattcgagcatctcaacctgaagcactcaacattcaacttctgttagagaattccactaagtcgtgaatgaggctaacgaggctgacaaaggctaatatcagcaagctaaaaatatcaataatgtagcccaggtctctattcccctatgtcttgtgtaaagctaaaatttatgcttgattagatgatgccactgttatggtta

SEQ ID NO: 388 - DNA, 1071 bp, Glycine max
acgctagttcaactcaaccaattacttcatattcatatatatggattcccctgcagtttcctctatccactttcacaacgcccatgtcttacccgaaccagacctttttatgcacactcccggtggtaaccgcattccagcgcacgcaaccattctggcttcggcatccccagttttagaaaacgtcattgcgtccaaccgagtcgtcaaaatccacggcgttcccgacggcgccgtcacggccttcgtagcgttcctctactcctccaggtgcacggaggaggacatggacaagtacggaatccaccttctagcattgtcgcacgtgtattcggtgccgcagctgaagcagaggtgcatcaagggactggcccagcgcttgagcacggagaacgtggtggacgtgttgcaactctctcggctctgcgacgcaccggatctctacctcaagtgcgtgaagctcctcaggaaccgtttcaaagccgtgaaggaaacagagggctggaaattcctcgagagccacgacccctggctcgaactcgacgttctccgcctcatgggcgaactcgaaaagaggaagaggagggtgaggaagtggagggaggaggagaggttgtacgtgcagctgagcgaggcgatggagtgtttggagcacatatgcacggaggggtgtacggaggtagggccatacgaggtggaggttggacgacagaaaacgccgtgctcaaagttcgccacgtgtcagggtttgcaggtgttgatacgacacttgggaacttgcaacaggaagctcaaaggagggtgtttgcggtgtaagcgtatgtggcagctcttcaggctccactcctccatttgcctatgccagaattcatgcaaggttcctctttgcaggcaaattcgattaaaaatggagcaagagaacatgaaagatgacgcaaggtggaaactactggtgaggaaggtggcctcggccaaagccttgtcttccttggcactgccaaagaggaaattagatcagagctagggaccatatatataaataaataatggcaagttgtgcctacatgtttc

SEQ ID NO: 389 - DNA, 858 bp, Glycine max
catctgtgagagtggctcataccatatcatatcacatcttatccagacaaaacaactgttatggataggtatcagagggtagagaagcccaaggcagagagccctataaacgagaacgagatacgcgttacttctcaaggaaggacgaggaattacatcacctacgccaccactctccttcaggagaaaggatctagtgaaattgttctcaaagcaatgggacgtgcaataaataagactgtaatgattgctgaactgatcaagagaaggattgttggtctgcatcaaaacacccaaattggatcaactgatataactgacacatgggaaccactagaagaaggccttcttcctttggagactactcgccatgtttcaatgatcacaattaccttgtcaaagaaagaattggatacgtcatccacaggataccaacctcctcttccagttgatcaagtaaaacctttaaatgaatatgatgaggaaggagaaggctcaccaaggatacgaggaagagggcgtggtcgtggaaggggcaggggtagaggattttacaatgggggtatggaatatggtgatggttgggatggtggacgtggctatggtggaagagggcgtggtcgtgcaagggggcatgcttttcggggacgaggacgaggacgaggctatggtgtgcagccagttggttactatgactatggtgaatatgatgctccacctccaccacgtggccgtggccgtggaaggggaagaggccgaggccgtggccggggaagggaccaggtaccagctgcttgatcaagtgtttgttgcttatcatgtatatgttaagttagatgttgcctctctgtttagttc

SEQ ID NO: 390 - DNA, 2072 bp, Glycine max
ttgagatgattgatcattcactcaggggcgaggatttgatgaatccaatgggtgctagtactgtaagcaacgaagaactcaaagagatcgagagtctcgggagagaggacattgaagaggctccaattgtgcccgaggatgtgagcagaatagcaccatggataagacagattacacttcggggactagtagctagcttcctgattgggataatttatagtgtgattgtgatgaagctgaacctcacaactgggttagttcccaatctcaatgtttcagctgctctccttggctttgtgttcattagagcttggactaaggttcttgcaaaggccaaaattgtttcgaccccattcactagacaggagaacaccataatccagacttgtgcagtcgcttgctatagcatctcggtaggaggtggtttcgggtcttatctcttgggtttgaataggaggacatatgagcaagcaggagttggtacagaggggaataatcctggtagtaccaaggagcctggaattggatggatgacagcctttctctttgtgaccagctttgttggattgttggcgttggttcccattagaaagattatgataatagactacaaattaacttatccaagtggaactgctactgctgttcttattaacgggttccatactcctaaaggagatgttatggccaagaagcaggttcatggtttcttgaaattcttctcagccagtttcctctgggctttctttcaatggttttattcgggtggtgataactgtggatttgttaagtttcccacttttggattgaaagcatggaaaaattcattttattttgatttcagcatgacttatgtgggagcaggaatgatttgttcccatcttgtaaatttatccttgcttcttggtgctgtgatttcatggggcattatgtggccattaatcaggggactaaaaggggaatggtttcctgcaagcatagcagagagtagcatgaagagtcttaatggttataaggtttttatttccattgctttgattcttggtgatgggctttacaattttgtcaaagtcctctatttcactgccacgaatattcatgccaccgtgaaaaggaagaaccccgaaactttttcagataaccagaaaccactccctcttgatgatcttagacggaatgaagtgtttgctagagaaagcattcctatatggctggcctgtactgggtacatattattctccatcgtttctatcattgtaatccctttgatgttcccccagttgaagtggtactacgtggtgtttgcctatctttttgcgccctctcttagcttctgcaatgcttacggcgcaggcttaactgacatgaacatggcctataactacgggaaagtggctctctttgtgctagcagccttggccggaaaaaatgatggcgtagttgctggactagtggggtgtggcctgataaaatccattgtttccatttcatctgatttgatgcatgatttcaagactggccatctcactttcacttcccctcgctcgatgcttctaagccaagcaattgggacagcaataggttgtgtagttgctcctctcacattcttccttttttacaaggcttttgatgtggggaacccagatggggactacaaggctccatatgccatcatatatagaaacatggcaattcttggtgtggaaggattttctgcccttccacatcattgcttgcagctttgttacggattttttgcatttgccatagcagccaacttggtcagagatctagcccccaaaaacattgggaaatggattccacttccaatggcaatggctgtccctttcctagttggtggttactttgccattgacatgtgcatgggtagtttggttgtgtttttgtggcacaaactaaacagaaatgaggctggtttaatggttcctgcagttgcttctggtttgatttgtggagatggattatggattctcccttcatctattcttgctttgttcaaaattcgtcccccaatctgcatgagcttcctgtcagccagtgccagttagtag

SEQ ID NO: 391 - DNA, 776 bp, Glycine max
caaggtaacgaacgtagctgagcaataacaatgccactgccaacggtcgtttccccattttcttcttcctcaggcaccttcttatccacagttaccgcgcgctcttcactccctccaaaacgcaacgtctccccttccccttcccccttctccactctctctcgcagagacattgctctgctttccttcttctccctctccctctcagcaccatcctccgccatcgacattggcatctcaggaccgaaggattggctgaaagagcaaaaaaagaaggcctccaagtacctattggcccccgtcgatgcctcccgccaaatccttcgctctgcctatctcacgctcacggaaactgacgctgcttatacggatgaggatttggagaagatgcagcagctctttatatctgctgccagggattgcgtcccacaggaccggaattctttcgtcactctccaagccaacaccggagtagaggtgtgcacctttcgattgattgtgaagaatgcagcttcgttgcttggaaataaggatcctgtaaagttgaaagccgaagctttgctagataatcttataagatctttcacctctgtcagtgggctggcaagcgaaaccaacattcaacttgcatcagataggaaaaagatagctgatgctgtatcagataccatatctgatcttgacaaatttgagcagggaatcagggattgccttgaaacctaactctaaaggatagcctagcctacttttttatgtggaaagttggccattaaata

SEQ ID NO: 392 - DNA, 1361 bp, Glycine max
ttattatggtgactatggaagagagtccaaggagcccagaggcgaagctggggttgcgagtggaggatctatgggacattcaggaaccacagctaagtcctgatgagaagttcaatgcttgctttgaaagcatacctgtctctgccttccctccacctccttcaaatcaagaaattgagataaaatcagatgccaccctagccgaggcagtaaaaatacttgcagaacacaacattcttagtgcacctgtggtggacgtagatgcacccaatgatgccagttggattgacagatatataggaatagttgagtttgctggaattgttgtttggattctgcatcagtctgaacccacatctccaaggagtccatccggtggagctgctaatacggctgcagtgaatggaataacttctgaagcattaggccttgaatctgcttcgacaacttcaggcaatttctttgaggatctgacttcttctcaactatataagaacaccaaggttcgtgacatttcagggtcattccgctgggctccatttctcgctctggagagatcaaactcatttttgaccatgcttttgctgctttccaagtacaagatgaagagtattcctgtggtggacttgggtgcaggtcgaattgacaacattattacacagtcttctgtaattcacatgttggcagaatgtgctggtcttcagtggtttgagagttggggaaccaagaaactgtctgaagttggtcttcccatggtgacaccaaatcatattatcaaggtttacgaggatgaaccagtgcttcaagcatttaaactgatgaggaaaaagaggattggagggttgccagtgatggacaggggtagcagcacagcaattggtaacataagcctgaaagatgttcaattcctcctaactgctcctgaaatctaccatgattatagatctattacagcaaaagacttcctgacagccattagaagctacttagagaagcatgaaggggcctttccaatgtcaggtgacctgattacatgcaataaggattgcacaatcaaagaattgattcaactgcttgaccatgagaagattcatagggtctacgttgctgacaatgacgggaatctggaaggactaatcacactcagagatatcatctcaaggctagtacacgagcctcgtggctattttggtgatttctttgatggggttctcccaatgcctccaaacagcagggtttgaaatgcttccaggaagaataagttctattccataagtaacaaattgacgtgtttctcatcagagctgacgacaagatcctagcccctttgtaacatcagcacctagcactttgcaagttac

SEQ ID NO: 393 - DNA, 2086 bp, Glycine max
agatattgaaagggctcttggattcttttttttttttatgtggttattcttttgctagcagaaccaggggtgtaagaagaagttgaagtgatggaaccccacgatgaagaagagatccataactgtttgatcaagctgagaagtaatccggaaaggcgaagggataaggtttacattggttgtggagctgggtttggtggtgacaagcccttggctgctcttaagttgcttcaaagagttcaagaactaaattatctggttcttgaatgcttggccgagcgaactcttgctgatcgttatcaaatcatgatgtctggtggtgatggttatgattctcagatttctaactggatgcatatgctgctgcctctggctttggaaagaggaacttgcataattaccaatatgggtgcaatggatcctctgggtgctcaacagaaggtcttagaaatagctaacagcctgggtctcaatgtttctgttgctgtggctcacgaggtgtctgtcactaatatagtaggttcaggattttcaccagcaaaatcatatatcatggagggtggtatcagcacctacttgggagctgctcctattgttcgttgccttgaaaagtaccaaccaaatgtaataattacatcgagaattgctgatgctgctttattcttagcacctatggtttatgagctaggatggaactgggatgaattagaacatctagctcaaggatctttggctggccatcttctagaatgtggttgccaactcacagggggatatttcatgcatccaggagacaagtaccgagatatgtccttccagcaactactggatttatcactgccttatgctgaaatctgttttgatggccaagtatgtgtatcaaagtctgaaggaagtgggggagttttaaattttaatacatgtgctgaacaattactatatgaggttggagaccctggggcttacgtaacccctgatgtggtgattgattttcaggatgtttctttccttccattatcaagctctagagtttgctgtcatggagcaaaaccatctactatttcagttcctgataagcttttgcagttggttccacaggattgtggatggaaaggatggggagagatatcttatggaggttatgaatgtgttaaacgtgctaaagcagcagaatatctggttagatcatggatggaagaaatatttcctggtcttaatcaccgtatactttcttatataattgggtttgatagccttaaagctaccagcgggaatggaaatgagtcatcacagacaactagtgaagataataggctacgcatggatgggctttttgaacagaaagaacaagccatccaatttaccagagaatttatagcattgtatacaaatggaccagctggtggtggtggtatcagtactggatataagaaagagactcttctagagaagcatttggtaaagcgggaagatgttttctggcgaactgggataaagaggagcacaagaagtcagtcaaataaagtagttgatcctgaccacaatctgaggcacatattgacattgccaccgaagctacaagctgaaacagacaaatccttggaatctgtttctcttggtagtagttgctcacctgctccatctggccagaagattccactttacagtgtagcacacagcagagctggagataaaggaaatgacattaatttttccctcatcccacattttcctcctgataatgagaggttgaaactaattattacatctcaatgggtaaaatcagtggtctccaatcttctggatttgtccctttctcctgatttagatgcaaaaattccaagagataaatgggtcaatgaaaatgttaaggtggagatatatgaagtcaagggaatccagtcattaaacattgttgtcaggaacatactggatggtggtgtcaactgttctcgacgaattgatcggcatggaaagaccatttcagatctcattctgtgtcagcaagttgtgttgcctccttgattgtgtgatttactaataaggtggcaatgttctcctgaatggaatgaatagagcattgcaa

SEQ ID NO: 394 - DNA, 767 bp, Glycine max
cggaggcatatcatccttatcatcatcttcataaaattatatcttttgcgcgcattctcattcaccaatggcgttcaccgtcgccattggcagtggcgtggctataatcccctgcggcaacaccaccaccgcaattccttacacccgtggtggtggtcaccgaacgagaagaaagctccatctccatgtggcgcgcgcgaagaagcccctgaacggcgacggcgtttccatttacactgagctcctcaaaaccgaagtttccgttttcgaaaataagccccttggcgacaacgatgccgctttgaagttcgtagagaagatagaccgtcaatttcaataccccgatttctgggaaggatcccagtgggactggttaggcatcttcgtcaagttttccccaatcattggcgtcgctgttgcggcatgtcttgctatctacggttgctttacatttcatgaaccaccaaaagaaatgagggaggctgctgaaaggctgtattctgtgcagtccggcgtggagtctagtgcagagtccggtttggagtctagtgcagattccagtgtggagtccggtaaagttattgaagagcctgatgcatatgactcagatgtttttgattccaatccaacagaggtagcacctagtttggagtagactctccctagatacactgcaaatataccttatttttagcatttaaacccaggtgaatggattcaaacctttactgcaattaatttttaaggcaatgcttctggttacatgt

SEQ ID NO: 395 - DNA, 1166 bp, Glycine max
tgtttccagtttccaactttcctggtatggcattagaggcagttaatgacagaaaagctgaagttcaagcatttgatgattctaaaacgggtgtaaaaggtgtcctagattctggggtaacaaagatccctaccatgttccatgtcaagttagactcaactcacacctcaccaactcactccaacttcaccatcccaatcatagatcttcagaacataaacagcaattcaactctgcatgctgaagtggttgaccagcttaggagtgcatctcagaagtggggatttttccaagtgatcaatcatggcgttcctgtggaggttttggatgagatgatcagtggaatccgcaggtttcatgagcaagatgctgaggcaaggaagcccttttactcgagagatagcagtaagaaagtcaggtatttttctaatgggaagctgttcagagacatggctggtacttggagggacacaattgcatttgatgtgaatcctgatcccccaaacccacaagatataccagcagtgtgtagagatattgtggctgaatattcaaaacaagtaaaagcgttaggtaccacgatctttgagctactgtcagaggctcttggccttgatccttcttaccttgaagaaatggactgcactaaagcactttatgttatgggtcagtactatccaaaatgccctgaacctgaattaactatgggaatttcaaagcacactgattgtgacttcataacaatacttttgcaagatcagattggtggtcttcaagttcttcatgagaatcattgggttaatgctcctccagtgcgaggagctcttgttgtcaacattggagatattctgcagcttatgactaatgacaagttcatcagtgtttatcaccgggtcttgttgaggaatatgggccctagaatttctgtagcaaccttcttcatgaattttaccatatctaaatgtacatcgaagagttatggtccaataaaggaattgttatcagaagaaaaccccccagtctatagggacatgaatatgaaagaaatcttgacaaattattatgcaaaaggccttgatgggagctcctacttgctgcctttaaggttgtgaagcaaataaaagtattagatcgatcttttcttgattctcatggagttggctagt

SEQ ID NO: 396 - DNA, 1589 bp, Glycine max
tcctgctaaagacagatctcagattctgtacgctaacatagagagttagagtgagaaagagagagatggcaacgacgacgtcgtcttcaagcgaggaagcaccgaacactaagaagaacaagaaggagcgtttaggttggatagaatggttaagaggttggttctatttggtctacgaaatgctctttcagcgcatcatggcgagccacttgcacaaccctatgcctctccctcctgtaaacgacctcacttgcattgtcaccggctccaccagcggcattggcctcgaaattgctaggcaattggctcagtcaggggcccatgttgttatggctgtgaggaacactaaggcagctcaggagttgatccagaagtggcaggttgattctgaaggattgagtattcctctcaatgttgaggtgatgcaagttgatcttctctcattggattctgtcacaaggtttgctgaagcatggaatgcacgctcagcacccttgcatgttctcatcaataatgctgggattttttctattggagagccacaaaagttttccaaagatggttatgaacagcacttgcaagtgaatcatcttgctcctgccttgctttcgatacttcttttgccatcccttattaggggttctcctagtcgcattgttaatgtgaattccataatgcatcatgttggctttgtagacaccgaagatatgaatgtcacatctggaaaaaggaaattttctagtttggtagggtactcaagcagcaagttagcagagattatgtttagtagtattcttaataaacgactccctgcggaatctggcatcagtgtattgtgtgtatcacctggaattgtccagaccaatgtggcaagagatcttccgaaacttgttcaagctgcgtatcatttgatcccttacttcatctttagtgctcaagaaggtgcaaggagtgctctctttgctgccactgatcctcaagttccggagtattgtgatatgttgaaagcagatgagtggcctgtttgtgcctttatttctcaagattgtcgtccagcaaatccatcggaagaagcgcacaacgttcaaacatcgtatgaagtgtgggagaagacattagagatgattggccttccctcagatgctgtggagaggcttttagatggggaagaagttaaaagccattatagacaagaacagtaatctaatatacaatatctccctaaatctgtaagggcacgtccattatttatagctagcaatgagcattttgattctgaatatgtaggagaagaacccttttatatttttttaacatgatatgtacatccattttgatcatatttgtgcactcaaatgccacttgctcctcctaatgggagaatttagccagctataaacaggtgttttgaccttaaatgtcaccataggagtaagaactaaattagtcagcactatgttgtgatagttgttttgacttttgacccatgccattggtgaccctcctaaataagtgggttccaacaatagtgttgctttcaattttggaatgttaccatgttataatgcaattcttacattctcgagttg

SEQ ID NO: 397 - DNA, 878 bp, Glycine max
cttgtggataggacgcaatcaaaagagcaaacgttgtttgttggtgtgttatcataaaattatattttttaggcgcattctcattcaccaatggcgttcaccgtcgccagtggcagtggcgtggctataatcccctgcggcaacaccggcaccgccgcactcttccctcaccgaacgagaagaaacctccacgtggcgcgcgcgaagaagcccctcaacggcgacgacgtttccgtttacgctgagctcctcaaagccgaagtttccgttttggaaaataataagcctctcgacgacaacgatgccgctttgaagttcctagagaagatagaccgtcagtttcaacagcccgatttatgggaaggaccccagtgggactggctcggcatcttcatcaagttttcccccatcattggcatcgctgttgcggcaagtcttactatctacggttgctttacatttcatgaaccaccaaaaaatgtgagggaggctgctgaaaggctgtattctgtgcagtctggtgtggagtccaatgcagagtccgatgatgtggagtccagtgcagagactgatgtggagtctagtgcagagtccagtagtgaagttttcaaagagcctgatgcatatgactcagatgtgtttgattccaatccaacagaggtagcacctagtttggagtagactctccgtagatactgcaaatataccttatttttagcatttgaaccaggtgaaaggattcaaactttttctccactaaatttgtaaggcaatgcttctgcttacatgtacaccctcttaaagtgtatcaattctgagacagatcaagtggattagttgtacgtgtaaatgtatggttatttgttgcattgcatctg

SEQ ID NO: 398 - DNA, 891 bp, Glycine max
gatttgagcctctctcagtgacaacagtttctgagtcttactgatcttttcttctctctaatctcttgtgatttttcttctctctaatctcttggttgcgtggcagactaaatgattttgtgtttttggttctcttttaggcttgtacaggttggaaatcttgggcttcagctgccatggtactttctgcaaataattgtcagcgcatggtatttcatatcagtcgtgggtaatttgtttgaaagctatttcatctctttaaagaaatacaagtctcttcattcgggaaaggttcggtaccttgccattgtcatagaaagtgaagaagcttatcagatttccaaagttgttaaactttcgcagtggcttgactctattggtgtaaagaatgtgtgcctttatgacatgaatggagtattgaagaagtctaaggaaaccatgtttcaaaaattgaagaatgcaaaatccattgaggaagttagtgaagtcgtcacactccatgctccagatcacatgactttagaatttctttcttatctggatgggaaggaggcagtggccaaagcagctaacttgatttttgtggaaaactcgaaacgacataacttgggtggagaactagatcttcaaatcttgttagaacctcaaatgaataaagcattgcaaattgttggtagcaaaggccccgagcctgaccttttattggtttatggacctgtgaggagccatcttggttttcctgcatggagacttcgttacacagagatcatacatatgggatcattgaacttcatgagatatggttccttaatgaaagtcattaacaacttcacgaaagtgcaccaaaattatggtacgtagaaaaggaatttggaggtagttaactgctag

SEQ ID NO: 399 - DNA, 300 bp, Glycine max
gttctgttctgtacctgcacccagccgcagcagcaagtgatcgaagcgaaaagagagtaatcagcagagaaattcatcgtcgtagttatgggtaaagttcacggatcacttgcacgtgccggtaaggttagaggccaaaccccaaaagtggccaagcaggataagaagaagaagccacgtggccgcgctcacaagaggatgcagtataatcgccgattcgtcaccgccgtggtgggattcggcaagaagaggggacctaactcgtctgagaagtgaggctgaggcttaaagaatatgtca

SEQ ID NO: 400 - DNA, 1578 bp, Glycine max
ggttggtgtgtaggaagcagagagagatgatggagttgtttctaagttgcatggtcctctttgtgttaactttagcaacacttggcgcacactggatctgggtggtttcatcgagtagagcaggttccaaactcccaccaggccctttccctcttcccataatcggaaaccttcttgcactgggcaaaaagccccaccaatctctggccaaactcgccgagactcacggcccaatcatgactctcaagttcggccaagtaaccaccatagtggtctcttccgccgacatggccaaagaggtgctcctaacccacgaccactccttgtcgtcaaaccgtgtcattccacaggccgtgcaggttcacaaccaccacaaccacagcattaccttcttgcccgtttcacctctctggagagaccttagaaaaatatgcatcgctaatctattctccaacaagactcttgatgcgagccaagatctcaggcgcagcaaactgcatcaactcctccacgatatccaccgaagcagcctagctggtgaagcggtggatgttggaaaagcagttttcaacacttccatgaatttgctttccaacacttttttctctctagatttggtccactcttcttcttctgctgctgctgtagatttcaaggatttggtgctcaaaatcatggaagagagtggtaaaccaaacctcgctgacttcttccctgtactcaaattcatggacccgcagggtatcaagactcgcaccactgtttatgccggcaagatcattgacacctttcgcgctttgattcatcagaggttaaagctcagagaaaacaaccatggccatgacaccaacaatgacatgctaaataccttgctcaactgccaagagatggaccaaaccaaaattgaacatttagctctgactttgtttgttgcgggaacggatacgattacatctacggtagaatgggcaatggcagaattgctccaaaatgaaaaggcaatgtcaaaggcaaagcaagagctggaggaaaccattggcagaggaaaagcggtggaggaatcagatattggtaggcttccttatttgcaagcagtgatcaaagaaacctttcgattgcaccctgcagtcccatttttgattcccaggaaagccaatgcagatgtggaaatcagtggtggctacacaatcccaaaagatgcacaagtgtttgtcaatgtgtgggctattggaagaaactcaagcatatggaaaaataatgcaaacgtgttttcaccggagaggttcttgatggattcggaggatattgatgtcaaaggtcacagctttgagcttaccccgttcggtgctgggcgtcggatttgtcttggcttgccgttggccatgaggatgttgtatttggtgttgggttcgctaataaactgttttaactggaaacttgttgaagatgatgatgttatgaacatggaagatagctttgggataactttagcaaaggctcaacccgttatactcattcccgagaaagtgcatggtgtcatcgtgtcatgaatgatgcacatgcacactgttaaatgca

SEQ ID NO: 401 - DNA, 1241 bp, Glycine max
aaagtcgacctgataacccataaccgaccgcaccaccgttttcctttgctttgcgttctacaatgtcgaaaacctcagagattattacatgcaaagctgctatatgctggggaataggaaaacctgtgactgtggaagagatacaagtagaccctcccaaagccaccgaagttcgagttaagatgctttgtgccagtatatgctccacagacatctctagcacaaaaggattcccacataccaattttcctatagcacttggacacgaaggagttggtattatagagagtgttggtgatcaagtaacgaatctgaaagaaggggatgtggtaattccaacatacataggggagtgtcaagaatgtgagaattgtgtttcagaaaaaaccaatttgtgtatgacatacccagtaagatggactggtctaatgccagataacacttcaaggatgtccatccgaggagagaggatataccatattttcagttgtgctacatggtcagaatacatggttagtgatgccaactacgttctcaaagttgatccaaccattgatcgagctcatgccagtttcatctcatgtggcttttcaactggatttggagctgcttggaaggaagccaaggttgaaagtggatccactgtagctgtttttggtcttggggctgttggattaggggctgtaattggatccaaaatgcagggagcaagtaggataattggaattgacacaaacgagaacaagagagcaaaaggagaagcttttggaataactgactttataaatccgggtgattctaataaatctgcttcagaattggtcaaggaactaagtggtggaatgggtgtcgactattcttttgagtgtactggagtttccactttactctctgaatccttggaagccacaaaaattggaacaggtaaagcaatagtaataggtgtaggaattgaaattactttgccattgggtctttttgccattctgcttggtagaactttgaaaggttctgtttttggaggactcagggccatatcagacctttccattttagctgacaaaggccacaaaaaggaattccctcttcaagaactcttcacccatgaggtcacattagcagacataaacaaagcatttgagctactaaaacaacccaattgtgtcaaagttgtcatcaacatgccatagtcatattagcgcaattgtaggtaatcttcggcaaagtttgaaaggcctttt

SEQ ID NO: 402 - DNA, 1045 bp, Glycine max
actagtgcggttgtgtgttctgttgttgtctccgttcattacatcgtagctccgatcaccgagaatgcgtagtctcgctgcacctcattccttccgggttttcgtcaactcgcccatctttcgccccattaagcttccttttctcactctcaaccctctctcttcaccttccagaagatctccagcttccgttcaatgcgccgttcaattccgcccctgcatcgacatccacaaggggaaagtgaagcaaattgtggggtcgacccttcaagacttgaaagggggtgacggttcggatcccgtcaccaatttcgagtctgataagtcggctgctgagtatgccgcgctttacaaacaagatggactcactggtggtcatgtcatcatgctcggagccgaccctttgagcaaagcttctgcccttgaagcattacacgcttatcctggcggtttgcaagtcggagggggaataaattctgacaattgtttgagttacattgaggaaggagcaagccatgtcattgtgacatcttatgtattcaataatggacaaatggatcttggacggctaaaagatcttgttcaaattgtaggaaaagacaggcttgtgttggatctcagttgcagaaaaaaggatggtaaatatgcaattgtcactgatagatggcagaagttcagtgatgtttttgttgatcctgatgtaatggaatttcttgccaattttgctgatgagtttctggttcatggtgttgacgttgaagggaagaagttgggaattgatgaagagcttgtggctttgcttggcaaacattcaccgattcctgttacctatgctggtggtgtgactgaaatgtctgatctggagaggataaaaactgccggaatggaccgtgtgaatgttactgtgggcagtgcattggatatttttggggggaacttggcttatgaagaggttgtagcttggcatgcccagcaaaatgcctctgcagtttaattagtatgttttcttttagttgggggctgggactggttagcaaggatttag

SEQ ID NO: 403 - DNA, 719 bp, Glycine max
cacgataagtgacaacattagacgttgaattgaattttgatggcgcaacaatcgtcacctccacggcggcaaactcctccgccatcgcagtacctggaggtcaactgcagaagctccggcaagatacggcggtttgcggcgggcaccggcgcggggtttgcggtggcgctgatcaatcggaagctgaagggaacggtggtggctgcgtcgcacatagaagcagtgaaggatgggaaagaagaagaaccaatcgcttttggccccacttcgcttctttctaacttcggcgaaggttggaaactccaaactgttaccctcactgatctttcttcagaagtggggaatggacaatttcaacagatggcaatgcagaaaccaggactagttccaggtgtcccaggtcctgcaagggtgtccaatccaatcagctttgtatatcttgttaaaataatgtttgcttttattttgatttttgtacttgttgcaatttttactttgtttctcgataaccttcctgcattcatattgtttcttaagtcaataacctagtgtctttttgcttgaaatttatatatgcataaataaattgttattaaatatatagcctttctgttaaggactagaattcaaactatggcagacactgaactgtgagagcattgtgtctctcttgaacatttcaatatttcatattttagctgcacacagaatctcatagt

SEQ ID NO: 404 - DNA, 1219 bp, Glycine max
ctcctaggtggaattggaattggggatctactagatgggcctaatcagaagcatgagatcgcggtcacagcgtgtggtgcaggagcaagaagctgctgagtgtgtcggtgtcgtcgtcggcgacagcatgcgacagagttgttgggccaacatgccccaagagcttctccgagaggtcctcctccgaatcgaggcctccgaggacacgtggccgccgcggaagagcgtcgtctcctgcgccggcgtctgccgcagctggagacatatcaccaaagacattgtcaaaacgcccgaactctcctccaagatcaccttccccatttctgttaaacagcctggcccaagggagaatctcctacggtgctttataaagcgcaaccggtccacccaaacatactatttgtttctcagtttaaccagtacgctagctgaagatgggaagttccttcttgctgcacgcaaatgcagacgtccaacctgcacagattatatcatctctcttgacgcagatgatatgtcaaagggaagcaactcctatgttgggaaactaagatcaaactttcttggaacaaagttcacaatctatgatagccagctgcctcatacaggagcaaagattatgaaaagtcgctccacaaggctggtgaatctaaagcaagtttcacccaaggttcctacaggcaactatccagtggcccatatttcatatgaattgaatgtgctaggctcaaggggtcctaggagaatgcattgtgtcatggattccattcctgccactgcaattgaacctggaggtgtagcacctacacagactgagttttctcttaacaacatagacatgtttccttcattccccttttttcgatcaaaatcaaatcgtgcggaaaattccatgtctggaccattggttgatcaaaaggatgggatgctagtgttgaaaaacaaggcccctaggtggcatgagcagctgcaatgttggtgcctgaactttcatggacgggtgacaattgcctcagttaaaaactttcagctggtggcttctgcagaaaacggacctgctggaccagaacacgataagatcatcctccaatttggaaaagttgggaaggatttgtttacaatggattaccggtaccctatctcagcatttcaggcatttgcaatctgcctcagcagttttgataccaagattgcttgtgaatgacatgtttaaacagtt

SEQ ID NO: 405 - DNA, 2373 bp, Glycine max
gttgttgtgctggttctctatgcgaaaatcttctgagggcttctcggcgatgagtggagtaattcattctctggtgtttgattccgcatttccatttttaaatttctctgtctcccatgtaagaaatgtttgattggaacgacgaagagcttgctaacatagtatggggtgaggtgggtgagggtgatgatcatattgtgccttatccggaggcaagtgaagatcttaatgacaagaaagaatggagtcaggaagcttctgctactaaactgattgaccagaagagaatagaggctaaaactgattttcatcaaggaaagctcggaagcagttccaaacttgatataattgagggacaatctgcctcagaatctggcacaaactcatggcctgatttatctttatccactgcggctaaaactgatcagggttccctgggtgctgctgatgtatctaaaactttagaagagactacacagcttgaaaaggatgtagaaaagcaaggtgattttgtcaactatgcctgggataacataggaagctttgatgatcttgatcgaattttcagcaatgatgacgaccctatatttggccatgtaagtcttgagaattctgatgagctgtggtcttccaaagacgtgagtaacagcacagtacccatactcttggagacaccaaacccaacaagtgctttaaggaacagatctgagcctttggaaattaaagcagaatatgtccaacagaatgatcgatcattttcccccagatttaagaggattggcgattctttatctcatgatattgagaaggctcctgcaaatatattcaatgtaggatatgatagagatagaattgccccggctgataaggagcaacaggattttgggcaaaataatcagttgaaagctcggaaaaaatcacaaggtaaactagagggaaaatcattgaaggagttttatggtagctggtctccttcatcaactacatctggacaatttcagaatcagctggtgtcttcagtcatacagtcttctccctcttcaattcttgggcagtggaatgagcttcaaggacctgagacactataccaggacatcacaaatacatatgtgacatcctctgcatatgggaaccttacaaatacatattcttctatgtcaatgctaccacaggctcagtcaggagttcttatgcgacagcctctgctttctcgctatgaagcatctcttggtgttatgaatcctgtgagcaagtctgtggacttagttaagcctcttacaatgactccccaggaaaaaattgaaaaattgaggaggcggcaacaaatgcaagcaatgcttgctattcagaaacaacagcaagaattcggccatcaagttcctagcactaataaatcaatgaatgaaaaatgtgccatagaaatccatagtcaactctgtgatggggctgatcctgaaattgaagatttaagaacagctctagatccaccaactgagcaagatgattctaatacaatgtctctggcaattgatgatcattttgttgaagacaccatactgtacatgcttcaggatgctatatcaaagttagatgtcaaaataagactatgcattagagatagcttgttccggttggctcaaagtgcaatgcaaaggaattatgctaatgatacaagcagtacaaacaacactagcagagaagaacttaaagttgctgcaagagaagaaagcaatagccaaaacagatatgctaggattgctgatgttgaaaccaagacaaatcccattgatcgaactgtggctcatttgctctttcataggcctttggagttaactgggaattatcctgataagcttgagtcacctatttctgctaagatacaatttgaaagcagagaagctaacatggagaagtttcatatgggatgcttgccagatgaggacttgaaaagtaatcaacaattttctcaccaagggcttgaggcccagcctgaggaccaatttaaaaacagtcgttgcatagacacctcagagaatgcttctaacaatgttctagctgatgctggagatcaggtgcttgaagccttgcaatgaagaaaaagtctcccctggaattggaggctgtctggatcataatcaaggcaaccgttgaagtctatcatcacataactgaacacctgtttctcatgtgtatgttatcattaatatttatgtttcgtctgtcaaaatcttgacagtatatgtatctcagcatatgaacttattcagcttggtgagtgacttatgttaataatgactttgtcagacttgtctagtagtaagtaaatgccaataatgttaaagactacgccagatttgtgcagtagtaatgcca

SEQ ID NO: 406 - DNA, 1391 bp, Glycine max
tgaaaatggtaaccatccactgttcccacctggtggttccctccgagcccacgccatcttcaaccctctcactctccctctgcgaccaaatcaagctcccaaaccacggatctcagctctacctctacagcaacaccagcatcacccaccatcatctcatccacactctctcagcctccctcagtaaagcactcactcactactaccccttcgctggccgcctccgccgcatccccggcggccgcttccagctcctctgcaacgccagtggagctgtcctcatagaagccacatgttcaagtcaattcagtttcaaatattttcgcgatttcgctcccgtccacgctgtccccaaaatcaactacgatgatgtccccattgaggatgtccccttgctggtggcgcaggtcacgaggttccccaacggcttcatcacgctcggtctctccctctgtcgcgctctcctcgatggaaattcggctaccagcttcgttaactcgtgggccaagcttgctaaaggagagaacttagattccagcttgattcctttgcttgatcgaaccaagttagattcatttaaactcaataaaccaccacgttttgaacaccctgagtttttgccaccaccccttttgacacaacagcatacccagatggaagaacaacttggttcgaccatattggaactcacaaagggtcaagttgagaaactgaagaagaaagctagtgactttggaagtgggtatggtattaataacggtaatggttccgtacgaccttatactagttttgaggttataactggtcacttgtggaggtgtgtttgcaaggtgcgttacgcgggtggtgatttgggtcaaccaacgaggttgaccactttggttaactgtagaaaccgtttaaggccttctctccccacggcttattttgggaatgcaacgtttcccacggtgacaccaacttgttcctttgatgagatcatgcacaagcctctgagctatgctgtggggaaagtgagggaagcgattgggaagatgagtgatgagtatgtgaggtctgcgcttgattacatagcaagtgtggaggacttcgatttgttcagggacacgttttatggttctggtgatgggaaagggaagtttaagggagatcctaatttgtatatggttggttggacgaattttaagtattttgagacggattttgggtgggggaaaccggtttctttgattcccggaaacattaattctaatggcaaggcttttcttttggacaatgcaagtggtgatggcttcattgtagctgtttgtttgctggaatcgcatgtagatgctctgaggaagttgttttatgaggatatggaggatgctagttccaaattgtgattgtga

SEQ ID NO: 407 - DNA, 2651 bp, Glycine max
aacacactctgctgatgacaagctcatcttccaagttctaatctcaaaatggaagcaattccttattcaatcccctccaccaaattgcactcatctcttcatatttacaccggcgttacacgaattcgatccctccctcttcgccctcccccaatctcaatcaaacctctatattcccccaatttcctcattctccatcgccacagacttcgctgcgtcgctgaatcctccaataatcatcatcatcatgaccacgaccatcaccacggccaccaccaccaccatcatcatcatcaccactcccacggtgctaatctcaccgggcctcaaaaagctgtcatcgctttcgccaaagccaccagatggatggacctggcagacatcctgagggagcacctgcatctttgctgcttctccaccgctctcttcgtcgccgccgcaatttgccctcacaccttgcccaagccactcgtcaagcctcttcaaaactccctcatcttcgtcgccttccctctggttggggtttctgcatcacttgacgctctcatagaaatcagcagcggaaaggtgaacatccatgttctgatggctatggcagcctttgcatcgatattcatgggaaactctttggaaggaggcctgcttcttgccatgtttaacctcgcgcatatcgccgaagagtatttcaccagccggtcgatggttgatgttagggagttgaaagaaaataatccagatttcgcccttgttctggataccaatgatgatgataaactccccaatacgtttgacttggcatacaagagggttcccgtgcatgatgtgactgtaggatcatttattctggttggcaccggcgagtctgtgccagtagattgtgaagtattccaaggcagtgccacaattaccatcgagcacttgacaggggaagtcaaacctttggaagccaaagttggagatagaattcctggtggttcaaggaacttagatgggaggataattgtggaggtaatgaaaacttggaaggaatcaactctcagcagaattgttcagttaactgaagaagcacagtcaaataaacctaaacttgaaaggtggctggatgaatttggtgaacgttatagccaagttgttgtggtgttatcaattgctattgctgttattgggccatttttatttaagtggccattcgttagtacatccgcttgcagaggttcaatttacagagccttagggcttatggtggcagcatccccttgtgccttggctgtggccccattggcatatgctatagcaatcagttcctgtgccagaaaggggatattactcaaaggtgggcatgttctggatgctcttgcttcttgtcatactattgcatttgacaaaacagggacattgaccactggtggactcgtattcaaggcaattgagcccatttatggtcatcatgttagaaacaacgaatcaaatgttccttcgtgttgcattcccacctgtgaaaaagaagctcttgctgttgcttcagcaatggaaaagggtaccactcaccctattggaagggctgtggttgaccatagtgaaggcaaagacctcccatctgtttctgttgaaagtttcgaatactttcctggtagaggccttactgctactgttaacagcattgagtcaggaactggaggtgctaaactattgaaagcatcacttgggtcaatagatttcatcacctctttatgtcaatctgaagatgagtcagaaaagatcaaggaagctgttaatacatcttcttatggaagtgaatatgttcatgctgccctttcagttaatcagaaggtaacattgattcatctagaggataggccacgtcctggggttgttaatgttattcaagaattgcaagatgaagcaaagttacgtgtgatgatgttaactggtgatcatgagtctagtgcaaggcgagttgcaagtggtgtgggcatcaatgagtttcattgcaacctgaagcctgaagataagctgagtcatgtaaaggatatctcaagagatatggggggaggcttaattatggtcggtgaaggcatcaatgatgccccagcactagctgctgcaactgttgggatagttcttgctcaccgagctagtgcaactgccatcgctgttgccgatgtattgttgcttagagaaagcatttctgcagtgccattttgtattgccaagtctcgccaaacaacttcactgattaaacaaaatgtagctttagcattgacgtccattctcatggcttcccttccatcagttttgggatttctgccattgtggttaacggttcttttacatgaaggtggaaccctgcttgtctgtctcaattccgtacgtgctctgaatgaaccatcttggtcctggaagcatgatatattccatttgattagcgagattaaatctagactcctgtctctcaagacaaatatcacgggctcaaacagtatcataacgacgaatttgtaacgtagtgttgtagtgcatgtattgcatatttatagtgtattgagaaaaaatgtcaatatccttcccttgtatatctgtaggcttcttttaatcccagagaattgaacattcccttctatttgagattagtttccctttccgtaattctc

SEQ ID NO: 408 - DNA, 415 bp, Glycine max
ggtttcactcccatcaacagcaacgatggtgcagaggctcacttatcgcaagcgccatagctatgctaccaaatccaaccagcaccgggttgttaagacccctggtgggaagttggtgtaccagaccactaagaagagagcaagtggacctaagtgccctgtcactggcaagaggatccaagggattccacacttaagacctgctgaatacaagaggtctagattgcctaggaaccgcaggaccgtaaaccgagcctatggaggtgttttatccgggggagctgttagagaaaggattattcgcgctttccttgttgaagagcaaaaaattgtgaaaaaggtattgaagatccagaaggcaaaagaaaagcaggcatcaaagagttaagctgttgagttattcgtgagtgaatag

SEQ ID NO: 409 - DNA, 2660 bp, Glycine max
ttccaatggagcaagggagcacagacactcgtgtggatgcaaacccaagtctttccagtcacgaagaaatacaatctttggatttcgatactgagtgtgagaccaaaatgaccaactctgctggaaatggggcaggaggttcttcctatgttgaagaaggcgtgagaaaaaagcgcggcagaaaaagtaaaaaggagatgggaaagatgttagatgctaccgccatggaaggtggggtttccgagcagagacccagtagaaaaagaaagaaatatgatgaaatggctgaatttgaaatgtctggcactgagaaaaaatatggtcttaggggctgtaaacaagagatggagccaaaagccaacaggagaaaggccaagtgtgatgaagagggccccttaacgtgccatcaatgtaagagaaatgataaaggcagggttgtgaggtgcaaatgctgtaacaagagaagattttgcctattgtgtttacaagcttggtatcctcatttgaaagagaatgatattgctgagaaatgtcctgtgtgccgtggtaattgcaattgcaaagcatgcttgagctgtgatgaacttattaagcaaatgagggagtttgcaaaagctgacaaagaagagaaggttgaactctgtatgtatttgctgcaagtacttcttccatatttacggcagttggatgaagaacagttgattgagaatgagacagaagctaagatacaagccaaagatcactttgcattgaagtctgactgcataagagaaataattatctgttttataatcatggataaaattttcacttttgaactgcctgactgttacgtgttgcaaactatttcttctagttattcccccctcttaccaatgtatgacaactgcaaaacatcaatatttgattaccatagaagctgcacaaaatgctcttttgacctttgtctcatctgttgccgtgagcttcgtggtgggcagcttgtaggtggtgcagatccaatagagttggagtttgtttggcaaggtcgtggttacttgcatgctgaaaaaaaagatgaagaggtaaaacaaaatgcatcagatgatgattgtaagcctgaggttcgtgaatggtcaagatctgggtggctggcacaaagtgatggtagcattccttgtccaaaagtcaatgatgaatgtaaccatggttttcttgaactgagaagcatattgggtcaacattttgtctctgagttagtgtgtaaagcaaaagaactagtgcaagcatacaagcttcaaaatgtagttaagaccgcagacaacttctgttcatgtttgaagcttgatagaaacacagatgttagctatagtaatatgaggaaggctgcttctcgagaagatttgactgacaactatttatactgtcctaaagctgtagatcttcagtacaaggatttaaggcattttcagtggcattgggaaaagggggagcctgtcattgtcagcaatgtgcttgaatgtacatctggtttaagctgggaaccacttgtcatgtggcgtgcattacgtcatgtaactaataccaagcgtggccaacatttggctgagaaaacaattgattgcttagattggactgagggggaaattaatatccaccaattttttactggctatacaaatggtcgtaaggattggcttgcttggccacagatattgaaattaaaagattggcctccttctaatttatttgaggaacaattgcctcgtcattgtgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggacgtggtgattcagtgactaagctccattgtgatatgtctgatgcagtaaatgtgttgactcatattgctgaagtgaaactggattctgatcaacttactatcattgagaagttgaagcaaaagcacctcgagcaagagaaaagggagctacttggtgatgatcaggatggaggaactaatgttgacatgcttaataattcatcttctacaataaatgctttggacaagcaaataaaaataaatcaaggtgatttgttgtttgggggggatgcttcagatggtgctctctgggatatttttcggagacaggatgtccctaagttgcaggaatatctgaagaagcatttcagagagtttaggcatgtccattgctgtcctttaaagcaggttattcatcccatccatgaccagaccttctatctgactatggagcataagaggaagcttaaggaggagtatggaattgagccctggacttttattcagaagttaggagatgctgtttttattccagttggttgtcctcaccaagtcagaaatctgaagtcatgtatcaaggttgcaatggattttgtgtctcctgaaaatgttggggagtgctttcgtttgacggaggaatttcgcacacttccaattaatcacaggtctactgaggacaaattggaggtgaagaaaatgacaatatatgcaatggaagatgtgattggaaagttggagaaagcaaggtccgggttaaccaagggtccagagtaataa

SEQ ID NO: 410 - DNA, 2198 bp, Glycine max
ctccgatgatttccgaaccggcgagttccctgagaaagagcaacttccaagaccggcgcctcagcatcatcgacgtttcctccgccgacgattcgcttctcgatggaaaccctctcagccaccaacgttcagagaaccaagagcaggccgatgtgttgtacacgccgaactcgaagaagttcgaagacgccgccaccaaactccaacaatgggaccacgagcctcactccaacgactcatccggaatcggaaaacctaagaaaaacagcaaatgcaatctgcgcaagagtttagcctgggacagtgcctttttcaccagcgccggggttttggatccggaggagttgactattataattgaaggtgttgagaaggatgagaagcctgaattaccgtctattcaagaggatgtgtacaagtcgtgtgagtccatttctacgttagcgagtgatagcttgacctttgaaagtgtggagatggagggtgatttatttgaggatgtaagagcttcaattcagaaatctagcaaaaagtccagccctgcagcgtcaaacatcaaagtgccatcttccccttcggttccattgttccaaactcatgactcttcgaaaaaggttggcatggtttcttgcaataagatgaaggtcccacctgcttctaagaatccaagtgctggcatgcaaggatttgggaaaatgacgaagaagaataatcctattttcccccaaattccacagaagcatgtggctacaaggagagagtcatctattttaatgcaatcaaaggtacccggaaggtctagtttaagttccacaattccatccaagagagattcacttggcaatccacatgtcaaaagtgaaagggacaaggcaaaacgaatagttggtgatagagtcagttcagtggcaaaagcatctgttgttagaggttctcgaggttctgtgcctaagcccacactaccatccaaatcaccttctggtccgacagtatcaaccaggactaaatcagtgacttccacatcttctgttgtcaaaacaccttcaagggttgcttcaagaaataaagctgaacctgagatttctagtctttcaaggttgatgtctgccacaaagctttcttctagtatttcgcccgctagctctatcagtgactggtcttcatcagagtcatcctcaacaacttctatggctaaacgtgtgtgtaatagttcaaggcccagcattgattgtgggtcaagcagaaaggttttattgaacactgatgcagatcaaggtacacaccctcagactcctctgagtgattcaagcttagaaaggcaagaggctcggcaaagtgggattattagtcagaaggaaaggacagtgcctggagcgacagttcttcctccagtttccaagaaaccttcaggccttcgactgccttcaccaaagattggttattttgatggggtgaagcccttagtgcgcactccacgtgggtctgttgtacctggtggcttgccaaaacatggagctgaaagtccaagagaaggccaaaacaaagcagaacttggaaagctgcaaccatccagatcttttgtttcaattgataatacaaaacccaacaaccagcaacctccacatccaaatccttttcatgaatcattagatgttgcaattaagacatctaatagcgtgcagaatggcaaaagctcttccgacatatccattggtgctgttgaaaatacatcacacttccatgtagtggagaaagctcatcatgatttgccaccacttaagggtgtcaataaccaggaaaatgctcatcatgatgatcaaattgattgtttgagcaaacaagttggacatatggacataaattttgagataggggaaaagtttaatagtgattccctttatttattgcagaatgatatcagcttccaagataaatccaatggtctggatttatctagtcacaaagagcttattgattgtcctaagaaagacgaattatttaatggtttatctactacatacctttatgtctccccaaccagctttgatgtggtagcttcaacaaggagaccctttgcggtcaaagattccttttgtaacatggatggtgttgtctttacagattcaacagtttcagaggctaaatcgaccaacttgcctgtgccggagagcattattatgaaagaaaacgagtgatga

SEQ ID NO: 411 - DNA, 2289 bp, Glycine max
aacagagtaatggtggtgaagatgatgaggtggcggccctggccgcctctcctctcgaagaagttccaagtgaggctgcacgtgcggaggctccagggctgcgatctgctgcagaacgctgcactccaaggttcaagattggtccttgagattcgctggaagggtcctaagttgatccttggctctctgcgatggaactccgtcgccagaaattttactaaagaggcggactttgaactcgacggcggtggcgccgccgtcgttcactgggacgaggagtttcagactatgtgcaatttgaacggttacagagacaatgtctttcacccttgggagatcgctttcactctctttaatggattgaaccagaggccaaaaaacaaggttcctgcaattggaaccgcattattaaatattgctgaatttgcatcttcaactgatcaaaaggattttgatttaaacattccactcacactaaccggaggttctggggagccttctcctttactctgtatatcaataagtttgatggagctaagcgtagctcaagaaagcttggagccagttcagagatctatagtgcctgtgccatcgccctctgccaagtcgggagaaacagccttggcagaaaaagatgagctttctgcaattaaagctggtcttaggaaagtaatgattttgacggagtttgtatctcccaagaaagcaaaaaagggttgtcgtgaggaagaaggcagtgaaggaaggtgctctaggagtgaggatggtgaatacaattatcctttggattctgagtcacttgatgattctgaggaaggtgaaacagatggggggaaggaggattccagtgttaggaagtcattcagttatggaacactggcttctgcaaatgctgggggattttttcattccaatgcgagagtaaattgtaatgatgaagactgggtttattacagccatcgcaagtctgatgttgggtgttcacagagggaggattctactgcttcttcttctcagccttatttagtacaaagttccaagcgcagcatacttccatggaggaagaggaagttgagtttcagatctcctaaagcttataagggagagccattgttaaagaaggtgtatgcagaagaaggtggtgatgacatagactttgatcgccgtcaacttagctctgatgaatccctttctttgacttggtacaagattgaggatgacacgtctgcacatcgatcatcaatctctgatttcggggatgacagttttgctgtagggagttgggagcagaaagaagtcacgagtcgtgatggtcatatgaagcttcagacacaggtcttctttgcttcaattgatcaacgcagtgaacgtgcagcaggtgagagtgcatgtacagctcttgttgctgtgattgctgactggttccaaaataattgtgatcttatgcccataaaatcacagttagatagtctaattagagaaggctcctcagaatggaggaacttatgtgaaaatgatgcctacagagagcggttccctgacaagcattttgacctggaaacagtcattcaagcaaaaatacgtccgcttactgtggctcctgggaagtcctttattggtttttttcatcctgaagggatggatgaaggcagatttgactttctgcatggtgccatgtcttttgataatatttgggatgagattagtcgtgctggacaagagtgccccagcaatggtgaacctcacatttatattgttagttggaatgatcattttttcatccttaaagttgaatatgattgttattacatcattgacactttgggagagagactttatgaagggtgcaaccaggcatatatcttgaaatttgacagcaacacaatgatgtacaaaacgccaaatgttgctcattcatcagacgacaagacatccaatgaccagcaaactgtagcagaaatattagatcctaataatagtcaaacccaacaagtaaatagcaaggaggtggattctgttgcaggggaaaaagaacagttgaggactgagcaagaagaacaagttatatgcagagggaaggaagcatgcaaagagtacattaaaagcttcctagctgcaatccctatcagagaattggaagcagatgccaagaaaggtctcatttcttcagcatccctttaccatagactgctacaaattgagtttcactacacccaactgttaggtgaaacatcaccaatggctgaactaagagaccttagctcttgcaataactaaggcttctactaa

SEQ ID NO: 412 - DNA, 1763 bp, Glycine max
cgatattcgacaagctcaagcaagcatgcacctcaagctctcacctttgaagccccaaattttaaaagatataactggcctgacagaaactgagaggatgaaacgtaatagtgtttatccctctgcacttaactgtgatgacatcttgcatgagatcctacttcgaataccaccaccaactatctccaaattaattatcgtatcaaaaatatggttgcgtgtgatatgcagtccttcatttcgtcaatgctacttgaggcaatggggacaaagttttcgacttttgggtttttttgtttgcaactttttatatcttggaagacctcgtgatggctatcgtcgccctcgttgggagcctgcgctcccaatcttgtccacttgcaaagatggtgatgatttgaaactttctggaatcctcaaacatcttgggtacttcattgatagttccaaaggaattattctttctggtttccatccaaagacatattatgtgtacaatactgtgaccaagcaaaagtatgaactcccagaacctcagcagttctataaagttctgtgcatggcattgattgttgaggaatatcttgatagtgacatatgctacaaggtgatccgtgcaagatgtgaatgcaaacttaaggaacgcaacactgtctcaattgagacttattcatcaaaaactagacaatggaagcaatccactctgatgtgctccacaacttttgcattgtgcccaaggacggcagctatggtggttggaggggttgtacactggtttgcaatgtggggaaaacttgccatttatgatcctcgtcttggagacaggtatatagccttgattaaactaccaacaggtgtgttaacacatgagcatgaggaatctgttcttggggagtcatctgatgggcttttgcagtatggccagagcaataatttgggcctggagatatggatacttgagaaggaatcaggagccaactcatctatttactgcaactgcactcatctgaagtacaagtggattctgaggtggagattaaactttaaagtattatggaagcagatgccgtctttaagcacacattctaaagaaacccagatattgtcattccttcctcagaattctacttctatcttcattaggtcggggtggaatattttgctgtgtgatttggagaccaaaacggtggaaattgtcaattatcagggtcgtggaggaaccatttcatgggaatctagcaaagtagttccttactttctaccagcttggccacacacttcctcggtgtcggtgtcatgacaacatggaacaagggaaaacttgtcgtttttcaatctagaggcacttggtcttttccattctgtttttgatctggatatgatgaaaattaagggtctgttttattttctgtgttcacttttaattacaatcttgttttcaatctaaaagttgttttcactagtttctattcaaatctttgaaaacaggaaatagattgaaaacaaggtataattaaaagtaaaaaccaaaaacattttgtcaaagtaaacggaccctaagcttttagcttctttgttctgttttgaatagccatagtattagtaggaccttcatttctcttacagtttcagtggtgtactgtacatgcctagaggttgctgtgttatcaaaacactgaaaaatattactcttctgattactttctctttagtcttttcgtagaagaattcagaattgcagcctgatacagtcacaacaagct

SEQ ID NO: 413 - DNA, 1183 bp, Glycine max
caataactagaaatctagaatggctttgaagcttgtaaatctagggtttcactcatcgattccgtgttctccgaggcccttgaaagatcggttcgtgcttcggtcttctaaagtggagcaaatatcgtttacggaatctgagaactcactcatcgaagcccttcttggcatccaaggacgcggacgttcttcttctcgtcagcagctcaatgctgttgagcgtgctgttcaagtcctggagcggttagggggtgtacctgatccgacaaaatcaaacttgatcgagggtcgctggcagctaattttcaccacaagaccaggaactgcatcgcccattcaggcagcagcatcaattgaagatggaaaaagaatcctttttaggtttgacagagctgccttttcttttaaatttcttccattcaaagttccgtatccagttccatttaggctgctgggagatgaagcaaagggttggttagacaccacatatttgtcgagttcaggaaaccttcgtatctcaagaggaaataagggaaccacatttgtgttacagaagcaaactgagcctaggcaaaggttattgacagctatttcctcggggaagggcattaaagaggcaatagatgaacttatttccttaaagcagaatactggtcaagaagatccagaactagaagagggtgagtggcagatgatgtggaattcacagactgtgacggatagttggatagagaatgctgtcaatgggctgatgggcaagcagattatcaggaagaatggaagaataaagtttctggttgatatcttgcttgggcttaagttctccatgagtggaaattttgtaaaaactggctccggagtgtatggcgttacaatggatgatgcagccataattggtggcccattcggatatcccttagaactgaaaaacaacttcatattggagcttctatacagtgacgagaagctcagagttagccggggaaacaacagtattcttttcgtacatgttcgtaccgatgcattgaggtgacctagtacatatgtgattgtttagaagaatagacgaaacctttgcgagtgacaattttaaatttgtgttcaattgggtatttaactgtacgacaatgcaaactaaatataaacataacatggacgtactacttgttcagcttccatttca

SEQ ID NO: 414 - DNA, 1410 bp, Glycine max
gtaacagcaggtttgggaggcttttggggtagccggcgagacacagtggattccttaattctccatggatatggggaagaaagaaggtgaagcccccgtgttgtggttcgaaacctctgactctgtctgttgccaacaccagtttgaacccgatggtcgactctccgtagtgattgttgatgattccaggcccctataccaaaggatggctggatctttcatgaataaatttttcccctcaggatatccgtacagtgtgaatgaaggctatcttagatacacgcagtttcgagctttgcaacatgttaccagtgcagcactatcggtgctatcaactcagtccttgctattcgctgcagggttgcggcccactcctgcgcaagcaactgctgttagttggattttaaaggatggaatgcaacatgtagggaagctaatatgtagcaattggggtgctagaatggattctgaacctaaacgttggagactactagctgatgtgctctatgatataggcattggcttggaagtgctttctccattatgcccgcatctttttcttgaaatggcaggcttaggaaattttgcaaaggggatggctgttgttgcagcaagagcaacaaggttgcctatatattcttcatttgctaaagaaggaaatctcagcgacctatttgctaaaggagaggctttttcaactctctttaatgttgttggaattggagtaggaattcaattagcatctaccatttgtgcatcaatacagggaaagttggttgcgggtcctctcctttcaattatacatttatacagtgtgtctgaagaaatgagagcaactcctatcaatacgttgaatccacgaagaactgcaatggttgtggctgattttctcaaggcaggaattgtatcgagccctgctgatttgagatatcgagataatctgctgttcaatgtgcaagtcaaagaagacactggaaacgtaagagtggggaagaatgtgcacaaggtcattaagccttccaggcttcttgaattaaaacaagtgttccccgaggagaaatttctcttaaattttgggaataaatgcattgacatggtattggaacaagatgctagtggtgaagatgcactgagagggtggctagttgctgcatatgctgcacgaactgagagttcctctcatgagctcagtgctactagtgtcctgcatgaggcttatgagaaaatgaatggtgtctttcctgtattcttaagggaattacagaacaaagggtggcacactgatcggtttttggatggaactgggagccgtttttcattctagtgcttgtataaatttaatgttgctttaaataggttttatccattctctgagaattttttatgagctatgggtggagtaaatccaat

SEQ ID NO: 415 - DNA, 826 bp, Glycine max
ctctctacactctattcaacccttcacattttctctcttctttatcttaaattacttttccatggaggaaagcaagaaacgagtccgggacgagtccagctactcacccgagtcccaaactcagctggtcgactctcccgagtctgaaagtcagcgggtcgactcacctgagtctaagattcgtcgagttgactcgtccgagtctcaactcgactcggtccttgactcggaggtgcgtctacaagacgacatttttaacatacttgacgacgccgataatgtgcctgagcgtgactcggtgcagggtcttgactcagtgatcaaaagcttcgaagatgagataaacgctcctggttcggattctggttcgggtgacccgacccaggaaccagactctggggagctacaatctaacttggggtatcttctagaagcctctgacgacgaactggggttgccgccgacggttgttgacggtgaggaaacgggtcgggttggtccggaaatgacggagcttgccaggttaatgggttttgaagatgatatacccagttatgatgcattcgggtttgggtcagggtttgcggcggagagtgacggcggcgccggaggttttgtgacggtggatgggttgtttgactattcggacccggcggcggatgttttgtggcggtcggagtcattacaagctatgtaggtgaccgcggcgagattttgcgatggttttggcagaagggtgcgtaggggtggaaaatgtaaatctaggaaaatattggggttaaaataggaggaggaaaaaaaagggtagggtagcatagaaacgtgg

SEQ ID NO: 416 - DNA, 799 bp, Helianthus annuus
gttgacccgaccacttattccactgcagcaatgtctggcccagagtgctgccaaaacccaccggcgccctcctccggcggagaatccggtgatcttttacaaatcgcatctctcaattcctatgtttccggcaaccctgattccaaagtcgccgttattcttatttccgatgtttatggttatggagctccgaaactgaggcaacttgcagacaaagttgcagctgctggatattatgtagttgttcctgatttcttctatggcgacccgttgactcccggaaccaacatagaagattggctaaaaaaccatgcacccgagcaagcggttgattttgctaaacgagttatacaggctctgaaagagaagggtgtaactaaaattggggctgcgggtttttgttggggcgctaaagtggttgtggagctagcaaaggacggtgaaatacaatttgctgcactcttgcatccttcgtttgtcactttagatgatatcaagggggttaagatcccgatagggatactaggtgccgagatcgacaaacgatctccaccagaactcgtcaaagaattcgaggctgcactagtcgcaaatgaggttaataactttgtaaaaatatatcctggtgtcgcacatggttggaccgttagatataaagacgaggatgcagcagaagtgaaatgtgcagaagaggctcatcaggatcttgtggattggtttgggaagtgtcgtcattagacatatgattaaatctgttaaaccctaatcaatcatatgtaataaaggagggatttggatg

SEQ ID NO: 417 - DNA, 2465 bp, Solanum lycopersicum
gaggatttgaagcagagatagctagctttggttcctttattttgatggacccttattcctcaggggaggaacttgttgttaagacaaggaaaccttatacaatcactaagcaacgagagcgatggacggaggaggagcacaataggttcctagaagctttgaaactttatgggcgtgcttggcagcgcatagaagaacacataggaactaaaactgctgtgcagatcagaagtcatgcgcaaaagttttttacaaagttagaaaaggaggctcttacaaagggggtcccaacaagtcaagcacttgacattgaaattcctcctccacgacctaaaaggaaaccaagtaatccttatcctcgtaagacaagcgcagcaggtcactcatcacaggtgggagcaaaagatgggaaatattcgacaactttttcttccatctgtgaggaaaggaacttatttgacctggagaaagaaccgattactgagaaacctggcggaaacgagaagctgggcaatgtaaaagaaacccagaacaagaaaaactgctcccaagggttaactaaggaaggtgcttctgcagcctctatgtcttcaggaaagtccttgcaagcacatgtggcacctacagatgtgtgtgcctttagtgagtctgtgtctgtcaccaaaggagtggttaacaatgataacgcaaataaatcttttctcattgttgaatccaaagaacatcaacagtcagaaatactcgatatcagacagtcctttcaaggtaacagctcctgtaacacctttgacggggggaaatcttgccagtcgagtgaaaagttggcacaaggtgagaaaaaacatccatcgtttcagccaaaccatttgggggaattctcaagaaatgatatgcaagtgctacacaactatccaagacatgtgccagtgcatattcttgatggaacaaatggttctcaaatagccccagatatgtttaatcatgaatctacgagtcagcagataaatggggtcccggggctcccaaatttgtattctaaccctgcttcatccaccacatctgagcaccacagtaacgctccacagtcatccattcatcagtcattttcttgtttccaccccattttcacccctattcgtgatccagatgattaccgatcgttttttcaattatcctccaccttctccagccttattgtttctgctttattgcaaaacccagcagcacatgtcgcagcaagttttgccgctagcttttggccttatgcaaatatggaacgtccaacggattctccaactgataacaccgctagccagattaactcagctcctagtatggcagcaattgctgctgccacagtagcagctgcaactgcatggtgggcagcccatgggctcttaccattgtgctctcaatttcaaagcagttttacctgtgttcctacatcagcaacatcaatgcaagtggatgcctgtcaacctagagtagacaagaacgaaggaagagagggaactcatgattctccccatgttcaggaacctgtcccagaatgctctgaagctttgcaagaacaacaatcaggttctaagttgccaccttctctatcatcagaatcggaggagagtgaaggtaggaagctaaaaactgggttaacggccactgatactgagcaaggagctgcagttactaaaattaatgagccaaacgcagaaaagggcgggaagcaggtagatcgctcttcctgtggatccaacacaccttcaagtagtgaaattgagacagatgctttggagaaggatgagaaaggtaaagaagagccccaagaatctaatattaaccttctagctggagaggctgcgaatcggcgttatagaaatttcatcagtccaaccgaatcttggaaagaagtctccgaagagggacggatagctttccaggctcttttcaccagagaagtgttgcctcaaagtttttctccttcacttgatctgaaaaataagggaaagatcattcttgaaaagttgaagcaaaagccagacgagaaagttcaatgtggaccgcagttagatcttaatgatatggcatccaatatctgttccagtcaccaaacaatggaagacaatgtgttattaattggcaacaaagaagatgtagaaacatgcctaccaatgatagaacttggacaagtaaggttgaaagctcgccgtactggatttaagccttacaagaggtgctcattggaggcaaatgatagcagggtgacaagttctaactgtcaggatgaagaaaaaagctcgaaaagacttcggttggaaggagaagcttctacttagtgttgtatcaatgtgcaattctacgagggaacctgtgttgttgcacggagagctctattctatcctgttattatcttttcccagttacgttgtctagttctaatgtacacgaaacttgtcgtgtaggtgtgt

SEQ ID NO: 418 - DNA, 2190 bp, Solanum lycopersicum
gcatgagcaatttgtgtttaagttaataaattgaggaacttgatgattgatcactaataatattagatggaagaaacttctctcgatagtgagcaaaatgttgctgggcaaggcagtgggagatttcaagaaatagagtcagatgatcagaacagtgagaaaattgagtcagatgaattatttgtacaaaatggtgtgcaaatagaggcaaatggtttagatgatcacaattgtgttactgaggatgggcagaaggaatttgttgccccagcagttggaatggagtttgaatcgtatgatgatgcttataactattataattgttattccagggaggttggttttcgtgttagggtaaaaaattcttggttcaaaagaaatagcagggagaagtatggtgcagtactatgctgtagtagtcagggtttcaagaggattaaagatgtaaaccggctgcgcaaggaaactagaactggttgtcctgcaatgatgaggatgagaatggtggactctaaaagatggagagtactcgaagttactcttgaacacaatcattccttaggtacaaaagcatacaagactatcatgaaaacaggtactggaaacaagaagaagttggattcaaactgtaacgctgaagtgcaaacgattaagttataccgggcactagtgattgatgcaggtgcaactaggaatgccaattttagtgcaaggaggtgccaaacttcatctgattgccatgataagctgaacttaagaaaaggagacacacaagccatgtataattatttctgccgcatgcaattgacaaatccaaacttcttttacttgatggatctgaacgatgaagggcagttgaggaacgtgttctggattgatgccaggtcaagggcggcatatgcttactttgttgatgtgatctatatcgataattcatatttgtccaacaaatatgagatccctcttgtggcatttgtgggaacaaatcaccatggtcaatcaatgttgctgggctgtggcctgcttgctggtgagactaaggcctcttatgtttggatgtttaaagcttggctcacctgctctcttggacgtttccctcaaacaattattacagaaaggtgcaaggttttggagactgcaattcatgaggtattcccgaggtctcttcatcgttttgctttatcacacatcctgaggaaagttccagaaaagttgggaggattgcgtaactatgatgttattcggaaggcattgtttaaaacaatatatgagggtctaaagccatttgattttgaagcagcatggagagttatgatccaaagatctggagtgggtgatcacgagtggctttgttcattgtacaatgaccgagctaaatgggctccagtttatctgaaagatactttctttgctggaatggccactgccagatccaatgaaacattgactgctttttttgacaaatatgtgcacaagcaaacgcctctaaaagagtttcttgacaaatatgaattagctttacagaaaaagttcaaggaagaagctcttgcagatatggagtcgagaagctcaaaccctgaactcaaaacaaggtgttcgtttgagctgcagctttcaaaagtgtacactagagagatctttaaaagatttcagttagaggtagaagagatgtattcttgttttagtacaacaaagttacatgttgatgggcaggtggtaatatttttggtgaaggagcgtgttttggaagaggggaataggagagagatacgggactatgaagttctgtacaacagagaagcagcagaagttcgttgcatttgtagctgcttcaacttctatggatatttgtgcaggcacgcattgtgtgtgctgaacttcaatggtgtggaagagatcccgtcaaagtacattttatcacggtggaaaaaggattacaaaaggttatgtgcattagatgttgaatctagttttaccgagtccactgaacaggttcaatggtatagccagttgtatataagtgcattacaagttgtggaagaaggggtgatttccctagatcattataaagtagccctaaatgcatttgaagagtctctgtccagagttcaccacattgaagaaaaaaccaaataaaaatttgttgtatttagcatatctactatctgttcttgttatcgaagggtgtag

SEQ ID NO: 419 - DNA, 1395 bp, Solanum lycopersicum
acagaaacgagacccattattctaaagaatgatcgcttcaactgtgcgaaagcccctctttggcgttactctattcaccttatctctctttctcattctcttcttcttcgcacctttttctttcttctccgacccttcggttaccttcaattcttcacggcgtgcaagacccgagatatggagcatacgaagattagctgagtggcgaccttgcaattggtggctccaaccaccaactaatgctcttcctgctaaagctaatgggtatattcgagtggattgctatggtgggctcaatcagatgaggagagatttgtgtgatggtgttggaatagctcgtttgctgaatgctactcttgttttgccgaagtttgaagtagctgcatactggaacgagtcgagtggttttgaagatgtatttgatgtagacttcttcatccaacaaatgaagggctttgttaatgtggtaaaagagcttccaattgagattgcaacaaaagatcctgttagagttgattgcagcaaacgcaaaggccaatttgactatgttgagagtgttcttccttccctgctgaagcatggatatatctcgatcacccctgcaatgagtcaaagaagggataggtaccctctttatgcaaaagcagcactttgccagggttgttatagtgcgttgcgccttacaagcacattggagaagaaagcacttgagcttctagaagctataccaaaacccttcttatcgcttcaccttcgctttgaacctgacatggtagcttatagtcaatgcgagtactctggtctttctcttgcttctgcaaaagccatagatgctgcacgggttgacaggaaaccttggactggggaaacagctcgtatttggagaaaccgtggaaagtgtccacttacccccaatgaaactgcattcgtacttgaagctttagccatacccaccaatacgacaatttatttggcagctggtgatggcctgatggaacttgagggacttacatctgtgtatacccatgttgttactaaatctagtcttcttagcggagaggacttcacaaccatgcatgggaatacaaaagctgcactggattattatgtgtctattaacagcgattcttacatggctacttattttgggaacatggataagatggttgcagcaatgcgagctttcagggggttgtataagacaattttcttgaataggaaagcctttgcattgcttacctctcaagggtttaaagggaaggaactaacagaagccctgtggaaggttcatagagatgattttataatgggtagaggatctgccttacctgactgtttttgtgaattcaatgtatgaacttatgttttcctcttcagtttattcgttacttgatg

SEQ ID NO: 420 - DNA, 595 bp, Solanum lycopersicum
aacagagagacgattcaatttgcagagatgaacggcgctatgaatatgcacggagatatggcgccgccggtaccacatgccgccgtgaacaaccacaacatgatgatgcacatgacgtttttctggggaaaaaacgctgaaattctcttctccggttggccgggatacgacaacatcggtatgtacgttttcgcacttatcgtcgtttttctacttgctttcttcgtcgagttgctatcgcactcaaattacatcaaagagagtgcaaatcatgtgacggccgggttgattcaaacggcgttgtacggagttagaattggtttggcttatctggttatgctttctgttatgtccttcaatggcggaatttttctggcggcgatttccggtcatacgttagggtttttggttttcgggagtagagtttttaagaaatcgccgttgacggcttatgctaaagcctccgatcttccttctatgccttgtaattgttaatgaaaattgaaagctttaaaatcgaatcgtaatcgataattcaaaataaaaaaatgttaattgaattatagatatcgaaacctcaactcaattatcgagg

SEQ ID NO: 421 - DNA, 2351 bp, Solanum lycopersicum
aaactcgagtactgtgcttctcaccattagcgttttacatcgcctccatcaaacttggctgtgtgtttttataggattaattagatgggcaagctagggaagaaagcgaggaagtttgccaagaagaatcttccgtcagtgcttcgagatcgccggaagaagaaagctttattcaaaaagagatattcatccaaaaatgtgcagagtaatgttgaagaccaagccaaagtaatagaccactctaatgaaagaaacaccgaagttgaagcttttgaagacttgcctcttgaggcaccattcatggaaaatgattgtgatggtgttgttgattcttcagacagtgatggatatctttcggaggatataagctatgaaaatggaacagaaagtgaacctgaaaaacttttagaaggtgacaaatgtactagtgaattgatgatgcagaacataaaaattcaagaaaatcttgctgtacaaaagagaaagctagaaaggttgaagaggaaggatccaagtttctcaaagttcttagaaaagcacaaggacattgaagcaatgcaaaatggagtagtgttctcagatgaggatgagatgagtaatcatggaagagactcggcgactgaagacaaccaaggtaaagacgagggaagagttttgacagtatctgccattagttcttggtgtcgactgatcaaagaagagcacaaggaggaagtatttgtttgtttattaaatgcttatcgagctgcatgccactatggtgctgaatccattggcctaaggtttcagaatgctgagacattctgcagcttagtaatgtctgttctttccgaagcagataatatacttcggggacttttggggctatcatccttcagttacaagaaagaagcagtactagaactgaaggataccccacaatgggttaatgtgaaacctctcatcaaatcatacttgagaagtacattatctctgttggatcaggttactgattcagaaattctggctttcgctttgactcggctcagggattctttaccattctttgatgcttttccatatctcttgcagaggcttattaagacgacaatacatttgtgggctacaggtggtgggatgctatcatcatcatctttttcgatattactggatgtggcctctctatttacaactgattggtttgacaattgcttagcaaaagcttttgtggcttatcttgctcagtcgagagctacggatattgtcaataacaagcatttgcagttcttaagaaattccttagttgacttatgctccctagatgttcaaaaatcattgtctaaagccaccgtgtctgtccgtcagcttgcaaaagtattacagtggggtttgcgtacaaagaaaaaggaagctcttcaaaggatctgcagttgggagtatgccaattgtataaatctctgggttggttttatagcacgcaatgtacgggattatgatcttcaggcctttttcttcactatggttcaacttataaatggagtggtgcgcctgtttcctggaccgagatatttccctttaagactcaattgcattcaatggcttaatgatctgtctaattctactggagttttcatccctattgcttcatttgtattggatgttttggaatataaaacagtcggagagcgtggaaaacctggacctgctctcttctttcagtctgttctaaagttgccaaagagttgcttgaagtctcagacattccaagatgaatgcattacatctgcaattgaacaactatcatcacactttttacaatggagctaccacatttctttccctgatctagcaactgttccactcatccgtctgaaaaagtttaatgagtcaaagacaaaagaaagtcaatgtcgtgtggtaaaacatttgattgagcaggtggagaaaaatgttgattctgtgcaaaagaaaagaaatgaggttgccttttcaccaaatgatcatcaatctgttgaaacattccttcagtttgagaagtccagtctcagttctccatttactcagtactgcagaagtgtacttgacaaggctgatctgaggggctcacataagaacgaaaagattagtttgccaacacgagataaatcaaagcgtaaaagagatgacagttcgattaacgtttttggccacaaggatgtggatactgttaatggatcaaagaagcgggtcaaaagatgagctccgaaagcataattgtcgtaccatttttttgtttgctataggttttgataattttctgattggccttaccagtttggaaattttgagctgggtaaacatgtgataattctttaggttggtaagaattcttt

SEQ ID NO: 422 - DNA, 1045 bp, Solanum lycopersicum
ggcacaaaccagaagagttgttgattagatcaaaaataaaaataaaaatggtggaattaaagtttcttggaatggactttggttgtgcacttggatctctaagtaatggtcaattcccagaaaaagattgtttgcttcccttaatttcaaagcttcttggttatgcaattgttgctgcctccaccactgttaaacttcctcagatacttaaaattttgcaacacaaaagtgttagagggcttagtgttgtggccttcgaactcgaactaatcggttacaccattgctttgtcatattgtcttcacaaagggttaccgttttcagcttttggcgagtacctttttcttttgatccaagctataattttggttgcaattatctactatttttctcaacctttgggaatgaagacatggatgaaaggcttattatattgtgctgtagccccaactgttttggcaggtcaaattaatcctgttcttttcgaggccttatatgcttcccaacatgcaatctttctttgtgcaaggattccgcagatatggaagaactttaagggcaaaagtactggtgaactgagctttttgaccttcttcatgaacttcgccggttccatggttagagtttttaccagcctccaggaaaaagctcccatgagtgttgccttgggatctgtgatcggtgtactgatgaacggtaccatcttgagtcaaattatcatataccaaaagccaacacctccgaaagggaagaagaaagattagaaagtttcagcacgccgtgctgcacctggagctccatgatcgtcgagcacataattcatccatatactatataccctgagaatctgtcatagttttcgcttattttcaaattttagattgatccatcagttccagaatttcattttaacatttaccatagtctcagtatggtatttctttttttttttttaaacctaaagtatgttaacaacagttgttacaatttctttttggtaaaaacatcctcattaggggacttcttgtgttgaagtcaccaattt

SEQ ID NO: 423 - DNA, 1525 bp, Solanum lycopersicum
actattttgcctatttctgatctgaaatttcagattttccggcgagaaaatggcgacggatatggaggtgcagcagaacgggaaggagacggtggcggtggttaatgggtgttgcaaaaaaggacctggttatgcttctccacttgcagccatggatggtcctaaagaatctttaatttatgtcacctgcatatatactggaatgggaaggggcaaacccgactatctggctacagtagatgtagatcctaattcaccatcttattcaaaagtgatccacaggctgcctatgccttatgagggtgatgaacttcatcattctggatggaattcctgcagttcttgttatggagatccatcagctgctcgacgatatctcgtcctgccttcactaatatcaggacgcatttatgcagttgacacacaaaaggatccaaaggctcccagtttgtataaagttgttcagccagatgatgtcgtcaagaagacaggattagcattcccgcacactgctcactgccttgcttctggtgagataatgttgtcatgtctcggagataaagatggaaatgctgaggggaatggatttcttcttctcgattcagatttcaacgtgaaaggaagatgggagaaaccaggtcatggtcccctctttggctatgacttctggtaccagcctcgacacaacaccatgatcagttccacctggggagctccatctgctttcaccaaaggtttcaacctgcaggatgttgctgatgggcattatggtcgacatttgcatgtctacacatggcccggtggtgaacttaaacagacattggatcttgggaacactgggctccttcctctagagataaggttcttgcataatccatctgaagcaattgggtatgtgggctgtgctttgaccagtaacatggtgcgatttttcaagaatccagatgactcgtggggacatgaggtagctatctcagtaaaaccagtgaaagtgcagaactggattcttcctgaaatgcctggtcttattactgattttctgatctctctcgatgatcgttttctatacctggcaaactggctacatggtgacattcgacagtacaatattgaggaccctgccaatcctaagttaactggccaagtatttgttggaggagtatttcaaaaaggaaacgctgtactcgctgaggctgaagatggttccacataccaggttgatgtcccagaagtccagggacatcggttgagaggagggcctcagatgatacaactgagtctagacggaaaacgtttgtatgtcacaaactcattgttcagtacatgggaccgtcaattctaccccgaaatgatagagaaaggaggtcacatgttacaaatcgacgttgacagtgagaaaggtggacttgctattaacccaagatttttcgttgatttcggagctgaacctgatggtccatctttggctcatgaaatgaggtatcctggtggtgactgcacttctgatatttggatatgagtgtga

SEQ ID NO: 424 - DNA, 3043 bp, Solanum lycopersicum
cattccacgttcttcgctccaccgtgaaaaacccgtctccggcgccaaatcatgtccggcaaatcccgaaacttccgccgtcgtggcggtgacgacggcgacgatgatgaaaccgccactaagtccaccaacggtaccgctgctaaacctacgaccaccgcttccgcttccgccgccaaacccaaaaagaaaagtctacttagtttcgccgacgacgaagagtccgacgatactcccttcgttcggccttcctccaaaccctcatctgcttcttcgcgaatcacgaaaccctcttcgtcatcttctgcgcacaagcttacttctggaaaagaccgaattacccctaaacctacttcattcacctccaatgtacaacctcaagctgggacttacaccaaggaagctctccttgagctccagaagaacactagaaccttagttggttctcgctcttcccaacccaaaccagaacccaggcctgggcccgttgagccagttatagttttgaaagggcttgtgaaaccgccatttagtgtgagtgcccaaactcagcaaaatgggaaagagagtgaagatgacgaaatggatgttgatcaatttggtggtactgttaataggttgggttcaatggcattggagaaggattcgaggaagaaagatgatgttgggtcagtaatacctgataagatgactattgatgcaataagggctaagagggagaggctacgtcaagctaggcctgcggctcaggactttatagcattggatgaaggaggtaatcatggtgaagctgaggggttgagtgatgaggagccggagtttcagcagagaattgggttctatggggagaagattggtagtgggagaaagggtgtgtttgaggattttgacgataaggcactgcagaaagatggtggatttcgtagcgatgatgatgaggaagatgaggaggacaaaatgtgggaggaagagcaggttagaaaggggttaggaaaaaggttggatgatgggtctaacagaggggtgatgagtagtgttgtaagcagtgcagctgcagttcagaatgctcagaaggcgaattttggaagttcagccgtaggagctagtgtatattcctcagtacaaagtattgatgtttctgatggtcctactattagaggaggagtggttggaggcttgcccagtttggatgcattatcaatttctaagaaggctgaggttgctaagaaagccttgtatgagagcatgggaagactcaaagaatcccatggccgaactgtgacatcattgcacaagactgaagaaaatttgtctgcctcattgtcgaaagtcactacactggaaaattctttgtctgctgctggtgagaagtacatgtttatgcaaaagcttcgcgactttgtttctgttatttgtgcgcttttgcaggataaaggtccttacattgaggaacttgaagaccagatgcagaaactttatgaagaacgagcagccgctatcttagaaaggagagctgctgataatgatgatgagatgaaggaacttgaagctgctgtaagtgctgcaagacaagttctaagcagaggtgggagcaatgcagcaacaatagaagctgccacagctgctgctcagacgtcaacagcagcaatgaggaaaggaggagacttacctgtagagctagatgaatttggtagagataagaacctgcagaaacggatggatacaacaagaagggcagaggctcggaagcgaaggagaatgaaaaatgatgttaaaagaatgtcagctataaaatgtgatagctcttatcagaaaatagaaggagaatctagcaccgacgaaagtgactctgagagtacggcatatcaatcaaaccgtgatcaattgcttcaggtttccgagcagatttttggtgatgcacacgaggaatactctcaactgtctgtggttgttgaaaagtttgacagatggaagaaagattatgcctcaagctatcgtgatgcgtatatgtcacttagtatacctgttattttttcaccctatgtgagactagagcttctgaagtgggatccactgcatgaaaacacagattttatggatatgaattggcacaattctctattcagttatggaatttccccagaaggtgaaaccgaaataagtgctgatgatactgatgtcaatcttattcctcagttggtggagaagcttgcaatacccattcttcataaccagttagctaattgctgggatatgcttagcaccagtgaaacagtgtgtgctgtctctgccatgcgattggtgttgagatacggccccttttctggctcagccctcagcaatctgattgctgtacttcgtgatcgtcttgctgatgcggtggctaatttgaaggtgccaacttgggacacccttgttatgagggctgtacctgatgcagcacgagttgctgcttataggtttggcatgtctattcgtttgatcaggaacatatgcttgttccatgaaatttttgccatgcctgtcctggaagagctggttcttgatcaactcttaagtggaaagattgtacctcatcttcgaagcattcagtcaaacattcatgatgctgtaacaagaactgaaagagttgtcacttcactacacggtgtctgggctggccccaaagccacaggagactgcagtccaaagctacgaccgttggtggattacttgctctcacttgccagggtgctcgaaaagaagcactcatcaagcagcggagagatagagacatctaaatttgctcgtcggttgaagaagatgctcgtagaattgaatcaatatgattatgccagggacatatcaagaaccttcaacatcaaggaggccttgtgatctatctacttggtccccattgtcttaaaaaactcatgggatgttctcagttttagcagtcttctacaattttgaatttcatgtcattagtttttcttttagtgtagttacaaaaataacaaattttgatgatacaaatgaagcttaaacgaagaaccgaaggatt

SEQ ID NO: 425 - DNA, 1412 bp, Solanum lycopersicum
ttcatattatgcccaacaagtgtttgttgtaagttgtagctgaagaaatttgtaaaaaatggaagaaggtgaaacagggttgttgttgcagagtaacaaagaaatggtttcttcaggtttttcaacaaatgaaagttctgaagaaatcaagaagattaaatcagctctgacatgggtttttcttgatcaatcaaatctatggagggctggtctttcttggtcatttttttccattcttacaattggggttccattagtatctcactttatgtttgcttgtttaacctgtgatactatgcatcagagaccttttgatgctcttgttcaagtttctttatcactttttgcaactttatcatttgttagtctttctagctttgctcgaaaatacgggatacggaagtttctgtttcttgataaattgtatgaagatagtgaaaaggtgcaacaaggatacactgaacagctacataggtcgatgaagatcctctcatcttttgtcctcccttcttttattgttgagagtatttacaagatatggtggttttcctccgggggaacacaaattccttacctgtacaatgctgctttgagcaatatcttcgtatgcatactgttaataagctcctggctttaccggatatcaatttccttccttgtatgtgtcctattccggttaatatgctccctgcagatccttagactggaagagtttgctcaagttttcgagaaagaaactgatgtctcatcgatcatgatggaacatcttcgaatcagaagaaatcttcgtgtcattagtcatcggttcagagttttcattttgtcaactctcatactagttaccataagccagtttcttgcgctgcttcttactactgagcctagctccacagtgaacatctttacagcaggtgaacttgcgttgagctcaattactctggtaactggacttttcatgtgcttacgtagtgcagcaaagatcacacacaaagcacaagctgttacatcacttgctgccaaatggcatgcttgtgcaacaatcagcagcttagatgacatgactgaggaaactcccatggctcggtccgtggcacctcaggtggtataccctatcaattccagttgggacacagacgaggaaggagacggagacgatgtgttggacaacacaaatatggtacctattcatgccagtacaatatcctaccaaaagagacaagcactagtaacatactttgagcataacaaagctggaatcaccgtgtatggtttcatgttagatcggacatggcttcatacaattttcgcgattcagctgtctcttacactctggatactcaataaaacaattggtatttcgtaaatcccagtcaacgacaaggtttttactgtgtgttggtagttgtacagaa

SEQ ID NO: 426 - DNA, 1822 bp, Solanum lycopersicum
ccgatctatttctctacctctccggcgaaaaaggataatcatggaagataaatccattccattcgaatcaagtcactccgtatcaaacaatgataacaatcacggatggcaaaaggtgacatatgtgaagaagcagaaaaaaaagcagcaaaaaatctcggattcaggcaaggtaatcgccaatggatctgctatttccggcgccgataatgtgtataagtcgcttgagaagcactccgatgaacgccgcaagagaattgcagctcagacggctgcgatgtacggtgttggcgatgctccggttagatcggcgatgaaacaccggtcggacgatgaagacgaggataactatgctgaaggtggtgctgagaatggtgcggttggggagaagaagaaggagaaggtaaaaaaaccgaagaagccaaaagttactgtggctgaagctgctgcgaagattgatgcagctgatctagatgcttttctcgctgatataactgtttcctatgaatctcagcaagaaatacaattgatgcgttttgctgattactttggacggtcatttgcggcagtggctgggtcacaatttccgtggttgaaattgttcagggagtccgcgatcagtaaaatcgcagatgttcctgtttcacatcttcctgaaccagtttataaaacatcggttgattggatcaaccaacgttctttcgaggctcttggatcgtttgtgctgtggggactagacagtattcttgtggacttaacagcccaattagcaggttctaagggctccaagaaaggtggccaacaaacatcgtcaaaatctcaggttgccatgtttttagttttggcaatggtactacggcgaaagcctgatgttttaatcaccgtactcccgacgcttcgggaaagtccaaagtatcaagggcaagacaaacttatagttattgcatggatgatagtccaggcctgtcagggcgatctctgcgttggattgtacttgtgggcacatcataccttgcctttagttggaggaaaatcaggttccaatccgcagacaagggacttgattttgcaggtggtagaaaggatcctctctgcaccaaaagctcgaacaattttagtaaatggggctgttaggaagggagagcgtctgatgtcaccttcctcccttgacctgcttctacgggtgacttttcccgctccttctgcgcgagttaaggcaactgaaaggtttgaggcagtatatcccactcttaaggaggttgcgcttgctggttcccctggaagcaaagcaatgaagcaagtttctcaacagatacttctactagctgtaaaggccgttggaggaggcaatccagaactatctcgagaggcaacaaacatattcaattggtgtttgacccagagcgctgactgttacaagcagtgggacaagatttacctggataacatagaagcaagtgctgctgtgttgagaaagctcaacgaggagtggaaggagttatcgaggagacagtcctctactgaggccttgaaggagactctcaagagcttcagagagaagaatgagaaatcattaactggtggagcggatgctcatcagtcacacttcagagatgcagataagtactgtaaaatgttgttagcaaggctgtctcgtggacatggatgtgtgaaaggatttgttgttgttcttttggctatggcggtgggaggtgctattgtgtcacagaacttggaggattgggattggaacaagttttcggctttacttgatatcccacagacctcctaagtaatctggaccagatgagcaatgttcttt

SEQ ID NO: 427 - DNA, 1872 bp, Solanum lycopersicum
tgacacatcaccatatcttcttcatcatacaaaaaaaacaaaacaaaaaaaaaatcatagtgtactatgaacattcactatattttccttaaaagttcagtacctttctgcaattctcagaggactaaaatcaacacttttgagaccccttttagtagaaatggatgtagtaacttttggcataataataggaataataatactatttttctgtgctgtttgtgtaatcaccatagaaggcacttgcaagaaccgctcttcttgattcctaataccctttatccaaacacgcccttatcatctcacccttccataaatttagggtttttagctgattttgttcttgcccaaattgacaaaatgtcgaaaaaaattgatgctttggtgaaacagatctgcttcttcttgattgtttctacttctttatggctagtgatttttgggtcttctgtagaagcgaaggctctagaagatcccaagcaggaatttcatcagtgtagccatggtcatggtcatcatggccatgaggggcatcaccatgatcatgatcatgggtcgagtggagttgagcagaggaagcttctagaggaattggctgaagaggaggatctgaaactgtatggatttgggtctcatgctagtatggatgaacatcatcatcatcatcatcatgatggacatggagtcaaggatcttactggtcttggtctatgggtcaatgcaatgggttgctcactattagtgagcttggcttcccttatctgcctgattcttttgcctttaatatttatacacgggaagccgtcaaaagcagttgtagattctttagcattatttggggcaggagccatgctgggggatgctttccttcaccaattgccacatgcttttggtggtgggcactcccactcccatgatgaccatcttcatgatcactctggtcattcacacgcccattcattggaggatctttctgttggattgtccattttggctggaattgtgctctttcttattgttgagaagcttgtgaggtatgttgaagagttttctggaggagtcaatgagcggagtcatggtcatcatcaccatcatcatatgcactacacaaagttgaaggatgataatgatgctgatgataatctccgggaactgtctcaggagaaagatggaagttcatcagaaaaggtagctggagggagtagagtggatggagtgtctactgactctcccaatggggagaaaccaaatggaggagctattctacggaagaggaatactggctccagtgctgctgaagacaatactgctttagatgctgcaaattgctctaccaattctacatcaactggagaggaacaggctaaatcacgttcaagccttgtctttggttatctcaacctcttttctgatggtgttcacaattttactgatgggatggctttgggaagtgcattcctccttcatggatcagttggtgggtggtcaagaactttgtttcttctggcacatgagctccctcaagagataggtgattttggaatcttggtaaggtctgggttcagcgtctccaaagctctcttctttaacttcttatctgcactagtggccctagccggaactgcactggcattgacattgggacaagattctggtcattcgtcattgattgagggattcactgctggcggcttcatctacatttcagttgccggagtgttggctgaaatgaacaatactggcaggacgacgttagtgaatacagtaatccaacttatctcactggtatcagggatggctgttgctctttgcatctctctcattgaatgacggtatacgctacttcttgtgttcgtagagaggagagactag

SEQ ID NO: 428 - DNA, 3113 bp, Solanum lycopersicum
aacgatttgctcaacaacgaacagtcatggtgttcatcaatcttccgaatcacaaaaccctaaccctagaaattaatccttttgtaacttctcttcaaaccctaaccctagcaatccatcaaaagttccatattccaatcactcaacaacgactctactcatcctgccggcgtctcctcgatgtggaagcactgttatccgatctagggatttcccctaattccactctaactctacacgttcctcttttcggaggtatgcaagcacccggggcaccgaaagcccggcttgaatttcttaacacgagacctcctccgaattatgttgctgggttgggtcgtggtgctaccggtttcacgacccgttctgatattggtccggctcgtgctgctcctgacctccctgatcggtcagctgttgggggtgcaccggcgactggagttggacgtggacgtggaaagggtgctggagaggaagacgaagaggaggatgcggaggagaaagggtatgatgagaatcagaaatttgatgaatttgaaggaaatgatgtggggttgtttgcgtctgctgagtatgatgaagatgataaagaagctgatgcgatttgggaatctattgatcagaggatggattctaggaggaaagataggagagaagctaggttaaagcaagaaattgaaaagtatagagcttcgaatccgaagattactgaacagtttgctgatttgaagaggaaattgtatacattgtcaagtgatgagtgggatagtatacctgaaataggggattattcgttacgaaacaagaagaagaggtttgagagttttgtgcctgtacctgatactcttttggagaaggctaggcaggaaaaagagcacgtaactgcattggatccgaggagcaggatggttggtggcatggagacgccctcttcacagacgccagttgcagatttgactgctgtgggtgaagggagaggaactgtgttgtcagtgaggttggataggattttggattctgttactgggcaaaccgtcgtggatcctaagggatacttgactgatttgaagagtatgaaaattactagtgatgctgagatttccgatataaagaaggctagattgttgcttaagtcggttactcagaccaatccaaagcatcctcctggttggatagcagctgctagactggaggaggttgctgggaagatgcaggtagcaagacagttgataaagaaagggtgtgaagagtgtcctaagaatgaggatgtttggttggaggcatgccgtttggcgagcccccttgaggctaaggcagtgattgctcaaggtgttaaagcaaatcccaattcagtcaagttgtggatgcaggcttcaaagttggaggatgatacagcaaacaagagccgtgtgttgaggaaaggtctagagcatatccctgattcagtgaggttgtggaaagctgttgtggagctggccaatgaagaagatgctagacttttgctacagagggctgtggaatgctgtccattgcatgtggagctgtggcttgctcttgccaagttggagacttatgaaaatgctaagaaagtacttaacaaggctagagaaaagctgcctaaagagcctgccatctggatcactgcagctaggcttgaagaggctgatgggaatactgcttcagttgggaaaattattgaaagggcaataagggctttgcagagagaaggtttggagattgacagggaggcttggatgaaggaggctgaaggatgtgagagagctggttctcttgggacttgccaagctataataaacaacactgttggggttggtgttgaggaagaagataggaagaggacctgggttgctgatgctgaggagtgcaagaaaaggggttctattgaaacagcgaaatacatttatgcacatgctcttactgtatttagaactaagaaaagcatctggcttaaagctgcacagctcgagaaaagtcatggcacgagggaatcacttgatgcagtgcttcgaaaagcagttacctacattccaaaggctgaggttctatggttgatgggtgccaaagagaagtggcttgctggtgatgttcctgctgctcgagcaattctggaggaagcatttgctgcaattcctgattccgaggagatatggcttgctgctttcaagctcgagtttgagaactgtgagacagagagggcaaggaagcttcttgctaaggcacgtgaaaggggaggcttggagcgggtttggatgaagtcagtcattgtggagagagaacttggaaatgtggatgaggagaggagattactggatgaagcattgaggcgcttcccctcatttttcaaactttggttgatgctgggacagttggaagaaagacttggtaattctaacaaggcgaaggatgcatttgaatctggcattaagaattgccccaattgtatacccctttggctatcccttgcctctctagaggagaaaatgaatgggctaagcaaagctcgagcagttcttactatggccaggaagaggaatcctcaaaaccctgagttatggcttgcagctgtgcgggctgaagctaggcatggctacaaaagggaagctgatgttatgatggctaaagcattgcaggagtgccccaacagtggcattctttgggctgcttcaattgaaatggcgcctcgacctcaaagaaaaaccaagagctctgacgctttaaagaagtgtgatcatgatcctcatgttattgctgctgtagctaagctcttttggcaggagaggaaagtagataaagcaagaaattggttcaatagggcagtgacccttgcaccagatattggtgatttctgggcattgtatttcaaatttgaacagcagcatggagcagaagagcagaggagcgatgtgctgaagcgatgtgttgctgcagagccaaagcatggtgaaaaatggcaagctacatcaaaggccgtagagaactctcatgaaccaactgaaagcatattgaagaaggtggtagccacactaaagaaggaggagaatttggctgaaaataaccacaactaatctgctgtagtgcatgagtcaatgtag

SEQ ID NO: 429 - DNA, 780 bp, Solanum lycopersicum
caaatctttgatggatgattctccaaaaaagtggtaaattttccattcccagaaaatctcaagaaccaaaaagcaaatggggcagaatactggtgcaagtggcaaagggaagaaagaagcagaaacggaaaaggaaacagtggtagaagaagaagaagaggaagttgaagaaggtggagaagaagctgaacaagatggaatgtctgttcattctccttgtaaacctgcatcttctgctcttcgtaaggaacaatcacaggtggaattggagataagattgttggaggctcttgaaatctatccccctgccaaattgagaggcatccatcgtcattttgtcctatacggcttaacagagcatctgcgtagaagcttcaataggcaatttgctcctgatgatgttttgaagctgctggatcgcttctacaacttggatatggtgaaaccagaggacgaggactctgaaatcctaaatcaagaggaagagttttgcctacctcacagttatttctcgagggacgaaccttgaactaagttggaatcgatatggatattgaacttctacatatggcagtttttgtatagtagtatctgggtggttcaatttttttttttttgatgccataagagattctgcatctattaatcttactgaaaagtttttatgcatgctgatatttcagctctccttatatatacagtagacagttggatctttttacaatttttctcatagagatttgatatattgtgaagcatcaacatccactgtgtcaagag

SEQ ID NO: 430 - DNA, 1080 bp, Triticum aestivum
gtttatccagcgaagctagcaggcagcagcaatggcggccgagcccgagatctgcgtgctctccaatggcaggatcacggcgaacatcgccagctggggcgccaccatcacctccctcctcgtccccgacgcgcaaggggatctcgcggatgtcgttcttgggttcgacacactggagccgtacttgaaaggcatggcaccttattttggttgcatagttggccgagttgcaaataggatcaagaatgggaagtttgatctgaacggagtcgagtattcattgcctatcaacaatgggccgaacagccttcatggtggattgaaggggtttgacaaggttgtgtgggatgttgtagagcgtaaagatggcgagtacccatcaataacctttcaatatgagagcaaagatggcgaagaaggttaccctggcgatgtaaccgtccgagcaacgtattctcttccggaggccaccactctaagacttgatatggaagctataccagctaacaaagccactcctatcagcttggcacagcatacttactggaaccttgcaggccacaactctggcagcatcttggatcattcgatccagatctgggcaaaacacgtcactccagtcaatgaaaacacgattcctaccggagaaataatgcccgtccaggacacgccttttgatttcaccacggagcacaagattggagaccgcatcagcgatgttcctggagggtacgaccataactatgtgttggactcgggtgatgagaagaatggcttgaagcacgcagccaagctgaaggacccatcgagctcacgaactctggacctctggaccgatgcgcctggcatgcagttctatactgccaactatgtgaatggcatcacgggcaaaggtggagctgtttacggtaagcatgccggagtatgcttggaaacccaggggttccccaatgccatcaaccagcccaatttcccgtctgtggtggtgcagcctggtgcgaagtataagcacgccatgttgtttgagttctcggcatgattagatatgctgccggcagcttaaatggctgcaactgcaat

SEQ ID NO: 431 - DNA, 1386 bp, Brassica juncea
ctagctctccgagggtctcttctctctcgctctttggttgctagggttttggtaaagaagggaggaaagaaaagatgttcgggcgaggaccctcgaagaagagtgacaacaccaaattctacgagatcttaggtgttcccaagagcgcatcccctgaagatctcaagaaggcttacaagaaagcagccatcaagaaccatcccgacaagggtggagatcccgagaagttcaaagagctagctcaggcttatgaagtacttagtgacccggagaagcgagagatttatgatcagtatggagaggacgctctcaaggaaggaatgggtggtggcggtggtggaggacatgatccctttgatatcttctcttccttctttggcggcagcccctttggaggtggtggtagcagccgcggaaggaggcagaggcgtggtgaagatgttgttcacccccttaaggtctcccttgaggacctctaccttggtactaccaagaagctctccctttctaggaatgctctctgctcaaagtgtaacggaaagggttcaaaatcaggagcctccttgaaatgtggtgggtgtcagggtacaggtatgaaggtgacaatgaggcagcttggccctggaatgatccagcagatgcagcatgcctgtaacgaatgcaaaggcactggtgagaccatcaacgatcgggacaggtgtccacaatgcaaaggagataaggtcatccccgagaagaaggtgcttgaagtgaatgtcgagaaaggaatgcaacacagtcagaagatcacattcgaaggacaagctgatgaagcgcctgacactgtcactggggatatagtcttcgtcatccagcagaaagagcatccaaagttcaaaagaaagggagaagacctctttgtagagcacacactttctctgactgaagctctttgtggcttttcattcgtcctgacccacttggatggcagaaatcttctcatcaaatctaatcccggggaggtcgtgaaacctgattcatacaaggccattagcgatgagggaatgccgatataccagaggccattcatgaagggtaagctctacatccacttcactgtggagttcccggactcactgagccctgaccagaccaaagcactcgaagctgttctgcctaagccttcaactactcagctgagcgacatggagatcgatgagtgcgaggaaactacgctacacgatgtcaacattgaagatgagatgagaaggaaagcacaagctcaaagggaggcttatgatgatgaagacgacgatgatgaccatcctggaggcgcgcaaagggtgcaatgtgcccagcagtaagttaccttaagagagagagagagaggctttggtcacatggtag

SEQ ID NO: 432 - DNA, 905 bp, Brassica juncea
tcgaagtgtggtttcttcatatccggtgaattaagcaagatcctctagtaaccatgatgaatcggctgttcgggaaaccaaagcaggagacgaatgctctccagacattagacaagcttaacgagacacttgagatgctagagaagaaggagaaggtactcttgaagaaggctggtcaagaggttgagaaggccaaagaatacactcgtgctaagaacaaacgcgcggctatacaatgtttgaaaaggaagaggttatatgagcaacaagtcgaacagcttggcaatttccagctccgtattcatgatcaaatgattatgttggaaggcgcaaaagcaacaactgaaactgttgatgcgttgaggagtggagcttctgcaatgaaagcaatgcagaaagccacaaatatcgatgacgtggacaagaccatggatgagatcaacgagcagacagagaacatgaaacagatccaagaagcattgtctactcctatcggggcagcagctgacttcgatgaggatgagctagaagcagagcttgaagaactagaaggtgcagagcttgaagagcagcttcttcagccgacaacagcattgccttcagttcctgcagggcgtcaacaagtacgtcctactccgaaacgtaccgcagaggaggaagaacttgctgcattgcaggctgagatggccctctaaggtttattcacgaaccggagcagccctgtatgcattgaacaggcgatgtatataaggatctcaatgtcaaaattataaatctgagcgaaacttaataataatcctcgtcgtgcaatgttattttatcaacatttgactgtttcttcttcacatatactttttatcttttgtatttgatttggtaatctgatgggttacttactacgtacg

SEQ ID NO: 433 - DNA, 526 bp, Brassica juncea
aaagatgtcattagcttcgccgattcaatgcatcagaattataaatccatcatcttcttcttcatcttctttgacgacttggtcgtctttgagattctcaacgagtaagccatgtgtattcatcatcagatgttctcaggcggaaggacccttgagaaggccctctgctcctcctactctccgggagcctacacctccccaaaaacctgttactcctacgccgtcttcttcccctccaccaccgcagaaagctgtggctgttgacggtaagagcgtagtaacaaccgtggagtttcagaggcagaaagctaaagagcttcaggattactttaagcagaagaagcttgaagctgctggtcaaggccccttttttggtttccaacccaaaaacgagatctccaatggaaggtgggctatgtttggttttgcggtggggatgctgacagagtatgcaacaggatcagaccttgtcgaccaagttaaaatccttctctccaatttcggcattctagacttggaataataa

SEQ ID NO: 434 - DNA, 1072 bp, Brassica juncea
aaagaattctgaagatatggcaactttgaacccttttgatctgttgggtgacgacgcagaggatccgagccagatcgccgtctccatcgctgctgataagcccaagaaacctgcacctgtttccgctaagtcatctgctccgtcgaggcagcttcctcaacctgtgagagaggctaggagtgatgctccacgcggcggcggacgtggtggtggtggagaccgaggatctagccgtggtcgtggtggttacaaccgtgattttagaggcggtgatggtaacagtggaggatacaataagccctctgaggaaggaggcatttcaaagcctttctatgagaaacgtagtgtatatggcggtgctcctcgtggtggtggtcgacgtggtgaagctggtgaaggtgaacgtcctcgaaggacattcgagcgtcgtagtggaactggccgagggggtgacttcaaaagggaaggagctggtcgtggaaattggggaacaccaggagaagaagttcttgttgtggagactgaagaagttgctggtgttgagactgagaagcctgctggtgatgaggttgctgctgatgctaagaaggagaacgctgctgaagtcgaggagcagaaagagcctgaagataaggagatgactctggatgagtatgagaaaatactcgaggaaaagaaaaagtctcttcagtctcagaccacctctgagaggaaagttgatacgaaagtgtttgaatcaatgcaacaactctcaaacaagaagaagtctaacgatgaaatcttcatcaagctgggttctgataaggacaaacgcaaagatgacaaagaagagaaggctaagaaggctgtgagcattaatgagtttctgaaaccagctgagggtgagaactactaccgaggaggaggccgtggtggtggtcgtggaaggggacgtggtggtcgtgaccgtggagttgtttctggtggtggatttgatggttaccgtagtgaagctgcgcctgccatcggagatactgctcagttcccatctcttgggggaaagtaagatccatccatgaactaaaggcctaaa

SEQ ID NO: 435 - DNA, 1284 bp, Brassica juncea
tctcagtttaagcacgttctggagatttgaccggaactaaaagctttgaggaagagaagaatcatgcggaggtggatctgttgtggtgggcatagatcaggagattctgatatatcaaatgatgagaaacatctgaaaactcaatggcagcaacctgatgcaaataataagcagccaagaccacaagctgttgcaaaaactgaggcgcccaaggaagcgcttcccattgaagttcctctcttgtctgtggaagaggttgaagaaaagactgacaattttggatcaaagtcactcattggtgaaggatcttatggaagggtgtattacgcaactcttagtgatggtaaagcagttgcgttgaagaaactcgatgttgcccctgaagctgaaacaaacaccgagttcttgagtcaggtttccatggtttcaagattgaagcatgagaatttcattcagctggcgggttattgcgtcgatgagaacctccgtgttcttgcttatgagtttgcaacgatgggatcactccacgacgttctacatggtaggaagggagtacaaggtgcacagccaggtccaacacttgactggataacgagggtgaagatagccgttgaggcagctaggggtttagaataccttcatgagaaggttcagcctcctgtaatacacagagacgtgagatcaagcaatgtgcttctgtttgaagactatcatgcaaaagtggctgatttcaatctctcgaatcaagctcctgataatgcggctcgtcttcactctacaagagtcttgggcacctttggctatcacgctccagaatatgctatgacgggacagttgacacagaagagtgatgtgtatagctttggggttgtacttctagagcttttgaccgggaggaaacctgtggatcacacaatgccacgtggccaacaaagtcttgtaacctgggctacaccgagactcagtgaagataaagtgaagcagtgtgttgatccaaagctaaaaggagaatatcctcctaaatcagtagctaagctagcagcggtggcagcactgtgtgtgcaatatgaatcagagtttagaccgaatatgagtatcgttgtgaaagctttgcagccacttctcaaacctccagcgccagcccctgtacctgagtcctgagtttgttcgtaaaagagttggattctttgttcatacaaagttttagtttgtattttggtgtgaaatgagggatacttttgatattttgcatttgttattgtctggattggaacaacaaagatg

SEQ ID NO: 436 - DNA, 498 bp, Gossypium hirsutum
cataccctcttccttcattacatcacattccttcctcgctttgtagcaattcagccaatggcaaaacttgtggctgctttcttcttggctctcattgccatctccatgcttcaagttatggtcttggcatcgcatggacatggaggtcatcattatgatcaaaaacattacggccctggaagcctcaagagttaccaatgtccatcacagtgctcgaggagatgcagcaaaacccaataccataaaccatgcatgttcttctgtcagaaatgttgcaacaaatgcctctgtgtgccccctggttattatgggaacaaagctgtttgcccttgctacaacaattggaagaccaaagaaggaggacccaagtgcccttaaaaattcttatttcataatttatgcctaatgcttacattgttattattaccgtctgttttttttttttaggaaatgtgatgggttttgtatcaatttgtcactccattgagggaccatacc

SEQ ID NO: 437 - DNA, 551 bp, Zea mays
cccttggctcctactcactctctctccccatccgcgccagtccaaccaagtcagcacccgcgcgcggcaaggagttcacgcccatggcgagcaccaacatggcgtcggccacctcgcggttcatgctggccgcgggcgtgcccaccgccagtagcggcagcggccgcgtcagcttcgcctcggcgcccaaccggcttggcaggaggcttgtggtccgggccgatgaggagtccccggcagagccggcgccgacggcggaaggggagggcgccgtggccaccaagcccaaggccgagaagccgccgccgatcgggcccaagagaggcgccaaggtgaagatcctgaggcgggagtcctactggtacaacgggatcggcaacgtcgtcaccgtcgatcaggatcctaacacccgttacccggtggtggtgcggttcaacaaggtgaactacgccggcgtgtctaccaacaactacgccttggacgagatcctcgaggtgaaatgagtgaggccagtctgctcaaggaccccatgctcctgtgtgatttgttag

SEQ ID NO: 438 - DNA, 1019 bp, Medicago truncatula
caagctaattaactatcactccaatggccaccattgttgttcatagccaaacatctccagttcaagatgctgaggctcttcgacttgctttcaaaggatggggggctgataacaaggccattattgcaattttgggtcatagaaatgttcatcagaggcaacagattagaaaagcttatgaggagctttttgaagaggatctcatcaaacgtcttgagtcagaaatctccggtgactttgagagggctgtgtaccggtggatgttggaccctgcagaccgtgacgctgttttgatcaatgtagcaatcaggaatggcaacaaagactatcatgtggttgctgaaattgcttctgtgctatcaactgaagagctcttggcagtgaggcgtgcctatcataaccgctacaagcgttccatcgaagaagacgtgtctgctcacaccaccggtcatcttcgccagcttttggttggattggtgagctcatttaggtatgagggagatgagatcaatgcaaaattggcacaaactgaagctaatattattcatgaaagtgtcaaggaaaagaaaggcaacaatgaagaagtcattaggattcttaccacaaggagtaagactcaacttgtcgcaactttcaaccgttatagagatgagcatggaatctccattagtaagaaattgcttgatcaaacatctgatgacttccagaagacattgcacacagctattcgttgcatcaatgaccacaaaaagtactatgagaaggttttgcgcaatgcgatcaagaaatttggaaccgatgaagatggactgagccgcgtgattgtcacaagggctgaaaaggatttgagggacatcaaagaactgtactacaagagaaacagtgttcatcttgaagatgaagtttccaaggaaacctcaggggactacaagaagttcatcctcactcttttggggaaacatgattaaagtaattgagctaagggcatatctataatgagtttgggttatgatggctta

SEQ ID NO: 439 - DNA, 1058 bp, Medicago truncatula
ttaggaaaataaatcaattatggctacccttattgctcccatcaaccattctcctgttgctgatgcagaagctcttcatggagctttcaaaggatgggggactgatgagaagagtgttatcacaatattgggtcatagaaatgtttatcagagacaacaaatcagaaaatcttatcaggaaatttaccaagaggatatcctcaaacgccttgaatctgaactctctggtgactttgagagagctgtgtaccgttggatgctggaacctgctgatcgcgatgctgttttggctaatgtagccatcaaggatggaagcaaaagttaccatgtgattattgaaattgtttctgttctttcacctgaagaagtgttggcaatgagacgtgcttatcataaccgttacaagcattctttagaagaagatttagctgctcataccaccggtcatcttcgccagctgttggttggattgatgacctcgtttagatatggcggtgctgagataaatccgaaattggcaaaaactgaagctgacattcttcatgaatcaatcaaagagaaaaaaggaaatcacgaagaagccattagaatccttactacaaggagcaagactcagcttttggcaactttcaaccgctacagagatgaccatggcatttccataactaagaaactgttggataatgcatctgatgattttcacaaggcattgcacactacgattcgatgcatcaatgaccataagaagtactatgaaaagattctgcgcggtgcgttgaaaagggttggaaccgatgaggatggactgactcgtgtggtcgtgacaagagccgagaaagatctgaaggacatcaaggagctgtattacaagagaaacagtgttcaccttgaggatgcagtggctaaggaaatttcaggagactacaagaagttcatccttaccttgttggggaagcaagattgaagtaattgatcttgttaaggcatatatatatattgtaataatgggatttggatatgttggtttctttcttgtggtttggtttggttaatttgtc

SEQ ID NO: 440 - DNA, 1040 bp, Medicago truncatula
gggttttactcaatttcaagattcgatctcgatccatggatatgcgcaagagaggaagacccgaacatggattcaacaacaatgggggattcaagaaatccagacatgaaatggagtccttatcaactggtgtaggaagcaaatcgaagccatgtaccaagtttttcagcacttctggctgcccatttggtgagagctgccacttcttgcaccatgttcctggcggttataatgctgtttcccagatgatgaatctaacacctgcagcacctcctgcacccagaaatgttccagccccacgaaatgcacatgcacccaatgggtctgcaccatctgctgttaaaagccgcatatgcagcaagtttaatactgctgaaggctgcaaatttggtgacaaatgccatttcgcacacggagaatgggaacttggtaagcctgttgctccatcatttgatgatcaccgtcacaatgaccaccgtcacatgggaccccccaatgctggccgttttggcggtcatcggatggagcctcctcctgttccagctagctttggtgccaatgccactgccaagatcagtgttgaagcctccctggctggagctatcattggtaagggtggtgtgaactcaaaacagatctgtcgtcaaactggtgccaaacttgcaattcgagagcatgaagacccaaatctgaaaaacattgaacttgtgggaacatttgaacaaattaaggatgcaagcaacatggtgaaggatttactgttgaccctgcaaatgtctgcaccacctaaatcaaaccaaggcccccctggccatcatggcgcccctggccatcatggaaacaacttgaaaacaaagctgtgtgagaattttgcaaaaggatcttgcacttttggagatagatgtcattttgcacatggagctgttgaattgcgtaaatgaaaattttacctcaatgaggcggtgcactgtcgtgtcagacaggactatatttttatttttaatattgttgtgcattgctccttagggtactgacaggac

SEQ ID NO: 441 - DNA, 788 bp, Sorghum bicolor
gaagagacttgcaaagtggaggagtaggccatgtccaacgtgcccacctccctccgcgactcctccctcaccgtcttccgcctcgccatctccagctccgacccctggcccttctcttcctgcctctaaccaccaccagcccccctcggccggccagcttcagctcccagcctcccactccacccaaagtttcttcgttctaatcctccttcctgatcaagcaaccaggcaagcaagctaaggaacgccgagcgatcgaccatcatgcccggcaagcaccaccagcagatggcggcagcggcggcgggggcggtggcgcccaaggggtgcgtgacggtgcgcgtggggctggagggggaggagcagcgccggttcgcggtgccgctgggccacctcaagcacccgctcttcggcgcgctgctggaggaggccgagcgcgagtacggcttccgccaccagggcgccatcgccatcccctgccgcgtcgaccgcttcgtccacgtcgagcgcctcatcggccaggacctccacggcacctccccctgcgcccaccacctcgtcgacctcgacggcggcgccctggcggcaacagccggcgccggcgccgcgcaccaccaccatcaccaccacgtccacctgcacctcccgcgcttcgtcggctgcttccgcgcctgacgacgacgggcccggccgtcgaggtggttgattagcttttaatttggtttgctcatcctccctccctccctccctctctcgcgttgttttgctttgtgagggttctcatcgat

SEQ ID NO: 442 - DNA, 1115 bp, Sorghum bicolor
tcgcactcacactagcaaccaaccccaggaccatactctccggcggcggccggcgcgcgcgcgagggagatggaccgccctgtcggcgcatcgtaccagcgcttcccccgcgttcggatccgcgacctcaaggacgactacgccaagttcgagctccgcgacaccgacgccagcatggccaacgccctccgccgcgtcatgatcgccgaggtcccaaccgtcgccatcgatctcgtcgagatcgaggttaactcctccgtcctcaacgacgagttcatcgcccaccgcctggggctcatcccgctcacctccgccgccgccatgcaaatgcgcttctctcgggactgcgacgcttgcgacggcgacggctcctgcgagtactgctccgtcgagtttcacctcgccgcgcgcgccaccgactccgaccagacgctcgaggtcacatccaacgacctgaggtccatggatcctaaggtctgcccagtcgaccaagcacgcgcctaccagcaggcgctcggtggcaccgacccctttggagccaatacctcaaacgaaaataggggcatacttattgtaaagctgcgtcgggggcaagaactaaggcttcgtgccattgctaggaaaggaattggcaaggaccatgccaaatggtcaccagctgctaccgtgactttcatgtatgagcctgacatacgtatcaatgaagaactaatggaaacattgacagtggaagagagaagaaggttgattgaaagcagccctacaaaagtatttaagcttgattctgctaatcaggtggtggtggacaatgctgaggcatacacctatgatgatgaggtgatcaagcacgctgaggccttgggaaagccaggcttagttgaaatcaacgcgaaggaggacagcttcatcttcactgtagaaacaactggcgccatcacggcctacgagctgatcatgaacgcaatcacggtcctgaggcagaagctggatgctgtccgcctccaggacgatgatggtgaccttggcgagctcggtgcccaccttggcgggccttaggatctttgcaacaagaattgcccttggtgtcttcctccaccgcctatgtagtaggccta

SEQ ID NO: 443 - DNA, 1372 bp, Sorghum bicolor
gcgttggacagggagctaggcggccggggttgattgcaattgggggaggcgggggtgggtgatgtacggcgcgccggtgcccaaggacctgaacctgccagcagcagccctgccgcagccgaccaccagggccggtgcgagaacgccaccgcaccagcagcagcagatgagctccccgggactgctgcggtacaggtcggcgccgagcacgctgctcggcgaggtcatgtgcggggatcaggacttccccgcggctgcggctgcggctggcggcgcaggggcagggcacggaccaccaccggaccacgccgccgccgcggacaacgtcctcgcgcgctttctcgccgggcaccaccactgctccgaggcccgggactgcaagcctccccgccccgccgcgtccgctcatcacttcatggacgaagccgccgccgccgccgcgtccatggccgcctcacagcagcagcagctcatgtaccagtcgtcgcagcagcagatggccgccatggaggggttgtaccgcaacgtcagctccggcggcacggagcacggtgcggccgttggcggcgccggtaacaacagcctgatccgccagagcagctcccccgccggcttcctcagccacctgaacatggacaacgggtacgggagcatgctccgggcgggcatggccggcggcgggttcaggacgaacggcgccgtcagcgacgcgcggctcaaggggcagctgagcttctcgtcccggcaggggtcggtgatgtcgcagatctcggaggtgggcagcgaggagctcgacggcggcagcagccccgagacggcggccggcagcaacggcagcggcgcgccgcgcggctacagcggcatcccagggtacacgatgggcgtctcgcccggcgcctggacggacgagccgtcgccgtcgccgacgtccggcgcgaagcgcccccgcgactttgctgggcccgtgccgcagaacgtgcatcagcagccgctggcgccgcagctcagtctgcccagcggcaacaacggcggcggcaagccggcggcggcctcggcggagatggcggcgatcgagaagttcctgcagttccaggacgccgtcccctgcaaaatccgcgccaagcgcgggtgcgccacccacccgcgcagcatcgccgagcgggtgaggaggacgaagatcagcgagcggatacggaagctgcaggaactcgtgcccaacatggaaaagcaaaccaacactgccgacatgctggatctggctgtggactacatcaaggatcttcagaagcaggtcaaggtgctgaacgacggccgcgccaactgcacctgctccgccggcaagctgctgcaggaccagttcaccagttagtag

SEQ ID NO: 444 - DNA, 463 bp, Sorghum bicolor
ttagccggcaaagagtggccactagatccgctcctgatggacaacgtcgagtctgcccctgactcgccggcgcaggcgccgccgtcatccgcctcttctctccccaaggaacaatcgcaggtggagttggagctgaggctgcttcaggctctcgagttctaccctccatcaaaactcaaaggcattcatcggcactttgttctctatggcctcatggaatttttgcgaaaaagccttgatcggcaattctctcctgatgaagttttacaactcttggaccgcttctttaacctagaaatgctgaaaccagaggacgatgaaaaggacaacttcagtcagggggaagaattttccttgccagagagttttctcaacaaggaagaataatagcaagtagtagcttggtaatttcataggaggtactttgggcgtcgtctggaagagagatcagaacgctggtttc

SEQ ID NO: 445 - DNA, 309 bp, Glycine max
ttacgcacccaagagagagaaggagaaagagaatcgatcgacgctgctagagaagtagaagaagatggcgggtggtgctcccaaacaattgttcggattcggagttgtggcgttgcttgccactctcattcttcctctctttatgcccgccgctgttcaggctcaatccgcagcccctgcacctgcccctactagcgacgggtcctcccttgatcaagggatagcttatgtgttgatgttgctggctctggtactcacatacatcatccactcggcctaaatttcctccaccttctgaacttatagagc

SEQ ID NO: 446 - DNA, 352 bp, Glycine max
ctggtctcgtgcaagtgtaacccaaaaccctagcggcgcctgctttcttcgttcgtcttttgcatcagccatcaggatggagtctcaggtgaagcatgctcttgttgtcaaagttatgggtcgtactggatccagaggacaggtgactcaggttagagtgaagtttttggatgatcagaaccgtcatatcatgaggaatgttaaaggaccagtgagagaaggagacattctcaccctactcgagtctgaaagggaagcaagaaggttgcgctagagggtatttttttcttgatctttatggtagttagttggtgctaaaggttatagcaccctgtcttgttgtcttggatct

SEQ ID NO: 447 - DNA, 562 bp, Glycine max
ctgcatcttcacgtcgtctctaacgagggaaaatgagtcgaggaggtgcagcagcagcgaagggaaagaagaagggtgctacattcaccattgactgtgcaaagccagtagaagacaagatcatggacattgcttctctcgagaagtttcttcaagagaggatcaaggttggtggcaaagctggtgctcttggtgactctgttaccgttacacgtgagaagactaagattattctcacctctgactgtaacttttccaaacggtatttgaagtacttgacgaagaagtacttgaagaaacacaatgtgcgagactggctcagagtgattgcttcaaacaaggatagaagtgtttacgaactgaggtacttcaacattgctgagaatgagggagaggaagaagattagttgtctgatagccttatttgcttaagtgttttgtttacccttttcctatacctagcttcctttttggcaaatattgcttgagatacgatgctttgttttgatcggttgcaatttaacggttttgatcatttaagaattgcggtactattggtgtt

SEQ ID NO: 448 - DNA, 1007 bp, Glycine max
aaaggatccataaagctagccggagatgatggttcaaaaggaagatttgggtttgagtttaagtctcaatttccctcatcacagtaccccaaatcctcaacatctgagtctcatgtcatcctctactcattcctcttccccttctggtttcaaccctcaaaaaccctcttggaacgaggctttcgcttcttcggatccagatcgaaactccgacacatgcagaggcgaaacacggtcgttcctgcggggaatcgacgtgaaccggttaccttccgccgtggacgccgaggaggaagcgggagtttcgtctccaaacagcaccgtctcgtgcgtgagcggaaaacgaagcgagagagaacccaacggcgaagaacacgacatggacagagcctgttcccgcggaatcagcgacgaagaagacgctgaaacctcaaggaaaaaacttagactctccaaagaccaatccgctatcctcgaagaaagcttcaaagaacacaacaccctcaaccccaagcaaaaattggcactggcaaaacagctagggcttcgacctagacaagtggaggtgtggttccagaacagaagggcaaggactaagctgaagcaaactgaggtggactgcgaagtattgaaaaggtgctgtgagaatctgacggaggaaaatagaaggttacagaaggaggttcaggagcttagagcactgaaactttccccccagttttacatgcaaatgagcccacccacgacgctcactatgtgcccctcttgcgagcgtgtggctgtttcgtcctccgccgttggttctgccacgcgtcatcatcccatggcccatgcccatgcccatgctcggcccatgcccaatggcccgtgggcttccgcagctcccattccacaccggccgtttgatgctttccaccaatgatcttgagggtgttttggtcattgtgaattattattatttacaattatgggcctacttgtaccaccgtgaatgtgtgggtaccttt

SEQ ID NO: 449 - DNA, 348 bp, Glycine max
ttagcaaaatccatggcagatcttcaagaaaaactggatgctctgaagggtcttgttggtgtgctaaataacatggatgagggtgaaactcacaacaacaatgcaacctcctcacccaataattcccatagtcctgctcctatgcctggaaggaatcgctctgttggaaaatataacaacagtggcactcagaagattaaaggtctgagtaaccaaaccggcttcaccgaaggcaacgctaacggagccatcaactttggcaatttacatgcctaaataaatcaatgtaccaagatcttgaaatccataaataataatgtgacgtacaaattaaaataagagcttcac

SEQ ID NO: 450 - DNA, 1049 bp, Glycine max
gtatttgttctccgtcatctcgcgtcgttagttcattgaactcactgcattgagtggatttggtccaagttgagtttagaaatggatggccatcatcagaagcaaaaaaacaagtacagtataattgttcctacatataatgagcgtctcaacattggtctcattgtttacctcatcttcaagcaccttggggatgctgattttgaaattattattgtggatgatggcagtcctgatggtactcaggatgttgtaaaacagctgcagcaagtttatggagaagatcggattctgttaagagcacgacctaggaagctgggtttaggaactgcttatattcatggcatgaagcatgcatctggaaattttgttgtcatcatggatgctgatctatcacaccatccaaaatatttgccaagcttcattagaaagcagtcggagactggtgctgatatagttacagggactcgttatgttaaaggtggtggtgtgcatggatggaatcttatgcgtaaactaactagcaggggggcaaatgttcttgcacaaacacttttatggcctggtgtctcagatttgacaggatcttttagactttataggaaatcagtgcttgaagatatcattagttgctgtgttagtaaaggatatgtctttcaaatggaaatgatagtacgagcatccagaaaagggtaccatatcgaagaggttccaatcacatttgttgatagagtatttggaagttcaaagcttggtggatcagagattgttgaatacctaaaaggcctagcatatcttttggtaacaacataaaagataaatcataacaactgatatatgtcttacattttggggaaaaaaaactagatataaatcttgttgatcaactacctgtttattgggggtacatcagcttggctgatagaatctccataacttgctttttcaatttagcaggaagcatctgtatgtttctgtgtctataattgtgtgaaacttgataattaattgttttagattttatgaacttgtgacttaggctgaggtct

SEQ ID NO: 451 - DNA, 662 bp, Glycine max
atattgtgcggcaagtgtctcatcacgtctcgcgatctcttcaaaggcgaaggggaaggcttcaggggtttgaaaaaggttgatattgaagccatggttcttgactccattctgacttctcctcgtctcaagtctccatctttcaggaggcagtttacaaaggatgaactgggtagttggtccacactttttcagaggcatcgcttcctcttatctgctcttgttctgctaactctcctctgcactgtttatctttactttgctgtcactttaggggccagtggcacctgttccgggttgactggagcccagaaagcttcatgccatatggagcttgttaaggattctgtggccaagggtaaactgaagattctttgatatttcaaaatattattacaagaaaatttttttctttattttgtgcctgagtataggtgacatgaaatccaaatatagtctctggctacagtatcagtgtgactgtgatttgtatacatactatttatcttggtatttgtgggccaaaatgtagaatacatgtagaaagcaatttgttagatacatcatgttaattttagtgattgcttcattgagataaatttgtgggcatcttagttgctaaatgaagtttgagtctctgcttatgtgtaaattatgggcgg

SEQ ID NO: 452 - DNA, 1349 bp, Glycine max
aactctgcaccatccattcactatattttgctgtgtctatatatatttatagttccatcaatcagtttcccctgcactgcaaaaaaaagtgaaaggctgttacacactgccaccaaagaccaacccttttttcctccattttgccttgccccaaatcagagtttttttttccccaaacacacactcacaattggtggttgagtgcttcttctcaaaatgggtgagaaagatgatgagtttgggttgagtttgagtttgagtttggggggagtgaatcaacaacaacaacccccttctttgaatcatatgcaccagcctcaacaacaacaacctgttcccatgaatcacaataagactctctttggtgatttgtttcagttaccagatcggagctccgatatggtacgaggaatcgacgttaattcggcggcggagtacgatggcgtttcctcgccgaacagcgccgtctcgagcgtgagcggcggcggcaagcagagcgagagggacgacgataatgccgccgccgtggctggtgagaggacctcgtgctcgcgagggagcgacgacgatgacggtggtggcagcgactccgcgaggaagaagctgaggctgacgaaagaacagtccatggtgttggaagaaacgttcaaggagcacaacaccctgaatccgaaacggaagcaagcgttggcagaggagttgaatctgaagcccagacaagtagaggtgtggtttcagaacagaagagcaaggactaagctgaagcaaactgaagtggattgtgaatacttaaagaaatgctgtgagaatttaactgaagagaatagaaggttgcacaaggaggttcaagagcttagggcactgaaattatccccacaaatgtacatgcatatgaaccctcccaccactcttacaatgtgcccttcttgtgagcgtactcactcctctgcatcctcctcccctgctaccatccactcaacagtggcggcggccacctctagcaattgcaaactgcttggtgcaaacatccggcggccggtgcccgtcaacacttggccatttgaaggcccaattccccggccataattggttgagggcaatgtgatatttataatgatgtctagacatttttagttactagacatgtatgcatgaaaagaaaaaaacaaattacaacggaacactaatttgtggtttttgtttggaatcaaggatgtgagtttggatttggttaactcttcaatgaagggttgttctattttgtgtatgctataagttctagctagtcaacttcaagatttgtgtagggtagatatgttaccggtggggtaaggtttcaaatgccgaat

SEQ ID NO: 453 - DNA, 1489 bp, Glycine max
cagcatcgcagttacagagaaaaagagagagagagagagagagaaagtgtaatggcaatggcaacaatgggagagagtccacgaagcccagaagcgaagttggggatgcgagtggaggatctttgggacgttcaggagccacagttgagtcccactgagaagctcaacgcttgttttgaaagcatccctgtctctgcttttcctttggatccttcaaacacagaaattgagattaaatcagacgcgaccctagcagatgctgttaagatattggcgcgacacaacgtattcagcgcacctgtggtggatgttgaggcgcctgaagatgctagttggatggatagatacatcggaattgttgagtttgctggaattgttgtatggattttgcatcagtctgaacctacatctcctaggtgtccatccactccatccagtgcaagggctattgcagctgcagctaatggagcggcttttgctctagaacttgaagccttaggcctcggatctgctgcaacaactgcaggaaacttttttgaggatctcacttcttctgaactttataagaataccaaggttcgtgatatttcagggacattccgctgggcgccgtttcttgctttagagagatcaaactcatttctaaccatgctcttgctgctttctaagtacaagatgaagagtgttcctgtgttggatttaggctctggtacaattgataacattattacacaatctgctgtgattcatatgctggcagaatgcgctggacttcagtggttcgaaagttggggaaccaagaagctatctgaagttggtcttcccctggtgacaggaaatcaaatcatcaaggtttatgaggatgaaccagtcctccaagcatttaaagtaatgaggaaaaagagggttggaggggtgcctgtaatcgaaagagagaccaaaaaggcagttggtaatataagtttgcgagacgttcaattcttgctaactgcaccagaaatctatcatgattatagaggtattacagtaaagaacttcctgactgaggttagaagctacttggagaagaataaaaatgcatccccaatgttaagtgaatatgtcacatgcaaaaaggactgcacaatcaaagaattgattcagctgcttgatcaagagaagattcatagagtctatgtagtggaggatgatggggatctgcaaggactaatcacactaagagatatcatctcaaggctagtacacgaaccgcgtggctattttggtgatttctttgatggcgttctaccgctgcctgcaaacaccagagtttaacaggcaaggttacaagggagaataacctgctggtgcagctttttcttttttgtttttgaaatatttttttcaagtaaaaagggaaaaaaaatacaaatagatctatgtgcttctcttcagggttgaagacgagtggttggatctttatataacgtgtaggcagtttgcaagttaa

SEQ ID NO: 454 - DNA, 389 bp, Glycine max
gaagaagatgggtttgaagaacaacatggtggtgctaaaggtgtgtttggtgctacttttccttgtggggggtactactagtgccaacttgaggctgagtaagcttggcctgctcatgaaaagtgatcatcatcaacactcaaatgatgatgagtcttcaaaaccatgctgtgatcaatgcgcatgcacaaagtcaaaccctcctcaatgccgctgttcagatatgaggctgaattcgtgccattcagcttgcaaatcttgtatttgcgcattatcgtatcctgcacagtgtttttgtgttgacataaccgatttctgctatgaaccttgcaagcccagtcaggatgacaaggaaaactactaatgaacaagtgttatgcatgtaagct

SEQ ID NO: 455 - DNA, 1029 bp, Arabidopsis thaliana
ttgttgctctctctctcttctcaccttgatatttttcagagagggagagatgatttccgatcattgctatgtcgtccggatttcttcgtcaaggccgtccggtttgtcaaccggcttcagcccgacatccatatgcctcttgtgatgtggtttgtcggttactttcccggaatcttctggctcctttagcagaattgtccggtgtcgccgtcctccatcggttggttcctctaccaacggtggttggctcttgtctagcttctccgtcgtccctctccggcggtttaggctagcttttggccggatttcttttccggttttgttttatgttctcgttttctatagatccagtttgattttgctcctttgtgttctaactcttagagggctcaattccttgaacctcctttgtttaaagggctcaatttgtttttcaagcttatcgatttcaattatataagaacaaattagagttgtggattggggttttctctagtgcctttgagttgggttttatgcaattgagtcaattgtcatattggtttttggaaacgagtgtttttattttacttttaggtgttcatggaagttccattggcttaagttctacgctgatgtcgtttgaagatcatgatatgactacccaggggagattttcctttgcgaattcgaagatgaagaagattgatgggattctctgaatttggtgttgctccatcggacaagcttgaagtcttggtggttcctggtagttttggagttccctgcgatgactaaccaaatcggcggtggccgtgataacaaatgtttcttctgcccacgtgcttcaacctcgcttgataacttacatgtggttttgcgttggactacatcaattacttcctaaaagggtttcttatttcaactgggctttcttttagttgggcttttatctttattttgtttttgtctgcagtctgaaagttgagtttccactcttgtaacctttacaatctttggtttaaataatagccaacacttatgagaaaa

SEQ ID NO: 456 - protein, 395 aa, Arabidopsis thaliana
MSNSRMNGVEKLSSKSTRRVANAGKATLLALGKAFPSQVVPQENLVEGFLRDTKCDDAFIKEKLEHLCKTTTVKTRYTVLTREILAKYPELTTEGSPTIKQRLEIANEAVVEMALEASLGCIKEWGRPVEDITHIVYVSSSEIRLPGGDLYLSAKLGLRNDVNRVMLYFLGCYGGVTGLRVAKDIAENNPGSRVLLTTSETTILGFRPPNKARPYDLVGAALFGDGAAAVIIGADPRECEAPFMELHYAVQQFLPGTQNVIEGRLTEEGINFKLGRDLPQKIEENIEEFCKKLMGKAGDESMEFNDMFWAVHPGGPAILNRLETKLKLEKEKLESSRRALVDYGNVSSNTILYVMEYMRDELKKKGDAAQEWGLGLAFGPGITFEGLLIRSLTSS

SEQ ID NO: 457 - protein, 219 aa, Arabidopsis thaliana
MASPTLTLLLLLTTVSFFISSSADPDMLQDLCVADLPSGIKINGFPCKDAATVTSADFFSQGLAKPGLTNNTFGALVTGANVMTIPGLNTLGVSLSRIDYAPGGLNPPHTHPRATEVVFVLEGTLDVGFLTTANKLISQSLKKGDVFAFPKGLVHFQKNNGDVPASVIAAFNSQLPGTQSLGATLFGSTPPVPDNILAQAFQTSPGTVKHIKSKFQPKK

SEQ ID NO: 458 - protein, 408 aa, Arabidopsis thaliana
MIFVDVLWKLFPLYSFGSGRDSLSESILQIIPETMASSTTKILCDAGESDLCRDDSAAFLLKFVAIASILLAGAAGVAIPLIGRNRRFLQTEGNLFVAAKAFAAGVILATGFVHMLAGGTEALSNPCLPDFPWSKFPFPGFFAMVAALATLLVDFMGTQYYERKQERNQAATEAAAGSEEIAVVPVVGERVTDNKVFGEEDGGGIHIVGIRAHAAHHRHSHSNSHGTCDGHAHGHSHGHMHGNSDVENGARHVVVSQILELGIVSHSIIIGLSLGVSQSPCTIRPLIAALSFHQFFEGFALGGCISQAQFRNKSATIMACFFALTTPLGIGIGTAVASSFNSHSPGALVTEGILDSLSAGILVYMALVDLIAADFLSKRMSCNLRLQVVSYVMLFLGAGLMSALAIWA

SEQ ID NO: 459 - protein, 348 aa, Arabidopsis thaliana
MGEASRQQRAWNREMTVTTNLSLDIDKYPRDLLRGFMSENGGGRVFHGGETNCDDESTIELNLGLSLGGRFGVDKTPRKLKRSSSVLDTVPFNDSTVAEPENYTVGLERTTSLPAEMEEEWRKRKEMQSLRRMEAKRRRCEKQSFRVGNSDDQTVSFENERWVTASKSGFLQRHLVSSNRQVCGVDSDGGGATGGGSSSSLSELDNKNQQGSSNSCNDERSPKIVAGCSSNSGSQGTERPSVTRANKVNENENEKRVRSEDSVDRKGKGMATSTGLVDMPCVFTKGDGPNGRRVDGILYKYGKGEEVRIMCICHGSFLTPAEFVKHGGGGDVDRPLRHIVVNTSSSTF

SEQ ID NO: 460 - protein, 233 aa, Arabidopsis thaliana
MPRSSLRLLAKPLLESRRGFCTSSDKIVASVLFERLRVVIPKPDPAVYAFQEFKFNWQQQFRRRYPDEFLDIAKNRAKGEYQMDYVPAPRITEADKNNDRKSLYRALDKKLYLLIFGKPFGATSDKPVWHFPEKVYDSEPTLRKCAESALKSVVGDLTHTYFVGNAPMAHMAIQPTEEMPDLPSYKRFFFKCSVVAASKYDISNCEDFVWVTKDELLEFFPEQAEFFNKMIIS

SEQ ID NO: 461 - protein, 200 aa, Arabidopsis thaliana
MESSEDVENLSRAIEKLLHEKRKREASGDAFIEDADDQLFLSSLISQLESPNPKGKEDVITGEEEEKEEESADSSPSKGKSEGQRQLEESIEEIAKDIKKVKKQNKITHVLLSATIILTLVWQLSEYSMIFMLKDRISHPVRSIGGMLNGMFKGKLRPIKNQLAGTSNSNDQNNHGNGSHTGPQLQVPELLREFGFDDEE

SEQ ID NO: 462 - protein, 700 aa, Arabidopsis thaliana
MANLPILQFEEKIVETVEKNSVVVIIGETGSGKSTQLSQILHRHGYTKSGVIAITQPRRVAAVSVARRVAQELDVPLGEDVGYAIRFEDRTTSKTRIKYLTDGVLLRESLSNPMLDDYSVIILDEAHERSLNTDILLGLVKRLVRIRASNFKVLITSATLDGEKVSEFFSGCPVLNVPGKLYPVEILYSKERPVSYIESSLKVAIDIHVREPEGDILIFMTGQDDIEKLVSRLEEKVRSLAEGSCMDAIIYPLHGSLPPEMQVRVFSPPPPNCRRFIVSTNIAETSLTVDGVVYVIDSGYVKQRQYNPSSGMFSLDVIQISKVQANQRAGRAGRTRPGKCYRLYPLAVYRDDFLDATIPEIQRTSLAGSVLYLKSLDLPDIDILKFDFLDAPSSESLEDALKQLYFIDAIDENGAITRIGRTMSDLPLEPSLSRTLIEANETGCLSQALTVVAMLSAETTLLPARSKPSEKKRKHDEDSNLPNGSGYGDHIQLLQIFESWDRTNYDPVWCKENGMQVRGMVFVKDVRRQLCQIMQKISKDRLEVGADGRKSSSRDDYRKLRKALCVGNANQIAERMLRHNGYRTLSFQSQLVQVHPSSVLSADNDGMMPNYVVYHELISTTRPFMRNVCAVDMAWVAPIKRKIEKLNVRKLSGGPAPSFKVPEEKTELSKNNAETPAVSENVESRIEAARERFLARKGQK

SEQ ID NO: 463 - protein, 600 aa, Arabidopsis thaliana
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQHVIAKERKGDYLGKTVQVVPHVTDAIQDWIERVAVIPVDGEEDPADVCVIELGGTIGDIESAPFIEALGQFSYRVGPGNFCLVHVSLVPVLNVVGEQKTKPTQHSVKGLRGLGLTPDILACRSTKPLEDNVKEKLAQFCHVPLEYIFTLYDVPNIWRIPLLLKDQKAHLAISKVLNLASILNEPSLGEWTSRAELCDNLHVPVRIAVVGKYTGLSDAYLSVLKALLHASVACRKKLVVDWVPACDLEKETEKENPDAYKAAWKLLKGVDGILVPGGFGDRGVEGKILAAKYARENKIPFLGICLGMQIAVIEFARSVLSLQDANSTEFNPETKHPCIIFMPEGSKTHMGGTMRLGSRKSIFNVKDSKSAKLYENKSFVDERHRHRYEVNPDMVERLEKAGLSFAAKDETGKRMEIIELPNHPFFIGAQFHPEFKSRPGKASPLFLGLIAASCGELDTVLNPASAHQHSISNGPTNIFINGTSKKSPNGLADVRYNNGYCNGLYTR

SEQ ID NO: 464 - protein, 527 aa, Arabidopsis thaliana
MASLSLPITLKNPRFFSSSPQNIFKTQPQTLVLTTKFKTCSIICSSSCTSISSSTTQQKQSNKQTHVSDNKREEKAEEEEEEKEVSLREIWREVQGCNNWEGQLDPMNNHLRREIIRYGEFAQACYDSFDFDPHSKYCGSCKYHPSDFFLNLDLHLHKGYTITRYLYATSNINLPNFFQKSKLSSIWSQHANWMGFVAVATDEEEVSRLGRRDIVIAWRGTVTYLEWIYDLKDILCSANFGDDPSIKIELGFHDLYTKKEDSCKFSSFSAREQVLAEVKRLIEYYGTEEEGHKTSITVTGHSLGASLALVSAYDIAELNLNHVPENNYKIPITVFSFSGPRVGNLRFKERCDELGVKVLRVVNVHDKVPSVPGIFTNEKFQFQKYVEEKTSFPWSYAHVGVELALDHKKSPFLKPTKDLGCAHNLEALLHLVDGYHGKDEEAEKRFCLVTKRDIALVNKSCDFLRGEYHVPPCWRQDENKGMVKNGDGQWVLPDRPLLEPHGPEDIAHHLQQVLGKVNDDNFKPTTT

SEQ ID NO: 465 - protein, 326 aa, Arabidopsis thaliana
MSRSLVFFFLFLVLVVPCLSHGTGGDHDDDEASHVKSSDLKSKSLISVKIACLVIIFVLTFISGVSPYFLKWSQGFLVLGTQFAGGVFLATALMHFLSDADETFRGLLTAEGESEPSPAYPFAYMLACAGFMLTMLADSVIAHIYSKTQNDLELQGEDKSNQRSATTETSIGDSILLIVALCFHSVFEGIAIGISETKSDAWRALWTITLHKIFAAIAMGIALLRMIPDRPLFSSITYSFAFAISSPIGVAIGIVIDATTQGSIADWIFALSMSLACGVFVYVSVNHLLAKGYRPNKKVHVDEPRYKFLAVLFGVVVIAIVMIWDT

SEQ ID NO: 466 - protein, 421 aa, Arabidopsis thaliana
MYVTRTLSQFRKYQKTLSEESPEGPFSGVLVITDEEAETEDTFCFGMCTRTKIEKLPLPQDKILSVVHLDSSGNRETSVKKVLFIPALDQPLSSNRYYVVHARGRHKGKVSVCSREIEKGVCCFPDILHDKKPKPLDPRNIYQTVKINRHHDRTFYAKSVAPDGTPPTFLKKKGWELRTSRSLHPRRPREALGLDEELRARLPAFGFPVSTIRSGSVIVGEWYCPFMFVKENCSVSQQMRKSMFYRITLSQYWERIYHCGNNDLDENNDENEEEVVRVEANVVREANYVKGMEAVKGEKEGHGGFYWYRQVQGPRGPGERRRKTGLRSPVGLSFVVVERMRRVMEEGGWVGGGRKVVRVERDEPIRVCRRDGRNMNGNNDRNWRRFGCYVLVESFGLRRADGVLLVKCVFRHTNRLRCNWE

SEQ ID NO: 467 - protein, 346 aa, Arabidopsis thaliana
MALKSKLVSLLFLIATLSSTFAASFSDSDSDSDLLNELVSLRSTSESGVIHLDDHGISKFLTSASTPRPYSLLVFFDATQLHSKNELRLQELRREFGIVSASFLANNNGSEGTKLFFCEIEFSKSQSSFQLFGVNALPHIRLVSPSISNLRDESGQMDQSDYSRLAESMAEFVEQRTKLKVGPIQRPPLLSKPQIGIIVALIVIATPFIIKRVLKGETILHDTRLWLSGAIFIYFFSVAGTMHNIIRKMPMFLQDRNDPNKLVFFYQGSGMQLGAEGFAVGFLYTVVGLLLAFVTNVLVRVKNITAQRLIMLLALFISFWAVKKVVYLDNWKTGYGIHPYWPSSWR

SEQ ID NO: 468 - protein, 695 aa, Arabidopsis thaliana
MKLHQFLVFLFLFLSCFALSSWALPLCSDSRAPSEVNSTLSFCPYKGKTCCNTMKDTSLMKQFQAMNISDKGCASVVKSILCANCDPFSSDLFRDNSDQQSVPILCNSTSSANSTENFCSETWETCQNVSISGSLFAASLQGRAGAPSNKNASKLADLWQSKTDFCSAFGGASSNETVCFSGEPVALNDNDTTPDKPPSGICLEKIGNGSYLNMVPHPDGSNRAFFSTQPGIVFLAGIPDQDSGGVLDVDPSSPFVDMTDEIHFDTEFGMMGMAFHPKFAQNGRFFASFNCDKSKWPGCTGRCSCNSDVNCDPSKLTPDSGSQPCQYQTVIAEYTANSTSSDPSKAKNAKPTEVRRIFTMGLPFTSHHAGQILFGPDGYLYFMMGDGGGGADPYNFAQNKKSLLGKIMRLDVDNIPSASEISKMGLWGNYSIPKDNPFREDKELEPEIWAVGLRNPWRCSFDSSRPSYFMCADVGQDTYEEVDLISKGGNYGWRVYEGPDLFHPESSPGGNTSVKSLNPIFPVMGYNHSEVDSSGKSASITGGYFYRSETDPCIAGRYVYADLYGNGVWAGIETPANSGSFVTKRTTFSCASDSPMKCSDSPGTSGLSLGYVFSFGEDNNKDIYLLTSNGVYRVVRPSRCNLTCSKENSTARRNPGTSSSPSSSSSSCYKHINGFHGSLVVLFVSLSLILLGLLN

SEQ ID NO: 469 - protein, 339 aa, Arabidopsis thaliana
MSMLMAVKTTSLCCSSLNLTASPTFRRNPRAARLVNPTARIQTRFHRLIEEQGIVLMPGCYDALSAAIVQQTGFSAGFISGYALSASLLGKPDFGLLTPPEMAATARSVCASAPNIPIIADADTGGGNALNIQRTVKDLIAAGAAGCFLEDQAWPKKCGHMRGKQVIPAEEHAAKIASARDAIGDSDFFLVARTDVRATSAKSGLEDAIARVNLYMEAGADASFVEAPRDDDELKEIGKRTKGYRVCNMIEGGVTPLHTPDELKEMGFHLIVHPLTALYASTRALVDVLKTLKENGSTRDHLQKMATFEEFNSLVDLDSWFELEARYSNLRNALGTTKS

SEQ ID NO: 470 - protein, 311 aa, Arabidopsis thaliana
MGDNNPNRSEAERLLGIAEKLLESRDLNGSKEFAILAQETEPLLEGTDQILAVVDVLLSSAPENRIKNQPNWYKILQIEDLTESSTDNDLIKKQYRRLALLLHPDKNRFPFADQAFRFVLDAWEVLSTPTKKSQFDGDLNLIFTKVNLNTQKSKKKTTTNEKMSTFWTACPYCYSLHEYPRVYQEYCIRCQNCQRAFHAASIPQLPPLIPGKDEYYCCWGFFPMGFVGGKGGEAAIANGVDAAKFPNWMPPVFSSGGVAAPPSGNGVSFDGWSGGAAKRDNEAVRSNNGVGVNSDGTPKKRGRGRPKKNPV

SEQ ID NO: 471 - protein, 439 aa, Arabidopsis thaliana
MRADNDHALGNSIEICKDESKPHQCLDENWEDAELKVPENGKNNNNVCELFYDTRSGEEWENEAGKKVRDTSHDCDANVDSPEKKDPVFYMDKNVTACDLPEIVVCYKENTYHIVKDICVDEGVPVQEKFLFGEKDSVKSSSTEDLMKADKTNVNPSETKSAEDSISKVDDSEFCNDHKTDRDVEESSGEDFADAEGTSSNYNQEHLIVTEEVKASPTHGLSPSEIEPDENSKDEVAISQDNDSKECLTLGDILSREDEQKSLNQDNISSDSHEEQSPSQLQDKEKRSLETTAIETELEKTEEPKQGEEKLSSVSTTTSQEPNKTCNEPEKPETENHHQQNCLVENSYEDDKFSSSRFGETSFSAADSVSISGHITYSGPIAYSGSLSVRSDASTTSGRSFAFPILQSEWNSSPVRMAKADKRRQKGGWRHTLLCCRFS

SEQ ID NO: 472 - protein, 140 aa, Arabidopsis thaliana
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDEIKVDKETLEMLASLGMSDTSGISAVEPQQAMAPIAAFGGRAPRRY

SEQ ID NO: 473 - protein, 119 aa, Arabidopsis thaliana
MMSEFAPISIYLVISLLVSLILLGVPFPFASNSSTYPEKLSAYECGFDPSGDARSRFDIRFYLVSILFLIPDLEVTFFFPWAVPPNKIDLFGFWSMMAFLFILTIGFLYEWKRGASDRE

SEQ ID NO: 474 - protein, 338 aa, Arabidopsis thaliana
MAGKEETDVSAQGSLTREATEIWRSELESRRFQVDSLEAELVDVKAYLEFGSEEDARKELGVLSGRVRSTATMLRYLRSKARVLAIPDDLANVSCGVEQIEELKGLNLVEKDGGSSSSDGARNTNPETRRYSGSLGVEDGAYTNEMLQSIEMVTDVLDSLVRRVTVAESESAVQKERALLGEEEISRKTIQIENLSVKLEEMERFAYGTNSVLNEMRERIEELVEETMRQREKAVENEEELCRVKREFESLKSYVSTFTNVRETLLSSERQFKTIEELFERLVTKTTQLEGEKAQKEVEVQKLMEENVKLTALLDKKEAQLLALNEQCKVMALSASNI

SEQ ID NO: 475 - protein, 194 aa, Arabidopsis thaliana
MSSVCGKLDFKDADFDISTSSPTQCSKGSEHTSFTGSEDSQESDGDETGYIDPTVNDETAVQDFGKSVLSPNSSDDEDKDENLMTQTPIVLIPAIKGSREKYGLSLRKSSVSWGADVYDPPPSIASHTVTRSKKQQQKSKSKDNHRKTGKKGQKSKDNSSSRGGSSKDKKQASRKHSRDKFDWVTQMPIVAASS

SEQ ID NO: 476 - protein, 240 aa, Arabidopsis thaliana
MAPRGRRKKAGLMREDAARDRMRGFGFHEHVISESIKELLEVYEDQWFLIEDDSYGPLLAICLEKQEEKEKQLAEVQANQLPENHNEEMAEEEQPNQLAVEIHEEEKEQEQDMHIEYGRDQADELSINSEAVNDPSPAAIHLGEASSDYAQSSVRGVENLHCGWLIDEEETDPEEETDPEEKETEPEDPKEKETEPEEDSDGDDDEIIQLTPEPLCEELQELLREVRGQKRRKKEMRWDK

SEQ ID NO: 477 - protein, 259 aa, Arabidopsis thaliana
MLIKTVSSSSSSALSLVNFHGVKKDVSPLLPSISSNLRVSSGKSGNLTFSFRASKSSTTDALSGVVFEPFKEVKKELDLVPTSSHLSLARQKYSDECEAAINEQINVEYNVSYVYHAMYAYFDRDNIALKGLAKFFKESSLEEREHAEKLMEYQNKRGGRVKLQSIVMPLSEFEHVDKGDALYGMELALSLEKLVNEKLLNLHSVASKNNDVHLADFIESEFLTEQVEAIKLISEYVAQLRRVGKGHGTWHFNQMLLEG

SEQ ID NO: 478 - protein, 133 aa, Arabidopsis thaliana
MTFKRRNGGRNKHNRGHVNPIRCSNCGKCCPKDKAIKRFIVRNIVEQAAIRDVQEASVYEGYTLPKLYAKTQYCVSCAIHSHVVRVRSRTNRRVRTPPPRFARRKEDTPKPGQPGQAPRPAGPGAAAAAAPRV

SEQ ID NO: 479 - protein, 232 aa, Arabidopsis thaliana
MDALGGCGGAGGFWGWNGFDQRRKKKSSGDRGKKRNSGSSDSVDVSRDAGGYRFPLKQAVTAGALTFTGDTIAQLSGRWKKRTALKQSSSELDEGELWNIFSEHDWIRALRMSSYGFLLYGPGSYAWYQFLDHSLPKPTATNLVLKVLLNQVILGPSVIAVIFAWNNLWLGKLSELGNKYQKDALPTLLYGFRFWVPVSILNFWVVPLQARVAFMSMGSVFWNFYLSSTMSK

SEQ ID NO: 480 - protein, 164 aa, Arabidopsis thaliana
MAMEVATPAPAPIPSERNIVLAPATTTTTATVETHKKNRIQVSNTKKPLFFYVNLAKRYIQQHNEVELSALGMAITTVVTISEILKNNGLATEKKVLTSTVGMKDETKGKMVQKAKIEIVLGKSDKFDSLVPPVTNGKTPEEEASAETEASVEAQEEVAAATEV

SEQ ID NO: 481 - protein, 463 aa, Arabidopsis thaliana
MGRTCLPRWRLGRLMAGLQVILGLLVITVSLSCLYRFHSVGYFLQNEDTCNNIYTIKEVSSEGFDLKALHDRVDEVLEKMDNLYEKLEKTVKDMEKSKDGSKKEMKKFLEDEVMKPFYYAHIGLRQIRLPKPEGIRNSTEKEEPLINKFLIEEIRQYITPKENRVGKINMFGTERVYNTIGHACALMKMELEKYMDYDVGAYCDDDWNLAQKLMLNGCDPLPRRRCLTRASMTYQKPYPINESLWKLPDDRNVRWGNYQCRNFACLSSKNPKRGYTKCSGCFEMEKEKDKWVKNSSLLVDFMIEDVLRVKPSEIRIGLDYGVGTGTFAARMREKNVTIVTTALNLGAPFNEMIALRGLIPLYISLNQRLPFFDNTMDMIHTTGLMDGWIDLLLMDFVLYDWDRVLRPGGLLWIDRFFCKKKDLDDYMYMFLQFRYKKHKWAISPKSKDEVYLSALLEKPPRAI

SEQ ID NO: 482 - protein, 460 aa, Arabidopsis thaliana
MVVSDGGKRVKLNVGGEIFETNASTIQSSCPDSLLAALSTSTSHGSNPVFIDRDPEIFAVILNLLRTGRLPANSSGVFSKQELLDEAMYYGVESLLRLAMLPPPLLGFDASLVSTIVPAADGVPSALTATAGDASLWIAHGGQISVYDWSLSHAGTVRTHLNDITSICRVWGEAAAIGSGSASGLHFYDLSGGRYIGSTHWTDPEDPRIHKARVAAVADSEGGVFASFDCLHRENSVLQIDKSTLQVAAVIGQQSGNSAKTTVPEKLRWLPAKGLLVGSAVQRGVFGCSGYIRIWDPRSRNIVWETNEPGSGRSTRFGDALADMDVDVEDSILFKVCSKSGDLGMADIRKLGEDPWVYMSDENPGAWKAGDGGGYSVVHCYRKQVLAARGGALEVWSSVKEKTSGDPIRRRNFVDKEDDSKRGMISKIEAGGDRLFVSRECMEGVEVWETSSFSGVVSVE

SEQ ID NO: 483 - protein, 432 aa, Arabidopsis thaliana
MAIKDLTATTGDSSLPLIKSPPSETTGGDRTSALQTLGNIIVSIVGTGVLGLPYAFRIAGWLAGSLGVIIVGFATYYCMLLLIQCRDKLESEEGEEESKTYGDLGFKCMGTKGRYLTEFLIFTAQCGGSVAYLVFIGRNLSSIFSSYGLSMVSFILILVPIEVGLSWITSLSALSPFSIFADICNIIAMCFVVKENVEMVIEGDFSFSDRTAISSTIGGLPFAGGVAVFCFEGFAMTLALESSMREREAFPKLLAKVLAGITFVYVLFGFCGYMAYGDQTKDIITLNLPNNWSAIAVQIGLCVGLTFTFPIMVHPLNEIIEQKLKRIDWLQKHHNGYSNETGSVSKFAIFTTRTLLVVGLAAIASLVPGFGTFASLVGSTLCALISFVLPASYHLTLLGPSLNVWNKSIDVFIVICGLIFAVYGTYNTIVGV

SEQ ID NO: 484 - protein, 643 aa, Arabidopsis thaliana
MSAVSFLYSSKTPKFRGVFNGICALVLFCFFFDRSELLRNPLLRNASFVNGGSGSTSGGITQFMVIRRNARQIETNGSGNNSSLSSSSTVLCSGLHKHMGYADQCEFLKANPICSPDGFFDYLSFFYCSCRDFSILGYMMLGVWLVALFYLLGNTAADYFCCSLEKLSKLLRLPPTVAGVTLLPLGNGAPDVFASIAAFVGTDKGEVGLNSVLGGAVFVTSVVVGIVSLCVADKEVKIDKNCFIRDLSFFLFSLVSLLVILMVGRVTVRIAIAFVSIYVVYAFLVAANVILRKHAKRFKLEALTPLLPMQGSVFSPSVGEDMPMNTPLIETETEDGPPRLQSLPQWMWASNVAIYSNHFAKVSVHDEDRPPWGWIDDTAEVESSSCTKFTSLLEIPLTIPRRLTIPSVEEDTWSKTYAVASVSLAPVLLASLWSSQDDVSLQACGVAYFFSVVIGSTLGFLAYKNTEPDHPPRRFLIPWVLGGFIMSIVWFYMIANELVALLVTFGEIYGINPSILALTVLAWGNSMGDLVSNIALTMNGGDGVQIALSGCYAGPMFNTLVGLGMSMLFGAWSKSPDTYMLPEDKSLFYTLGFLVLGLVWAMVILPRNDMQPSRTLGVGLIAIYLIFVTFRLSCAMGFIPWAA

SEQ ID NO: 485 - protein, 220 aa, Arabidopsis thaliana
MELVEETIPKEGKKMGERIVVDKAYLYQEDKPLTVCKTSLFYTGDGFAAYDCRGDIIFRVDSYGPDTRDNDEIVLMDATGKCLLTVKRKRPTLHQRWEGFLGERSEGQKPIFSVRRSSIIGRCTMEVEVYDGTGEEYIIDGDFSQRSCLIYDTKKCTVAEIKRKVDASTNVMLGRDVFTLEIKPGFDGAFAMGLVVVLDQINGDDPVEIGDEQVHPFVED

SEQ ID NO: 486 - protein, 567 aa, Arabidopsis thaliana
MEGTDDASALQEPPDPEVLEVDPTFRYIRYKEVIGKGAFKTVYKAFDEVDGIEVAWNQVRIDDVLQSPNCLERLYSEVRLLKSLKHNNIIRFYNSWIDDKNKTVNIITELFTSGSLRHYRKKHRKVNMKAVKNWARQILMGLRYLHGQEPPIIHRDLKCDNIFINGNHGEVKIGDLGLATVMEQANAKSVIGTPEFMAPELYDENYNELADIYSFGMCMLEMVTFDYPYCECKNSAQIYKKVSSGIKPASLSRVKDPEVKQFIEKCLLPASERLSAKELLLDPFLQLNGLTMNNPLPLPDIVMPKEGAFGDRCLMSEGPPTTRPSKTLSIDLDEDSNLPIVTFSDNSGSRCIEVRRAKRGNFFVLKGEENDEQSVSLILRIVDENGRVRNIHFLFYQEGDTASKVSSEMVEQLELTDQNVTFIAELIDILLVNMIPTWKTDVTVDHLIHSQLNQNSRSHHNEAKPQKQEETVFHDTCELVSHSCNSDCPRSDEEDKQCVDATKGEDKSSIQEVEEATEPVSLEEEERLRQELEEIEAKYQEDMKEIATKREEAIMETKKKLSLMKLK

SEQ ID NO: 487 - protein, 422 aa, Arabidopsis thaliana
MGVDLRQVVAGILTITMFVMLGQMLHRDYFDSLQEKAQGDAQDIEFEGSKVSVKDGLVGTVEGSKGLWMEDNTDLTPCWPTLLSDDAVSSKGYVTFSLTNGPEYHISQITDAVMVAKHLGATLVLPDIRGSKPGDERNFEDIYDADKLIKSLENVVKVVKKLPEEVSLRNMAIVKVPTRVTEDYIKEHIDPIFKSKGNIRVASYFPSVNLRKSSQDGETDPVACLAMFGSLELQPEVNAVAESMVERLRTHSRKSGGRFIAVDLRIDILEKKNCHTTGVVGSKTCYNAQEIALFLRKLGFASDTTIYLTQPRWDSSLNILKDIFPKTFTKEAIMPASKRSKYLESVSSEYENVIDFYISSRSDVFVPAISGLFYANTVGKRIALGKPQVLVPAEISETSGLATDFISPYISKKNHLAYSCFC

SEQ ID NO: 488 - protein, 108 aa, Arabidopsis thaliana
MSKPVLLVCLLVILIVTSQFEWRQPLVELDTATSSSQKQQQISDREEAVKEKIIISQERHIQRLNELVRSLQLQLLQCKGENETQNATKSYHINKQFIEVERKQILEG

SEQ ID NO: 489 - protein, 353 aa, Arabidopsis thaliana
MILLSSSISLSRPVSSQSFSPPAATSTRRSHSSVTVKCCCSSRRLLKNPELKCSLENLFEIQALRKCFVSGFAAILLLSQAGQGIALDLSSGYQNICQLGSAAAVGENKLTLPSDGDSESMMMMMMRGMTAKNFDPVRYSGRWFEVASLKRGFAGQGQEDCHCTQGVYTFDMKESAIRVDTFCVHGSPDGYITGIRGKVQCVGAEDLEKSETDLEKQEMIKEKCFLRFPTIPFIPKLPYDVIATDYDNYALVSGAKDKGFVQVYSRTPNPGPEFIAKYKNYLAQFGYDPEKIKDTPQDCEVTDAELAAMMSMPGMEQTLTNQFPDLGLRKSVQFDPFTSVFETLKKLVPLYFK

SEQ ID NO: 490 - protein, 353 aa, Arabidopsis thaliana
MAVAENAGVKVDSSGQNLDNNNTAASATETTKPPCPDDDQSPKSDSSTPLTIDSTPETDDRINETAQKVQTLNGFSGNGERDNNGEIKDLADAFSKLNPMAQEFVPPSLARSQSGVLRNGLGFTNNFAAPPKLADGNDHFPRRRRSFGQGKRRMNKRTSLAQKDDVIRRTVYVSDIDQQVTEENLAGVFINCGQVVDCRVCGDPNSVLRFAFIEFTNEEGARAALSMSGTVLGFYPLKVLPSKTAIAPVNPTFLPRSEDEREMCVRTVYCTNIDKRITQIDLKGFFEMLCGEVHRLRLGDYHHQTRIAFVEFAMAESAIAALHCSGIVLGALPIRVSPSKTPVRPHFPRAEFK

SEQ ID NO: 491 - protein, 953 aa, Arabidopsis thaliana
MTDGFRYNGFSGIAYPFWLSSPPPPTPPHHPASAPPFQQSNPVESYDPAKEVFDPMMLYHDSYQRSPANWSNNPSYRENSRSQTPSSSFYADNTQHGNSGLRGEDSSYKDMLSPSGFYSSRESSSDFVSLPPTENFSERQRLNFEPTYSSATLAPVSSYADMLIRNSQDSFFTPIASSGVYSSSNAVDEKRPGYYFLGSDRSETMNVVSASRVEPYMCDTDCNPSFPMPNFITQALFDGSQTGLRVGDGRSFPSNSDVCSHAPQNFLGAQSSLQSSSVEPVNFDVLLGYGEATGHIKPLPENPNLPYPVVGSQGSRSPRSSYPLPSIINSSVSLIKDEVEGSGVSSLYQRPYTLVADSENGVSESSLKNATEDLNCHEPRSWSHFMVTSEGPSAPTMFSMGSESGGPSAPTMKADNENAQSAGNYKPPFEGSTTQPSEDVPTNQESCNLQKQTFDIMDRDKKIRSLTDVGLDLSSRSNADDVSTGRSPERHFCDQGDFPSPTSYPRVSSVVNAMHNLSEVLVYECFNNGSWLKLEQLENLDKVVDNLTKCLKKITDNKTTAGEATLPTQSMHVTCPNVVDLHEAATGVAKDFQRFSVKPLDSFGVKEPVDKNEMTQSIKNILASNFPDGEENHPQTLLYKNLWLETEAALCSTTCMARYHRIKNEIGNLKLNNKEISADAVSFMQEPSLNTQKSVPIMNANADKDTPESIIKHGSNCGKNAATMSHDASESSRINSDPVDAVLSVMSRSFTGGLEQTIRGNLRPDDATFAKIPDAIWQETSASTTENKHREVIDRFQILKEQETERKLKSQKLPDSDIDVIDRFQILKQQETNRKLKAQKCPETKKGDQEDKLEGSVMANMGRSSDVSDVMDRFQILKRREAEQVKKSLNSMDVDSDSENDQPQKRDHLWSDSLFPIRGHSQRETCAADTEQSASGKGYESPTSDWEHVIKDD

SEQ ID NO: 492 - protein, 658 aa, Arabidopsis thaliana
MGTEDYTFPQGAEELHRRHHTVEAPQPQPFLKSLQYSVKETLFPDDPFRQFKNQNASRKFVLGLKYFLPIFEWAPRYNLKFFKSDLIAGITIASLAIPQGISYAKLANLPPILGLYSSFVPPLVYAVLGSSRDLAVGTVAVASLLTGAMLSKEVDAEKDPKLYLHLAFTATFFAGVLEASLGIFRLGFIVDFLSHATIVGFMGGAATVVSLQQLKGIFGLKHFTDSTDVISVMRSVFSQTHEWRWESGVLGCGFLFFLLSTRYFSIKKPKFFWVAAMAPLTSVILGSLLVYFTHAERHGVQVIGDLKKGLNPLSGSDLIFTSPYMSTAVKTGLITGIIALAEGVAVGRSFAMFKNYNIDGNKEMIAFGMMNIVGSFTSCYLTTGPFSRSAVNYNAGCKTAMSNIVMAIAVMFTLLFLTPLFHYTPLVVLSAIIISAMLGLIDYQAAIHLWKVDKFDFLVCMSAYVGVVFGSVEIGLVVAVAISIARLLLFVSRPKTAVKGNIPNSMIYRNTEQYPSSRTVPGILILEIDAPIYFANASYLRERIIRWIDEEEERVKQSGESSLQYIILDMSAVGNIDTSGISMMVEIKKVIDRRALKLVLSNPKGEVVKKLTRSKFIGDHLGKEWMFLTVGEAVEACSYMLHTFKTEPASKNEPWNNV

SEQ ID NO: 493 - protein, 484 aa, Arabidopsis thaliana
MDDCSKDIINCLPDNLLCQILSNLSTKEAALTSLLSKRWRYLFALVPNLDFDVLPSLHPEVAMQDQDQTSFIDFVDRVLKLRGKDHINKFSLKCGDGIEDEDVFPWILNTLRHGVSDLSLHVSPSLVYWLPSKVFASKTLVRLKIGPKDGPRVKLRNVCLPKLKTLNLDSVVFEEGKIGFAKLLSGCPVLEELSLLNLAWDRWDSCSVSSKILKRLTLYCAHSSRNPKSVSFDTPNVVYFEYSDNIANKYPKVNFDSLVEASIGIRMTKVQKANARYVSDVDEETEMVGNATDLLMGICNVKTLYLSYDTLETLNLCCQVIPVFNNLTHLTIESHPELGWESLPNLLKSCPNLGTLVFQGLLHKATDRCGDVCMCQGLENSHSCLSSSPVKCLKILKFGETNDDDDMEIEMEQIKNFLEKMPNLEQLIIYYESSIDNDLVRVSSQLQEVPTVASLKCKIQVISDNLSLSSTLPISLSMENGFHL

SEQ ID NO: 494 - protein, 703 aa, Arabidopsis thaliana
MEETFVPFEGIKNDLKGRLMCYKQDWTGGIKAGFRILAPTTYIFFASAIPVISFGEQLERSTDGVLTAVQTLASTAICGIIHSIIGGQPLLILGVAEPTVIMYTFMFNFAKGRPELGRNLFLAWSGWVCVWTSLILFVLAICGACSFINRFTRVAGELFGLLIAMLFMQQAIKGLVDEFRAPAREDLKLVEFLPSWRFANGMFALVLSFGLLITALRSRKARSWRYGTGWLRSLVADYGVPLMVLVWTGVSYIPTGDVPKGIPRRLFSPNPWSPGAYENWTVVKEMLQVPIVYIIGAFIPATMIAVLYYFDHSVASQLAQQKEFNLRKPSSYHYDLLLLGFLTLMCGLLGIPPSNGVIPQSPMHTKSLATLKYQLLRNRLVATARKSIKQNASLGQLYGNMQDVYNQMQTPLVYQQPQGLKELRESTIQATTFTGNLDAPVDETLFDIEKEIDDLLPIEVKEQRVSNLLQAVMVGGCVAAMPLLKMIPTSVLWGYFAFMAIESLPGNQFWERILLLFTAPSRRFKVLEDNHATFVETVPFKTIAMFTIFQTTYLLTCFGLTWIPIAGVMFPLLIMFLIPVRQYILPRFFKSAHLQDLDAAEYEEAPALPFHLAVPEAEMGSTASYPCDSEILDEFITRSRGEFRHTCSPKVTSSTSTPVYNRNLSQVFSPRVIDLRGEMSPRLSGKGQNSPKPSPLNPSSSSK

SEQ ID NO: 495 - protein, 343 aa, Arabidopsis thaliana
MLALGYAKEIAQRFLRNPKWTSRFFLLHYQSSNYSSYVKSRPFLQVQCKSASFDVSQAQRWNLFAYDGLFSRRYLSNSTIELRTDDNVVRFAFNNVSSSGNNVVPTRKEKKWKRAKLSRKAKVNELRFYRLKAKKKMNSPNPEVRIRYKLEKAKRKEEWLIEKLRKYDVPKSPAEPYDPESLTEEEQHYLKRTGEKRKNFVLVGRRGVFGGVVLNLHLHWKKHETVKVICKPCNKPGQVHEYAEELARLSKGIVIDVKPNNTIVLYRGKNYVRPEVMSPVDTLSKDKALEKYRYEQSLEHTSEFIEKLEKELEEYHKYVARHKKKKDEEAEKKKEAVSKSKVV

SEQ ID NO: 496 - protein, 215 aa, Arabidopsis thaliana
MSANSKSERSASQSAETVAVSNRVVASRSSRQPRLSFSSFAPSSEHDNLKKLKSDEISPAREEVPVSVKEREETEEEEAKRTWNLRPRKAYGGSKKGNGVFTAEVCGGGGGGGSEVKNQKSGAGIEPKSNRQRGIPAESPGLGGGEVANENHRLWVALARDEIEEDLFSMSGNRSSRRPRKRAKAMQKHLDVIFPGLGLVGMNADCFRVATSPAK

SEQ ID NO: 497 - protein, 386 aa, Arabidopsis thaliana
MDFNRKAHPDCVYADNPFHECASACLEKIAQGHVKKNTKKQSSRLLSFSGSFGRKKKESNSQPPTPLSARPYQNGRGGFANGNSPKVHHSVAPPASVKKKIVSETKNSFTSSSSGDPDDFFNHKPEKKPSQTIPLSSNNLVDQSKVVSPKPGIQEHNGKIGEGGETRLFSFLSLPRSPGKESNDDFSDDDDENNNEIGVELDLESVMSDTFVSVGKYRVRSGSSTILSAVIEKHGDIAQNCKLESDSMRSRYLECLCSLMQELRSTPVGQLSKVKVKEMLAVLKDLESVNIEVAWLRSVLEEFAQSQEDVENEKERHDGLVKAKREELEAQETDLVRMEKEVVEVKRRIEETRAQMVEIEAERLRMEKMGFKMEKFKGKSFIDELL

SEQ ID NO: 498 - protein, 384 aa, Arabidopsis thaliana
MGCVSSKLGKKKLIREIRVNNGGDHIVSLTSTTYGHLDLDERAETSPKSLEVTKGEVFESEIIPRRSIKRDDPEIINTWELMEDLEDSMHVSNPQKISPKSRGIFGKSWKTPVKSVVESPKRGSSKRFGGKENNSRGVSPNQILKPKNILETPKRGVMRLSFPLKSEESSVTVTQRRKSYSPMFDPDLVASYERELSQEKEQIKMVISPVVHESRKTEKTERILEKFPEKCPPGGEHSVVIYITTLRGIRKTFEDCNVVRSILDSHEVRFSERDVSMHSVFKEEIRGIMGTKHVKIPAVFVKGRMVGSVEEVMRLEEEGKLGILLEGIPAARLGGSCCRGCGGMRFMMCVVCNGSCKVREEEKKSMVKCLKCNENGLVLCPICS

SEQ ID NO: 499 - protein, 1622 aa, Arabidopsis thaliana
MAMQSLSPVPKLLSTTPSSVLSSDKNFFFVDFVGLYCKSKRTRRRLRGDSSSSSRSSSSLSRLSSVRAVIDLERVHGVSEKDLSSPSALRPQVANLEDILSERGACGVGFIANLDNIPSHGVVKDALIALGCMEHRGGCGADNDSGDGSGLMSSIPWDFFNVWAKEQSLAPFDKLHTGVGMIFLPQDDTFMQEAKQVIENIFEKEGLQVLGWREVPVNVPIVGKNARETMPNIQQVFVKIAKEDSTDDIERELYICRKLIERAVATESWGTELYFCSLSNQTIVYKGMLRSEALGLFYLDLQNELYESPFAIYHRRYSTNTSPRWPLAQPMRFLGHNGEINTIQGNLNWMQSREASLKAAVWNGRENEIRPFGNPRGSDSANLDSAAEIMIRSGRTPEEALMILVPEAYKNHPTLSVKYPEVVDFYDYYKGQMEAWDGPALLLFSDGKTVGACLDRNGLRPARYWRTSDNFVYVASEVGVVPVDEAKVTMKGRLGPGMMIAVDLVNGQVYENTEVKKRISSFNPYGKWIKENSRFLKPVNFKSSTVMENEEILRSQQAFGYSSEDVQMVIESMASQGKEPTFCMGDDIPLAGLSQRPHMLYDYFKQRFAQVTNPAIDPLREGLVMSLEVNIGKRGNILELGPENASQVILSNPVLNEGALEELMKDQYLKPKVLSTYFDIRKGVEGSLQKALYYLCEAADDAVRSGSQLLVLSDRSDRLEPTRPSIPIMLAVGAVHQHLIQNGLRMSASIVADTAQCFSTHHFACLVGYGASAVCPYLALETCRQWRLSNKTVAFMRNGKIPTVTIEQAQKNYTKAVNAGLLKILSKMGISLLSSYCGAQIFEIYGLGQDVVDLAFTGSVSKISGLTFDELARETLSFWVKAFSEDTTKRLENFGFIQFRPGGEYHSNNPEMSKLLHKAVREKSETAYAVYQQHLSNRPVNVLRDLLEFKSDRAPIPVGKVEPAVAIVQRFCTGGMSLGAISRETHEAIAIAMNRIGGKSNSGEGGEDPIRWKPLTDVVDGYSPTLPHLKGLQNGDIATSAIKQVASGRFGVTPTFLVNADQLEIKVAQGAKPGEGGQLPGKKVSAYIARLRSSKPGVPLISPPPHHDIYSIEDLAQLIFDLHQINPNAKVSVKLVAEAGIGTVASGVAKGNADIIQISGHDGGTGASPISSIKHAGGPWELGLTETHQTLIANGLRERVILRVDGGLKSGVDVLMAAAMGADEYGFGSLAMIATGCVMARICHTNNCPVGVASQREELRARFPGVPGDLVNYFLYVAEEVRGILAQLGYNSLDDIIGRTELLRPRDISLVKTQHLDLSYLLSSVGTPSLSSTEIRKQEVHTNGPVLDDDILADPLVIDAIENEKVVEKTVKICNVDRAACGRVAGVIAKKYGDTGFAGQVNLTFLGSAGQSFGCFLIPGMNIRLIGESNDYVGKGMAGGEIVVTPVEKIGFVPEEATIVGNTCLYGATGGQIFARGKAGERFAVRNSLAEAVVEGTGDHCCEYMTGGCVVVLGKVGRNVAAGMTGGLAYLLDEDDTLLPKINREIVKIQRVTAPAGELQLKSLIEAHVEKTGSSKGATILNEWEKYLPLFWQLVPPSEEDTPEASAAYVRTSTGEVTFQSA

SEQ ID NO: 500 - protein, 61 aa, Arabidopsis thaliana
MAISKASIVVLMMVIISVVASAQSEAPAPSPTSGSSAISASFVSAGVAAVAALVFGSALRI

SEQ ID NO: 501 - protein, 376 aa, Arabidopsis thaliana
MASGDQSKKRKQHYRPQNRPVKKKGSYPLKPGVQGFFISCDGGREFQAAQEAINVIDSFFEELIQGTDSKVNPGLFGNPINKKVTFSYSEDEDEEEDESNNGEEEENKGDGDKAVVSEGGNDLVNEKEIASEGVNDQVNEKEIASEGSCEVKQLAENETVKEEEDKGNQKNGGDEPPRKKTCTEEANPLAKVNENAEKSIDKLIEAELKELGDKSKRRFMKLDPGCNGLVFIQMKKRDGDPSPKEIVQHAMTSAAATKKHMSRFILRLLPIEVSCYPSEEEISRAIKPLVEQYFPIETENPRKFAVLYGARANTGLDRMKIINTIAKSIPAPHKVDLSNPEMTIVVEIIKTVCLIGVVEKYKELAKYNLRQLTSTN

SEQ ID NO: 502 - protein, 679 aa, Arabidopsis thaliana
MSWLRTAVNKAVEVGNRKNITRTVKNYADSVVQHAGQAVAEGAKLFQDRIGVGAYKSVHQTIQRLEEAAVSYRGQERALLITRWLSVLKEIDRATDSSLKDKQLSSEEQLASDEAKKREWVLYYDPDIGGEPLNFRDVFLQSQALEGIVLSMIIEPPHDEEITLLLEMFGLCLNGGKEVHDAIVSSMQDLATVFSSYKDEVLVKQDELLQFAQNAITGLKINAEMLRIDAEASDLRKKLEKMNASQIPQESEDKEHKETPLTIEAFKETLAKIRLCSRLEGLLIRKRQLSNGDSPDIHAQKVDKLRVLLESLANSTSKAEKRISENRLQKEEALKARVVKANETGEKEKELGAEIAQLEKQRDELEADLKRVNLSLAAAQARFRNATEERDQFGEANNQIIAHLKTKDDDLSKSVVACKKEAEVIKTWINFLEDTWLLQCSHIETKDKQTLDELEKHEDYFSDVALNILSVYKKEVAPLISRIENYVENLKNLGPGSEKPPNADQGDNQVSNPRKILEEEYIDYETKIITTFSIVDNVKEQFQVLQSKLDKKDDRRVKELFDDMEKMRQQFESIARPTLEIEIPSPRSSVTSPKSSATSPKSPKPSSSSMNASTESTQTQKPELSNSPQAPNPAAGSSQEFNPEAELAELESEFGKVARDYSADEVDGWEFDELEKELQ

SEQ ID NO: 503 - protein, 535 aa, Arabidopsis thaliana
MFLSRVNPTRFPPFVASRRLFSASASAASLQQYCTEKPPIKPWPQRLFPKRLVSMITQQQNIDLALQIFLYAGKSHPGFTHNYDTYHSILFKLSRARAFDPVESLMADLRNSYPPIKCGENLFIDLLRNYGLAGRYESSMRIFLRIPDFGVKRSVRSLNTLLNVLIQNQRFDLVHAMFKNSKESFGITPNIFTCNLLVKALCKKNDIESAYKVLDEIPSMGLVPNLVTYTTILGGYVARGDMESAKRVLEEMLDRGWYPDATTYTVLMDGYCKLGRFSEAATVMDDMEKNEIEPNEVTYGVMIRALCKEKKSGEARNMFDEMLERSFMPDSSLCCKVIDALCEDHKVDEACGLWRKMLKNNCMPDNALLSTLIHWLCKEGRVTEARKLFDEFEKGSIPSLLTYNTLIAGMCEKGELTEAGRLWDDMYERKCKPNAFTYNVLIEGLSKNGNVKEGVRVLEEMLEIGCFPNKTTFLILFEGLQKLGKEEDAMKIVSMAVMNGKVDKESWELFLKKFAGELDKGVLPLKELLHEISVS

SEQ ID NO: 504 - protein, 362 aa, Arabidopsis thaliana
MLSRSVASAVTPVSSSSLLPNSKPIFCLKTLSGYRSSSFCGGCIRKINHKPLRMTSSNITPRAMATQQLENADQLIDSVETFIFDCDGVIWKGDKLIEGVPETLDMLRAKGKRLVFVTNNSTKSRKQYGKKFETLGLNVNEEEIFASSFAAAAYLQSINFPKDKKVYVIGEEGILKELELAGFQYLGGPDDGKRQIELKPGFLMEHDHDVGAVVVGFDRYFNYYKIQYGTLCIRENPGCLFIATNRDAVTHLTDAQEWAGGGSMVGALVGSTQREPLVVGKPSTFMMDYLADKFGIQKSQICMVGDRLDTDILFGQNGGCKTLLVLSGVTSISMLESPENKIQPDFYTSKISDFLSPKAATV

SEQ ID NO: 505 - protein, 353 aa, Arabidopsis thaliana
MCSSKLKNLTQENISQINGRPVLQPKSNQVPTLDRRNSLKKSPPKPLNPIASKIPSPRPISLISPPLSPNTKSLRKPAGSCKELLRSSSTKSKPVISPENSDGGYKEVMPMVIVQKQPGSIAAARREEVAMKQEERKKKISHYGRIKSVKSNEKNLNVEHEKKKRCSFITTSSDPIYVAYHDKEWGVPVHDDNLLFELLVLTGAQVGSDWTSVLKRRNTFREAFSGFEAELVADFNEKKIQSIVNDYGINLSQVLAVVDNAKQILKVKRDLGSFNKYIWGFMKHKPVTTKYTSCQKIPVKTSKSETISKDMVRRGFRFVGPTVIHSLMQAAGLTNDHLITCPRHLECTAMAAL

SEQ ID NO: 506 - protein, 343 aa, Arabidopsis thaliana
MMEVEGSMNRAPDQSSFLRSRRSKALYQFKQQKLPACKPVLTPISVITVFMLMGFVFIPIGLITLRASRDAIEIIDRYDVECIPEEYRTNKLLYITDSSIPKNCTRYLKVQKYMKAPIFIYYQLDNYYQNHRRYVKSRSDQQLLHGLEYSHTSSCEPEESSNGLPIVPCGLIAWSMFNDTFTFSRERTKLNVSRNNIAWKSDREHKFGKNVYPINFQNGTLIGGAKLDPKIPLSDQEDFIVWMRAAALLSFRKLYGRIEEDLEPGKVVEVNLMNNYNTYSFSGQKKLILSTSNWLGGRNDFLGITYLVVGSSSIVISIIFMLLHLKNPRPYGDNSWNKKSLSS

SEQ ID NO: 507 - protein, 692 aa, Arabidopsis thaliana
MGLSTNLHSLDLRSTFFTGLRTSPIPSNFIKISSISNPRRDISTIRAQVSTISLETSVKQRQDEIESLFSKQPSQQDSDRKRNGKSSKNGASGISSGVKLENIRKSYKGVTVLKDVTWEVKRGEKVGLVGVNGAGKTTQLRIITGQEEPDSGNVIKAKPNMKVAFLSQEFEVSMSKTVREEFMTAFKEEMEITEKLEKVQKAIEGSVDDLDLMGRLLDEFDLLQRRAQAVNLDSVDAKISKLMPELGFAPEDADRLVASFSGGWQMRMSLGKILLQDPDLLLLDEPTNHLDLDTIEWLEGYLQKQDVPMVIISHDRAFLDQLCTKIVETEMGVSRTFEGNYSQYVISKAEWIETQNAAWEKQQKDIDSTKDLIARLGAGANSGRASTAEKKLEKLQEQELIEKPFQRKQMKIRFPERGTSGRSVVNVKNIDFGFEDKMLFKKANLSIERGEKIAILGPNGCGKSTLLKLIMGLEKPVKGEVILGEHNVLPNYFEQNQAEVLDLDKTVLETVCEAAEDWRSDDIKGLLGRCNFKADMLDRKVSLLSGGEKARLAFCKFMVTPSTLLVLDEPTNHLDIPSKEMLEEAINEYQGTVIAVSHDRYFIKQIVNRVIEVEDGCLEDYAGDYNYYLEKNLDARTKELEREAELEEKAPKVKAKSKMSKAEKEARKKQKMQAFQQAKQKSKASKNSKRWN

SEQ ID NO: 508 - protein, 255 aa, Unknown
  Sequence found in Organisms: Brassica juncea, Brassica rapa
MASINSSLLLVLAVACFISPAISQTCSTQNVSTSFDSCMDLPVLDSYLHYTYDAANSSLSVAFVATPPRSGDWVAWGINPTGTRMIGSQAFLAYSPRAGARPMVDTYNISSYNLTPGRLTFDFWNVRAESMPGNLIVIYASVKVPMGANSVNQVWQIGGNVTNGRPGVHPMTPANMASTRVLRLTGSDAPSSAPGSAPGSAPGSVPGSAQGPTTPGASTTPGQAGGPENAGSMSTSVNFGVNFGILVMLATIFIF

SEQ ID NO: 509 - protein, 383 aa, Brassica juncea
MAMRRVAGAAIRACVSSSSSGSLARQFHASSGDSKKIVGVFYKANEYASKNPNFLGCVENALGIRSWLESQGHQYVVTDDKEGPDCELEKHIPDLHVLISTPFHPAYVTAERIKKAKNLQLLLTAGIGSDHIDLQAAAAAGLTVAEVTGSNVVSVAEDELMRILILMRNFVPGYNQVVNGEWNVAGIAYRAYDLEGKTVGTVGAGRIGKLLLQRLKPFGCNLLYHDRLQMGPEMEKETGAKYVESLDEMLPKCDVVVVNTPLTEKTRGMFNSEMIGKMKKGVLIVNNARGAIMDRQAVVEAVESGHIGGYSGDVWDPQPAPKDHPWRYMPNQAMTPHISGTTIDAQLRYAAGTKDMLEKYFKGEDFPAQNYIVKDGELAPQYR

SEQ ID NO: 510 - protein, 444 aa, Brassica juncea
MGADAIQTNGQDPAKLTVVEGIERLRCAVKNYEWGKLGHDSLVARLHEANSGNRVDPAVPHAELWMGTHESGPSHVVKEEELGSGHDGSECMITLKSWVSDNPDVLGSRVVDKWGCDLPFLFKVLSVTKALSIQAHPNKALAEKLHREEPLLYRDVNHKPEIALGYYSFQALCGFISLKELKEVIANVPGITELVGSKAADQIFTVNEKDGDESIKSIVRLIFTQLMSASNNETKRVIYEMKMRLITETNHRELTEKEKLVLELEKQYPGDVGVISAFFFNYVKLNPGEALYLDADEPHAYISGDCVECMAASDNVVRAGLTPKHRDVQTLCSMLTYKLGYPEILKGFPLTPYITRYLPPFDEFEVDHCDLPTGKSTIFPAIPGPSVYLVIEGTGKLQTGSSQLLVNRGDVLFVPAHNEIHLTGESDVMKLYRAGVSSRFFQTL

SEQ ID NO: 511 - protein, 509 aa, Brassica juncea
MDRREVYVLTIFVALSVRCVGCVANYNRNDFPTDFAFGSGTSAYQWEGAYDEDGKKPSVWDTYVHSRNMENGDIACDGYHKYKEDVQLMVETGLEAFRFSISWSRLIPNGRGPVNPKGLEFYKNFILELVTHGIEPHVTLYHYDHPQYLEDEYRGWLNRRIIKDFTAYADVCFREFGKHVKFWTTINEANIFTVGGYDGGNTPPGRCSTCMSGNSSTEPYIVAHNLLLAHASASRLYKQKYKDTQGGSVGFSIFTIGFRPSTNSKDDEMAIQRFKDFFYGWMLGPLTYGDYPEGMKRKLGTRLPVFTKEEAEQVKGSSDFVGVIHYLAATISNAEPKPLLPGDSAFFAEIGATLTYSGNFSGFEYEVAPWAMEVVLEYIKQSFGNPPVYILEDAEPMKQDLQLQEKDTPRIEFLDAYIGAVLKAVRNGSDTRGYFVWSFMDLYEMLSGYNFSFGLYSVNFSDPHRKRSPKLSAHWYSAFLKKGNTNFPGFQGTSHLQTNLSSSSLAASS

SEQ ID NO: 512 - protein, 593 aa, Brassica juncea
MAMAFPLSYTPVSVKPVTYSRRSKLVVFSSSSNGRDPSPSEENSVPNGVKSIEKLQEEKRRAELSARIASGAFTVRKSSFPSTVKNGLSKLGVPSNVLDFMFDWTGANEDYLKVPEAKGSIQAVRNEAFFIPLYELFLTYGGIFRLTFGPKSFLIVSDPSIAKHILKDNAKAYSKGILAEILDFVMGKGLIPADGEIWRRRRRAIVPALHMKYVAAMISLFGEASDRLCQKLDSAASTGEEAEMESLFSRLTLDIIGKAVFNYDFDSLTNDTGVIEAVYTVLREAEDRSVSPIPVWDIPIWKDISPRQRKVATSLKLINDTLNDLIATCKRMVEEEELQFHEEYMNERDPSILHFLLASGDDVSSKQLRDDLMTMLIAGHETSAAVLTWTFYLLTTNPKVVAKLQEEVDSVIGDRFPTLEDMKKLKYTTRVMNESLRLYPQPPVLIRRSLENDKLGPYPIKRGEDIFISVWNLHRSPLHWDDTEEFNPERWPLDGPNPNETNQNFSYLPFGGGPRKCIGDMFASFENVVAIAMLIRRFNFQTAPGAPPVKMTTGATIHTTEGLKLTVTKRTPPLSVPILPMEAPRDEVSSALS

SEQ ID NO: 513 - protein, 583 aa, Brassica juncea
MAFKVTLVSTSPIDGQKPGTSGLRKKVKVFKQPNYLENFVQATFNALTPEKVKGATLVVSGDGRYYSKDAVQIIIKMAAANGVRRVWVGKNTLMSTPAVSAVIRERSGADGSKATGAFILTASHNPGGPTEDFGIKYNMENGGPAPESTTDKIYENTKTIKEYPIAEDLPNVDISAIGVTSFEGPEGKFDVEVFDSADDYVKLMKSIFDFESIRKLLSSPKFTFCYDALHGVAGAYAHRIFVEELGAQESALLNCVPKEDFGGGHPDPNLAYAKELVARMGLGKSDTGDEPPEFGAAADGDADRNMILGKRFFVTPSDSVAIIAANAIGAIPYFSSGLKGVARSVPTSAALDVVAKSLNLKFFEVPTGWKFFGNLMDAGMCSVCGEESFGTGSDHIREKDGIWAVLAWMSILAHKNKETINGDTKLVTVEDIVRQHWATYGRHYYTRYDYENVDAGKAKELMEHLVKLQSSIPEVNKIVKGIRSDVANVSSADEFEYKDPVDGSISKHQGIRYLIEDGSRLVFRLSGTGSEGATIRLYIEQYEKDASKTGRESQEALSPLVDIALKLSKMEEFTGRSAPTVIT

SEQ ID NO: 514 - protein, 476 aa, Brassica juncea
MSFNRVLLSIIIILCVCLNWDCSEGAQEKQRRAIDSHTIQLSSLFPSSSSPCVLSTRASKTKSSLHVTHRHGTCSRITSAKATSPDHAEILRLDQARVDSIHSKLSNKLTDRVRQSKSTDLPAKDGSTYGSGNFVVTIGIGTPKHDLSLIFDTGSDLTWIQCEPCVRTCYSQKEPIFNPSSSSSYHNVSCSSAECSSLSSATGNSGTCSASNCVYGIQYGDQSFSVGFLAKEKFTLTASNVFDGVNFGCGENNQGLFTGVAGLLGLGRDKLSFPSQTATTYNKIFSYCLPSSASYTGHLTFGSAGVSRSVKFTPISTITDGTSFYGLDIVGISVGGQKLAIPPTVFSTPGALIDSGTVISRLPPKAYAAMRSAFKARMSQYKNASAVSILDTCFDLTGFKTVTIPTVSFYFSGGAVVELGSKGILYAFKMSQVCLAFAGNSDDNNAAIFGNVQQQTLEVVYDGAGGRVGFAPNGCS

SEQ ID NO: 515 - protein, 721 aa, Brassica juncea
MPSHTNFLFRWIGLFSGKLRRENTGFSENSIVQNNGGESSSSNSDETPVLSSGECYACTQVGVPAFHSTSCDQANAPEWRASAGSSLVPIQEGSAPTDPARTRVRRLKGPFGEVLDPRSKRVQRWNRALLLARGMALAVDPLFFYALSIGRTTGPACLYMDGAFAAVVTVVRTCLDALHLWHVWLQFRLAYVSRESLVVGCGKLVWDPRAIASHYARPLTGFWFDVIVILPVPQAVFWLVVPKLIREEKVKLIMTILLLIFLFQFLPKIYHCICLMGRMQKVTGYIFGTIWWGFALNLIAYFIASHVAGGCWYVLAIQRVASCIRQQCMRTANCNLSLSCQEEVCYQFVSPTSTIGFPCLSGNLTSVVKKPTCLDSDGPFRYGIYGWALPVISSNSLAVKILYPIFWGLMTLSTFGNDLEPTSNWLEVIFSIVMVLSGLLLFTLLIGNIQVFLHAVMAKKRKMQIRCRDMEWWMKRRQLPSRLRQRVRRFERQRWTALGGEDELELIQDLPPGLRRDIKRYLCVDLINKVPLFRGMDDLILDNICDRAKPRVYSKDEKIIREGDPVQRMIFIMRGRVKRNQSLSKGVVATSTLEPGGYLGDELLSWCLRRPFIDRLPPSSATFVCLDNIEAFSLGSEDLRYITDHFRYKFANERLKRTARYYSSNWRTWAAVNIQMSWRRYRKRTCSMSPVSEHSVEGNSERRLLQYAAMFMSIRPHDHLE

SEQ ID NO: 516 - protein, 321 aa, Brassica juncea
MCSKMAFTLTIPRFHSPVSRKPTTCSSPSPPSKTQCAHFSHGRSVSLRRRLFLLPVKATTDQSGQVGGEEVDSKILPYCSINKNEKRSIGEMEQEFLQAMQSFYYEGKAVMSNEEFDNLKEELMWEGSSVVMLSSDEQRFLEASMAYVSGNPIMSDEEYDKLKMKLKMDGSEIVCEGPRCSLRSKKVYSDLAVDYFKMFLLNVPATVVALGLFFFLDDLTGFEITYLLELPEPFSFIFTWFAAVPAIVYLALSLTKLIIRDSLILKGPCPNCGTENTSFFGTILSISNDSSTNNVKCSGCGTAMVYDSSTRLITLPEGGNA

SEQ ID NO: 517 - protein, 369 aa, Brassica juncea
MTMNSLPRRFGKNQGYLDRDHRRGRRSDSDSDEELKGLSHEEYRRLKRLKMRKSGKHCIWKNTPSPPRDPNEVESDENADDEEVPEKDEEDPKPKGESDSGKSESESDRSRKKRKSKSSRSKRSRRYSDSESDDDSDEEDRRRRRRKKKQKSSRKRRGHRRKRRYSDSDDESEISASSSSGEERSKSKSKKNTDSKGKLEEAVKEPELDEEEMKMIIESKKKALPEDEEEEGEVGPMPLPKAEGHISYGGALRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKTDGADD

SEQ ID NO: 518 - protein, 571 aa, Brassica juncea
METNSSGEDLIVKTRKPYTITKQRERWTEEEHNRFLDALRLYGRAWQKIEEHVATKTAVQIRSHAQKFFSKVEKEAEAKGVPVAQALDIAIPPPRPKRKPNNPYPRKTGTGSLPISKTGLNDGKQSLGSDKVLVPEMTNEDLQEDNCSDCLTHQHLSAASSIKTSNASTFREFLPSREQGNNKESNSANYSENIEAEPQTYPRHIPMLVPLGSSITRSLSHAPDENSHHPHTVAGDHQSFPDHIMSSLLQTPALYTAASFASTFWPPDTSVGPQGNNLTPNLAAMASATVAAASAWWAANGLLPLCAPFSSGGLTSHPPTITYGPSSGEVDVTKTTDQEHSEASKARSSLDSEETKNGSKPDCHEHHPCAATETDAKGSDGARERKQVDRSSCGSNTPSSSDDVEADALERQENGGNNDDEVKEVNADTTNNNPQTTSESNARRSRISSNLADPWKSVSDEGRIAFRALFAREVLPQSFTYQREEGQQQQQRYPMELDLNSAADDQEENRNIAFLGASKQQQLSRGRTGFKPYKRCSMEAKESRVISNTNPIISVEQKDPKRIRLETQTST

SEQ ID NO: 519 - protein, 452 aa, Brassica juncea
MMISQFFVLSQRGDNIVFRDYRAEVPKGSTETFFRKVKFWKEDGNAEAPPIFVNVDGVNYFHVKVVGLYFVATTRVNVSPSLVLELLQRIARVIKDYLGVLNEDSFRKNFVLVYELLDEVIDFGYVQTTSTEVLKSYVFNEPILIAPARLQPIDPAAIFTQGSKRMPGTAVTKSVVANDPGGRRREEIFVDVIEKISVTFSSSGYILTSEIDGTIQMKSYLSGNPEIRLALNEDLNIGRGERSVYDYRSSSGSGVILDDCNFHESVRLDSFDSDRTLSLVPPDGEFPVMNYRMTQEFKPPFHVNTLIEEAGRLKAEVIIKIRAEFPSDVVANTITIQMPLPNYTSRASFELEHGAAGQKTDFKETSKMLEWSFKKIVGGAEHTLRAKLTFSQEFHGNITKEAGPVSMTFTIPMYNVSKLQVKYLQIAKNSSSQNPYRWVRYVTQANSYVARI

SEQ ID NO: 520 - protein, 716 aa, Brassica juncea
MALSAFAFPSYITTKGGLTDSCCKSNSLSSSRSLSADLPSPCLRPNTSHSNRKAKVNASLAEKGEYYSNRPPTPLLDTINYPIHMKNLSTKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKNNNVVAVIGDGAMTAGQAYEAMNNAGYLDSDMIVILNDNKQVSLPTATLDGPSPPVGALSSALSRLQSNPALRELREVAKGVTKQIGGPMHQLAAKVDEYARGMISGTGSTLFEELGLYYIGPVDGHNIDDLVAILKEVKSARTTGPVLIHVITEKGRGYPYAERADDKYHGVVKFDPATGKQFKTTNKTQSYTTYFAEALVAEAEVDKDVVAIHAAMGGGTGLNLFQRRFPTRCFDVGIAEQHAVTFAAGLACEGLKPFCAIYSSFMQRTYDQVVHDVDLQKLPVRFAMDRAGLVGADGPTHCGAFDVTFMACLPNMIVMAPSDEAELFNIVATAAAIDDRPSCFRYPRGNGIGVALPPGNKGVPLEVGKGRILKEGERVALLGYGSAVQSCLGAAVMLQERGLNVTVADARFCKPLDRALIRSLAKSHEVLITVEEGSIGGFGSHVVQFLALDGLLDGKLKWRPMVLPDRYIDHGSPADQMAEAGLMPSHIAATALNLIRAPREALY

SEQ ID NO: 521 - protein, 809 aa, Brassica juncea
MSNPAESSDSKSKKDFSTAILERKKSPNRLVVDEAINDDNSVASLHPATMEKLQLFRGDTILIKGKKRKDTVCIALADESCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPKIMSKLAGESESNLRKAFEEAEKNAPSIIFIDEIDSIAPKREKTNGEVERRIVSQLLTLMDGLKSRAHVIVMGATNRPNSIDPALRRFGRFDREIGIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFGKARQSAPCVLFFDELDSIATQRGGGGGGDAGGAADRVLNQLLTEMDGMNAKKTVFIIGATNRPDIIDSALLRPGRLDQLIYIPLPDEDSRLNIFKAALRKSPIAKDVDINALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFETNAGSGATTGVADPFATSAAAAADDDDLYN

SEQ ID NO: 522 - protein, 432 aa, Brassica juncea
MAESSKVIHVRNVGHEISENDLLQLFQPFGVITKLVMLRAKNQALLQMQDVSSAITALQFFTNVQPTIRGRNVYIQFSSHQELTTAVQNIHGREDEPNRILLVTVHHMLYPITVDVLHQVFSPYGFVEKIVTFQKSAGFQALIQYQAQQCAASARTSLQGRNIYDGCCQLDIQFSNLEELQVNYNNDRSRDYTNPNLPSEQKGRLPHPGYGDAGVAYPQMANTSAIAAAFGGGLPPGITGTNDRCTILVSNLNTDSVDEDKLFNLFSLYGNIVRIKLLRNKPDHALVQMGDGFQAELAVHFLKGAMLFGKRLEVNYSKHPNITPGTDSHDYVNSNLNRFNRNAAKNYRYCCSPTKMIHLSTLPQDVTEEEVVNHVQEHGAILNTKVFEMNGKKQALVQFENEEEAAEALVCKHATSLGGSIIRISFSQLQTI

SEQ ID NO: 523 - protein, 110 aa, Unknown
  Sequence found in Organisms: Brassica napus, Brassica juncea, Brassica oleracea, Brassica rapa
MEAIRNLKIKTSTCKRIVKELHSYEKEVEREAAKTADMKDKGADPYDLKQQENVLGESRMMIPDCHKRLESALADLKSTLAGLEETTGPEVEDAKKTVADVEKQFPTEDA

SEQ ID NO: 524 - protein, 394 aa, Brassica juncea
MARTARPDGEEGISLLEFNGNGDRSWQLNFDDFQVSPEHKEKKSPSKLHNCLGCLGPEDNVTDYYQQQVEMLEGFTEMDELAERGFVPGMSKEEQDNLAKSETLAIRISNMANMVLFAAKVYASVTSGSLAIVASTLDSLLDLLSGFILWFTAVSMQTPNPYQYPIGKKRMQPLGILVFASVMATLGLQIILESLRTMLSSHKEFSLTKEQESWVVGIMLSVTLVKLLLVLYCRSFTNEIVKAYAQDHFFDVITNIIGLIAVILANYFDNWMDPVGAIILALYTIRTWSMTVLENVNSLVGKTATPEYLQKLTYLCWNHHKAIRHIDTVRAYTFGSHYFVEVDIVLPADMPLQVAHDIGESLQEKLELLQEIERAFVHLDYEYTHKPEHARSHC

SEQ ID NO: 525 - protein, 382 aa, Brassica juncea
MGGGEEEIKERLQPATEKKQHNVKGKRLWQKVKYQLVEYHALPAYLRGNEYVLGHYRSEWPIKQILLSIFTIHNETLNVWTHLIGFFLFLALTIYTATKVPSVVDLHSLQHRLPDVLRETDLHKLHSDLMSRLPSSPSKWHVMELLYNCLPERFSHGNSTDMCVLHSVKEDLANMVAPLIFRPITRWPFYAFLGGAMFCLLASSTCHLLSCHSERVSYIMLRLDYAGIAALISTSFYPPVYYSFMCDPFFCNLYLGFITILGISTVLVSLLPVFQSPEFRVVRASLFFGMGFSGAAPILPKLIIFWDQPEALHTTGYEVLMGLPYGFGALVYATRIPERWMPGKFDIAGHSHQLFHVLVVAGAFTHYRAGLVYLKWRDIEGC

SEQ ID NO: 526 - protein, 362 aa, Brassica juncea
MVMVVGETSMELDQCFQMMMMKMEGVSIKEWKDIPVELLMRILSLVDDRNVIAASGVCCGWRDAISLGLTRLRLPWCNNNMNSLVLSLAPKFVKLQTLILRQDKPQLEDNAVDAIANHCHELQELDLSKSLKLTDRSLYALAHGCPNLTKLNLSGCTSFSDKAIAYLTRSCRNLKVLNLCGCVNAVSDYTLEAIGNNCNQMQSLNLGWSEKISDDGIMSLAYGCPDLRTLDLCGCVLITDESVVALADWCVHLRSLGLYYCRNITDRAMYSLAQSGVKNKPGGQWKSSAKKSKFDEEGLRSLNISQCTALTPSAVQAVCDTFPALHTCSGRHSLVMSGCLNLTSVHCACILQAHRSVPHSAH

SEQ ID NO: 527 - protein, 473 aa, Brassica juncea
MEGRRITASPRPCSGRRVVAAEKKRSRPDGFVNSVKKLQRREISSRKDRAFSISTAQERFRNMRLVEQYDTHDPKGHSLVALPFLMKRTKVIEIVAARDIVFALAHSGVCAAFSRETNKRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKHVQEIKISPGIMLLIFKRATSHVPLKILSIEDGTVLKSFNHLLHRNKKVDFIEQFNEKLLVKQENENLQILDVRNAELMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITSSSGPPKEGETESSSSSSSSLGNNSKLRRNAVAEALEDITALFYDEERNEIYTGNRHGFVHVWSN

SEQ ID NO: 528 - protein, 96 aa, Brassica juncea
MLMVKATWVSILALAAFLLVVLVPAAEAVTCSPMQLSPCAAAITSSSPPSALCCAKLKEQKPCICGYMRNPSLRRYISSPNARKVSNTCKFPMPRC

SEQ ID NO: 529 - protein, 385 aa, Hordeum vulgare
MVTIVGTREQFVQPQSCLRATMQLKSPTRPKLSFCFTPQGDCDQYCALIPGLPEDLAKICLALVPRTHFPVMGGVSKRWMSFLESKELIAVRKEVRKLDECVYVLTADAGAKGSHWEVLGCQGQKNTPLPPMPGPTKAGFGVVVLDGKLVVIAGYAADHGKECVSDEVYQYDCFLNRWTAISKMNVARCDFACAEVNGVIYVAGGFGPDGDSLSSVEVYDPEQNKWALIGRLRRPRWGCFGCSFEDKMYVMGGRSSFTIGNSRFIDVYDTNSGAWGEFRNGCVMVTAHAVLGEKLFCIEWKNQRSLAIFNPADNSWQKVPVPLTGSSSTRFSLGTHDGKLLLFSLEEEPGYQTLMYDPAAPTGSEWCKSTLRPSGSCLCSVTIKA

SEQ ID NO: 530 - protein, 1719 aa, Hordeum vulgare
MAPKHAGRGKGRGGGGKGDRKKREEKVVPSVLDVAVATPYESQVTLKGISTDRVLDVRKLLVSNVETCHVTNYSLPHVVRGQRLEDGVEVVALKPCALTIVEEEYATEEAAVAHVRRLLDIVACTTAFAKAKQHKSSSKHAQRPATPPSPPPVSSAGANGVGAGAGGEAAPAISAAHDMVAIGPPPKLGEFYDFFSFAHLTPPLHFIRRKERNGAAQDGDYFEIEVKVCNGKLLHIVASVKGFYLVGKPHTVSRSLVDLLQQLSSGFANAYEALMKAFVDHNKFGNLPFGFRANTWLVPPVYVDSATKSPALPAEDENWGGNGGGCGRDGKHDRRRWAREFSILARMPSKTEEERVIRDRKAFLLHNLFVDTAIFRAASTIRRLVDTSPQTGPNGSLLLEERVGDLHIIVKKDEADASLKLEDKVDGVAIYQTDAMDISQRNLLKGLTSDESVVAKDSSTLGVVIVKHCGYTAIVKVSGRTKNSSDGKQTSDISDHLDEIPNIDVDDHPDGGSNALNAHSLRIPLPKITNPEIAASSQHLASKPHVDNYARKLACTVLETSLRKLGNTPNKNPRRIRWELGPSWLQHLQKKDASVSEDSEKNAKKSEKDSSVKGLGKHFEQLRKIKKKESTTEDAKTEKEESDSNCLTNGMEKSENVAVTETNIETEIRNLITEDAFCRLKSLEAGLHQKSLEELTMMAHKFYDDTALPKLVADFASLELSPVDGRTMTDFMHTRGLNMCSLGRVVELAEKLPHIQSICIHEMVIRAFKHVIRAVIAAVDDMQNMSAVIAETLNILLGSPRLENDLDTDADEHNLRLKWVESFLSKRYCWTLKDEFAHLRKPIILRGLCSKVGLELVARDYDMNSPNPFDKSDIVNIVPVCKHVVYSSIDSRNLLESSKMALDKGKLDDAVNYGAKALSKVIAVCGPYHRLTANAYSLLAVVLYHTGDFNQATIYQQKALDINERELGLDHPETMKSYGDLSVFYYRLQHIEMALKYVNRALYLLQFSCGLSHPNSAATYINVAMMEEGMGNVHVALRYLHEALKCNKRLLGADHIQTAASYHAIAIALSMMDAFSLSVQHEQTTLQILQEKLGEDNLRTQDAAAWLEHFDSKALEQQEAARRGIPKPDSSIASKGHLSVSDLLDYISPDQERKERDMQRKCRRAKNNTRAHQGESVEEKENFQHDSGSLLEADKKDFQEAKLEASPRVVAAVAEETYAVHDELRQVDTLSPEEYSDEGWQAATLKGRSSNVRKKSIRRRPSLTKLLVDRTEDGRTPSAHRSGVQPQAKEHKEEAVNSPSQLSFGNFIRSDKLNGDPVITEDKSSKGTSKSEWKVKPTGSKRPTTIASKLVSYKDVAVSPPGTVWKPILEQKEAKEKDNEQDTDAAPSSEEGDRKLIDEEKEKSSDESIKEIVSIQPEESSPTEPEKASDSNSDGSSSPGKKTSGSKLSASAPPFKPGSLLSVSHPYSTVAIYDASVVLQPIPSQAMEILPHAVDTRVPRGPRSTLYYRTGHSFQRKQGYTQSQSTILRGSTSPPTMNPHAAEFVPGKTVQQADLATEEQANSVTDPAGQQLASHASDEVKVDVREADKAGQVEKTTPGKGKERAKDAMRDSYKAELARQILLSFIVKSVHDSLGSTRPQPDRKPSGSDEASNEQSSNITKTALSPKEFDKQPKATEAPKSEKDTEGFTVVSKRRKSKQHFVNPINGLYSQQSICTSVS

SEQ ID NO: 531 - protein, 750 aa, Brassica napus
MAASSSSSSPSSLLLPNISFHSTTTRSVSIPGIFLPRNRLRHSHTLPLRIRASRDDNVAVEDRENAVINGNGSVRLNGNGAARKSINGDLNGNVPLNGNGSLVKYVNGSVTEEVSKKREEEKRQKRVEDIGQEDAWFKKTQQKQQVEVSVAPGGRWSRFKTYSTIQRTLEIWGFVITFIFRTWLSGQKFSYKGGMTEEKKVLRRKVLAKWLKENILRLGPTFIKIGQQFSTRVDILPQEYVDQLSELQDQVPPFSSATALSIVEEELGASVDDIFDRFDYEPIAAASLGQVHRARLKGQEVVIKVQRPGLKDLFDIDLKNLRVIAEYLQKVDPKSDGAKRDWVAIYDECASVLYQEIDYTKEAANSELFANNFKNLEYVKVPSIYWEYTTPQVLTMEYVPGIKINKIQALDQLGVDRKRLGRYAVESYLEQILSHGFFHADPHPGNIAVDDVNGGRLIFYDFGMMGSISPNIREGLLEAFYGVYEKDPDKVIQAMVQMGVLVPTGDLTSIRRTALFFLNSFEERLAAQRKEKEELAAAEELGFKKPLTKEEKQEKKKQRLAAIGEDLLAISADQPFRFPATFTFVVRAFSVLDGIGKGLDPRFDITEIAKPYALELLRFREAGVEVVVKDLRKRWDRQSQAFYNVFRQADRVEKLAVIIQRLEQGDLKLRVRALESERAFQRVAAVQKTVGSAVAAGSLVNLATILYLNSLKTPATIAYTVCAFFSLQVLIGVIKVKKFDQREKLITGTA

SEQ ID NO: 532 - protein, 221 aa, Brassica napus
MVLWVFGYGSLIWNPGFDFDEKLIGYIKDYKRVFDLGCIDHRGTPEHPARTCTLEDSAGAICWGAAYCVRGGPEKEKLAMEYLEGRECEYDSKTLVEFYTETDTTKQSKPILTGVIVFTSTPDKVSNKYYLGPAPMEEMAMQIATASGPCGNNREYLFKLEKAMHDIEHEDEYVIELANEVRKHLDLPKEVKALLKPVVSRVSIKSHSQAHVSTLQRVFAS

SEQ ID NO: 533 - protein, 1006 aa, Brassica napus
MNVMERVGEETVGSNNVQLKGGRVDDVPCTTLHTESDAGRSDCPGSSAPPGDKISVEELTYRAAVQGTSHNHMESSRPAGKFEHLYRLGSSAFRGGDVDSQPRDVDQMLSRIRQQLAGAPSERQNLVKPFVNKRSDQNLEAFSERLRAAGGENSVGLAWISDGVQLKMTPLSSSSFSQLILKRAMKGKGVVGKHQDAPPPEFVCEQDGVCKDKKLDISSKSPVAQEPIPKGNGIVSHGQGNHTNNSSSSGISLREFIRSSYGKREKRHSLSLFRQLVELIGSAHSQGLFLLELRPSLFALVPSKKLRYNGTFGKSNVESDVDEDLNRKRHVVQESSVVGRDLKKRRMDLNAPGNQLLQATLTGRPCKRKSPLIDLNVVDVRNPDSCELQQQSYMKNLGVPSVTRKQSMSTWLEEQWYTCPEEINGEDIGEKSNIYALGVLLFELLCHCESSEMHAAMMADLRHRILPPAFLSRYPKEAGFCLWLLHPEPSSRPTAREILKSELICVEDSVKSTAADEEISELLLHFLSSLEKQKKKNASKLLQDIQTLEDDIKEAERRYSSKASLVRSHEIIESKVQSSPIGERCTTTSGALFVPTANTDRLMSNIRQLEEAYFFMRSQMKLSDSAASARSDKSLLKDKDKWSENQNKDQDARTKGKSSDQLEVFFEGLCKFARYSKFETCGTIRSGDLLNSASVVCSLSFDPDEEHIAAAGISKKIKIFDFNAFMNESVGVHYPLVEMVNKSKLSCVCWNSYIKNYLASTDYDGVVQIWDAGTGQGFSQYTEHQKRAWSVDFSPSDPTKFVSGSDDCSVKLWSVNEKRSLGTIWSPANVCCVQFSSYSNHLLAFGSADYKVYCYDLRYVKTPWCTLAGHEKAVSYVKFMDSETIVTASTDNSLKLWNLNKTNSTGLSTGACSMTYKGHTNQKNFVGLSVLDGYIACGSETNEVYSYYRSLPMPMTSYKFGSVDPISGNEYFDDNGQFVSSVCWRKKSNMLVAANSTGNMKLLKLV

SEQ ID NO: 534 - protein, 611 aa, Brassica napus
MFDWDDEELTNMIWGDEGETDDHIVPFKVRNRKEQGDESNKAVKPAESKTHLHDSKLGGSSSGQNIECMSSWPDSSVSNARKADPGPDSSEPARYDSTRSEKASELAKGPDIFHSTDESKEQGDFDEYGWANIGSFDDLDRMFSSDVPIFGDGTLSGADELWSSSKDASKPLPSILDSQDLGLDIRTEFEQQENQQFPLTGETNGPSSQSAPRVRVTPKAEQYHEHKRQSSVDDQPYQQNKMMKFSEMLGTCEAGSFQDPYGQRTLSRRKFANQLGPSRSSMMGVNLQSESQGSGTSHYPHMPNQYMATSGFGNPYSAVPVVSAFQRPDVNKNQLMHPSYNPASAISANTVTDVCARPSTMTPQEKLEKLRRRQQMQAMLAIQRQQQQFRHQVPVADQSITQLVDKTSLQGLTAIPSFDPNSSLELDDSGNFAAAVDNPSEFSVLYRLQDVVAKLDMETRTCIRDSLFRLADSAGQRHHTSDTPHSNKSSQDDREVIPQEKSRYRYAGMLDTETVTNPTDRTVAHLLFHRPFDMYAAKHTEGLESPSSSKMGAEVKGSFPSTRESRMIKQKAKEEDVPAGSLALGYASNSGSSSTVAERVVEASQGNKRKL

SEQ ID NO: 535 - protein, 485 aa, Brassica napus
MALLVEKTSSGREYKVKDMSQADFGRLEIELAEVEMPGLVSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQVPDPSSTDNPEFQIVLSIIKDGLQVDPKKYHKMKERLVGVSEETTTGVKRLYQMQETGALLFPAINVNDSVTKSKFDNLYGCRHSLPDGLMRTTDVMIAGKVAVICGYGDVGKGCAAAMKTAGARVIVTEIDPICALQALTEGLQVLTLEDVVSEADIFCTTTGNKDIIMVDHMRKMKNNAIVCNIGHFDNEIDMQGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTKLTKDQSDYVSIPIEGPYKPGHYRY

SEQ ID NO: 536 - protein, 243 aa, Brassica napus
MAISRTFMSFNLFIFFLVIATTNGQAPAPTPSGPTNITAVLEKAGQYTMFIRLLKSTQAADQINTQLNSSSSQGLTVFAPTDNAFSSLKSGTLNSLSDQQKVQLVQFHVLPTLLTMPQFQTVSNPLRTQAGDGQNGKFPLNITSSGNQVNITTGVVSATVANSVYSDKQLAVYQVDQVLLPLAMFGSSSAAPAPAPEKGGSVTTGSASGSDGGGDSTDSSDAERIRYGIIATVAAIAASSLWI

SEQ ID NO: 537 - protein, 895 aa, Gossypium hirsutum
MAVKKRKERAVGGESGNSKKFKKYSNSKGPMKKNKNDTRKKGKGPRLPSALRTELDRLDPKIASDSDDGIDLDVGNDVYEYEEEVPQEESRKNRRFDPVENYEYELPEDFEDENVPSDDDDDDGDFGVGGNKGSLNDDVDASDGDEEEDDERHLRMLQGVTGMSTDAFGGKKKRNSVVISEAHPESEYNPTRDVLEGDSHITLQDLLDPIQGKAGYSKLRKRVQHMDRKSTSVQAPLPKVDREKLERMAVYEHSKKDITKWEHLVKRNREAPTVFFGGDVDLGFSTVGAIASEFEPRTEFEKKIASLVYDDKVMEAHKADGSKLLELNKISEEDYMKHQDHVAKMRGLLFRHEMKQKRIKKIKSKTYHRLKNKDKLKVESAEMLMDPEAAKEQARKQEFKRAEERMTLKHKNKSKWARRILERGLNAQDEGTRAAMAEQLHQHALLTRKINTVKDSSSSSDSSSDDDDEGSNEDRASELLEKAKEKTLKVLEDDEELPNSGVLSLPFMVRGLKKRREEAIEEAKLALQEYEQLEGTNDAENSKPATASGRRVFGRANNEVPDSNKKTKTDNKMKMDNYYGNSDSEDDLKAKENVNIEGGKRNDVEKDVGPNYDRKEAADVSIFKNFDDNGDPGSKTTYEVAIFASDSRRKMKSENGIDKNAKKLQQVKEAIVHNKDMEEGEEDSDSESKQMVDGILSSAPKESYELPSQSELIRHAFAGDDVEEEFEKDKQEILNEENPEPDKPVLLPGWGQWTHVQQKKGLPWWMLKEHEDAKRKREESLKKRKDAQLKHVIISEKVDKKAEKLQTKSLPYPFTSKELFEQSMRMPIGSESNPETAIRSLNRPEVVKKPGVIIKPIKFVEMHHHEKSEDNKRSGQKQKKNKSKGASGKNKKQSN

SEQ ID NO: 538 - protein, 740 aa, Gossypium hirsutum
SSVEENHKVLDEKRTLMKFVSDLGKEKHNLEEENCAVFAEAVSQSNISLILKDIITDNFVEIKHLMANLDKLKCFNDDLEGKLRIMGIKFEETQMVNSHLKDKVQNLENELVSVKSVCNQLNDEVVKGKDLLCQKENELLEAGQLLSATQEERTQLHEVVEDLKTKYVEVKLIGEDQKKQILKLSGDYDIQNKEIESIRQANQSFEAELSKLHEELEEWKCREESLCVELQKGRNEVELWETQATALFDELQISTVRGALLEEKACELSAECEVLESRSKSNAMEAEELEKSVRILECENGGLKAQLAVYVPAVVSLSDSVTSLESRTLLNPKLTTDHNQVKNATPGTDLHADNCQQTNEVQIATVPDGCSDLQGINMRIKAIEKAVLEMEKLAMTENLNLSSKLETAMKQIEDLRNGSSSGQENVGEKRHVNDKQGLEHGQGLGNNVKTQRLIPEIIEEDNEMMTKDIMLDQISECSSHGLSRRETSEADDQMLGLWEASDRDGTIDLSGDKAQKIVTGPSDHQQIDTVKVHKGSQHSTKSHVKELGVDKEKSKRYTEPNQEEKKRKILERLDSDAQKLANLQITVQDLKRKVEITEKGKKGKGIEYGTVKEQLEEAEEAITKLSDFNRKLIVHAGDPSRSLLDGKPAIDSDGSGSGRRQRISEQARKGSEKIGRLQLEVQKIQFLLLKLDDEKESRGRTKITEHKTTVLLRDYLYGGVRNIKKRKNSLFCACVRPQTK

SEQ ID NO: 539 - protein, 382 aa, Gossypium hirsutum
MAMKQVANSAIKAIANSGSSSLLTRQLHASPGSKKIVGVFYKANEYFTKNPNFVGCVEGALGLRQWLESQGHQYIVTDDKEGPDCELEKHIPDLHVLISTPFHPAYVTAERIKKAKNLQLLLTAGIGSDHVDLKAAAEAGLTVAEVTGSNVVSVAEDELMRILILVRNFVPGYHQVITGDWNVAGIAYRAYDLEGKTVGTIGAGRIGKLLLQRLKPFNCNLLYHDRVKIDPELEKQTGAKFEEDLDAMLPKCDIIVINMPLTEKTRGMFDKDRIAKMKKGVLIVNNARGAIMDTQAVADACSSGHIAGYSGDVWYPQPAPKDHPWRYMPNQAMTPHISGTTIDAQLRYAAGVKDMLERYFKGEDFPEQNYIVKAGELAPQYR

SEQ ID NO: 540 - protein, 1680 aa, Gossypium hirsutum
MAPGSGKSKSSKAKAEKKRKEEKIVPYVLDITVTTPYETQVVLKGISTDRILDVRRLLASHVETCHLTNYSFAHEVKGKRLSDKVEMVTLKPCLLKMVEEKYAEEAEAVAHVRRLVDIVACTSRFSRPKRPRSQSLSAPSDSKAEKVNRPNNSALPPAPSDGETTPIPENLDMAAIHPTPKLSEFYDFFSFSHLSPPILNLRKCDPKDVEGWRDGDYFVMQIKICNGKLIQVVASVKGFFTVGKHFFQSHSLLDLLQNLSQAFANAYESLMKAFVGHNKLGNLPYGFRANTWLVPPPVAECPANFPSFPSEDEEWGGNGGGQGRNGEYDLRPWATDFSILASLPCKTEEERIIRDRKAFLLHSQFINVSIFKAVAAIQHVMNSRLNVKGHPDSVLHEDRTGDLSILVKHDSEDVKLECGVKVAGHQSSDMTTNEIARRNLLKGITADENVVVHDTSALGTVIVRHCGYTAIVSVVGDVKKEKSGAPDIEIDDQPDGGANALNINGLRVLLHKSSPAEVTGGGQSNQSNLIDSKSSRCLVQRVIKENLTKLEENSAAPERTIRWELGSCWVQYLQKQETSTDATSKGLANDQEAEAAVKGLGKQFKFLKKRDKKPSNISSTVEKEDNDSELCSEDVKSNLGQEGNVELSSEMGLKHLISKEAFSRLEQSGTGLHLKSAEELIKMACKYYDDLALPKLVTDFGSLELSPVDGCTLTDFMHLRGLQMHSLGRVVELSEKLPHIQSLRIHEMITRAFKHVVKAVVASVEKIEDLPVVIASTLNFLLGSCGVDVNASSANDDYLIKLTWLRKFLGAKFGWKLKDEFQHLRKLSVLRGLCYKIGLELVPRDYDMECQEPFRSCDIISMYPVCKHVGCSSADGRTLLESSKIALDKGKLEDAVNYGTKALTKMKAVCGPYHRTTASAYSLLAVVLYHTGDFNQAAVYQQKALDINERELGLDHPDTMKSYGDLSVFYYRLQHMEMALKYVNRALFLLHFTCGLSHPNTAATYINVAMMEEGMGNVHVALRYLHEALKCNQRLLGADHIQTAASYHAIAIALSLMEAYSLSVQHEQTTLKILQAKLGPDDLRTQDAAAWLEYFESKALEQQEAARTGTPKPDASIASKGHLSVSDLLDYISPDQGSKGSDVQRKQRRSKVLQISDKTHDTHHNLQTDGAVFIDATDKATATVDINEIGTLTSIHPEEPEETDNISSIEATVTTEVVEDTTLDEGWQEANSKGRSGNATGKKYGRKKPVFAKLKVNGCEYSNGRESGSRRDIISPAGKTVPKNIIREMQTVKQSKSSSLNPRGTSIGLPASVSRGSSPSANLSAIASKSLSYKEVAAAPPGTVLKPLSEPSEGKMEQSMCAETANVEHGNNISVVDDVVDDNGETEGTHDTESQSEETAPEIDKVSSCSQEKGLEAKRSKLSASAEPFNPGALYHPLNSVSVTCVYDVTASQGMLVEPVVPPVAARVPCGPRSPLFYRNNNSYGSFLRYQTPILEQNGFGSPRVMNPHAPEFVPSKIWQMTGTGDLSGSEEAMNTEVKEVDKKLSREVNGSNPKKSSAEEKSELARQILLSFIVRSAKQNMDGECEALINDKRLNHSQNSSDAVTSDTAIIKILYGNEGKDLDSQSSSNEEPKALDINNKKPGDGEGFTVVKKRRKNRQQLTNEVTGLYNQQSICASVR

SEQ ID NO: 541 - protein, 257 aa, Gossypium hirsutum
MTHFVLVHGMCHGAWCWYKIVSLLKSGGHRVTPLDLGASGINPKTITDLASLSDYAEPLMALMASLPQDEKVILVGHSYGGVIISLAMESFPMKVLAAVYLTAFMPNHDSPIATGVAEYFRRVMAEPLMDFQLLFEDGSENPPTHALFGPKYMEAMVYQLSPKEDIELANTLLRQGKWFMKDLSKESLLSKEKFGSVDRVYIVCKDDLLIKESLQKWYIENSPTDDVKVIAGADHMAMFSKPQEVCKCLQEVAEKYN

SEQ ID NO: 542 - protein, 447 aa, Gossypium hirsutum
MGSGGSKGCCRVGGGGRDTAPAASSSSSGGLRGRSKVKNRVFRSSCLGALSRSASPKPNFDHRKQPASESDLVKRESNRKLEGEAASNEEMQLPLPTPCISSGGSTSGAAVTAAHRSPSRCLSGISFLPGNLSFRFSRANSMGSSAEMLNPDDDSETLEPQQPPRNSCSPIIFNDSDGSGETLESNARFSRALSVGRLRDRVLGRAPTFCPLQQDIQITQQQLATSPSTTASAHASSVISHDEIETSRSREARYHDLLHHRSNFLERRRRIRSQVRALQRLGSRFENFSGHERSCILSGQHRSGRCTCRVNNRDSSSNDDTTGARSSVSRIVMLAEALFEVLDEIHQQSMVLSSRPSVSPIGSVPAPNEVVESLPVKVYKSPKLKNDEAVQCYICLVEYEEGDSIRRLPCNHEFHRTCIDKWLKEIHRVCPLCRGDICGPDLMPGEK

SEQ ID NO: 543 - protein, 472 aa, Gossypium hirsutum
MSIEPFNRLVKLAARGFYDDVTTKGDNQPKTGRGDNRGIAVVVLDALTRRQWVREEDLAKELKLHSKQLRRILRLFEEEKLVTRDHRRETAKGAKIYSAAVAATADTQTGGKEGEEKIKLHTHSYCCLDYAQIYDVVRYRMHRMKKKIKDELEDKNTVQEYVCPGCGKRYNALDALRLVSLEDEYFHCERCNGELVAESDKLAAQDVGDGDDNARRRRREKLKDMLQKMEVQLKPLMEQLNRVKDMPIPEFGSLQAWEARASAAGRAVNGDSGSNDPSKNSQGYGGTPMPFLGETKVEVAFSGLDGKEDVKSESASTSLKVLPPWMIKQGMNLTKEQRGEVKQESKPDGSSAQPEFSDDKKSTVENDDKKKIQDEYLKAYYAALYKKQQELEEAAKKQQELSDIPLATGLSDSSNRQVGMKAKRDDNEGEDDIDWEEAPVAGNTIESYKVNDLNVEAEESGDDEDDVDWEEG

SEQ ID NO: 544 - protein, 783 aa, Gossypium hirsutum
MTAETALRVSSSSSTVCNLNGFQRRPTPLSSSTRFLGLRPRASSSSISSSLSQFMGSVRIGSRLPISRQQKGKRRNFSLFAMAADESKRAVPLKDYRNIGIMAHIDVGKTTTTERILYYTGRNYKIGEVHEGTATMDWMEQEQERGITITSAATTTSWKDHRINIIDTPGHVDFTLEVERALRVLDGAICLFDSVAGVEPQSETVWRQADKYGVPRICFVNKMDRLGANFFRTRDMIVTNLGAKPLVIQLPVGAEDNFKGVIDLVKMKAVLWSGEELGAKFEYADIPADLQELAEEYRSQMIETIVELDDQAMENYLEGVEPDEETIKKLIRKGTIGISFVPVLCGSAFKNKGVQPLLDAVMDYLPSPLELPAMKGTDPENPEVIIERTTSDEEPFSGLAFKIMTDPFVGSLTFVRVYSGKLAAGSYVLNANKGKKERIGRLLEMHANSREDVKVALAGDIVALAGLKDTITGETLSDPDHPIVLERMDFPDPVIKVAIEPKTKADVDKMANGLIKLAQEDPSFHFSRDEEINQTVIEGMGELHLEIIVDRLKREFKVEANVGAPQVNYRESISKVSEVKYVHKKQSGGQGQFADITVRFEPMEAGSGYEFKSEIKGGAVPKEYIPGVMKGLEECMCNGVLAGFPVVDVRAVLVDGSYHDVDSSVLAFQLAARGAFREGIRKAGPRMLEPIMKVEVVTPEEHLGDVIGDLNSRRGQINSFGDKPGGLKVVDALVPLAEMFQYVSTLRGMTKGRASYTMQLAKFDVVPQHIQNELATKQQEVVA

SEQ ID NO: 545 - protein, 196 aa, Gossypium hirsutum
MAAKPLTSEAIALTEKKMDMTLDDIIKMSKTSSNKTKKQRRVLNKGQKPFNNAAKAKALKVQQYMDSRSSVRQGFLAQRRSNIPGNQFPLAAEAARRAAVAPVRIKNVNGVRVANLNKPRTGVPPVQRRAKNGGFAAKPRQHQPQQQQGGNVVTKQRPHTLDSLFANMKKERMNGPAQRNGSSRQRMPWRRGRFGN

SEQ ID NO: 546 - protein, 362 aa, Zea mays
MVAIENQSQAAVAAEAVAAPASRIPREARRLLHELAAAWADVADCRALEVVPLKGAMTNEVYQARWLTAGPAGQKEEPRAEREVRKVLVRIYGDGVDLFFDREDEVRTFECMSRHGQGPRLLGRFPNGRVEEFIHARTLSAADLRDPEISALVASKLREFHNLDMPGPKSVLIWDRLRNWLRTAKSLCPPEEAKEFRLDSLENQITALENECSGDYQWIGFCHNDLQYGNIMIDEETNVLTIIDYEYASFNPVAYDIANHFCEMAADYHSSKPHILDYSRYPDVDEQKRFVKTYLNISGEEPDAEVVENLLQSIEKHTLASHLVWGLWGIISDHVNDIDFDYKEYARQRFEQYWHKSAILTS

SEQ ID NO: 547 - protein, 421 aa, Zea mays
MAVDPRQVVAGFLTLSMFVMLGNMIKHDHFSPVTEELGFEATGVVSNTRKLDNDAEMSSVDTAGVEDLMDAVEEVKPCWTKPSPKNQPSNGFVTFSLTMGPEYHISQITDAVVIARYLGATLVLPDIRGNELGNKRKFQDIYNVDKFVRSLDGVVEVIEDIPDEVSAKKPAVIRVPNRVTESFITGTIQPIFQKNKYLRLAVIFSSVSLRPKETNNKDMDATACLAMFGGLELKHEYSEVARKMLDRLQELSKKSDGKVLAIDLRTDLLEKKSCKTTRGARRKGCYSPDEVLAFLRSVGFSANTTIYLTETSWYKGLDVLKEEFPNTWYKGDIMPAENKAEFLKSSNADLARALDLEICSQSDVFVPAVAGLFYGHVTGKRIASGRTQIVVPSQSSTSTHASDFISTYISNKNHLAYACYC

SEQ ID NO: 548 - protein, 506 aa, Medicago truncatula
MNKNMSPLILLPFALLLFFLFKKHKTSKKSTTLPPGPKGLPFIGNLHQLDSSVLGLNFYELSKKYGPIISLKLGSKQTVVVSSAKMAKEVMKTHDIEFCNRPALISHMKISYNGLDQIFAPYREYWRHTKKLSFIHFLSVKRVSMFYSVRKDEVTRMIKKISENASSNKVMNMQDLLTCLTSTLVCKTAFGRRYEGEGIERSMFQGLHKEVQDLLISFFYADYLPFVGGIVDKLTGKTSRLEKTFKVSDELYQSIVDEHLDPERKKLPPHEDDVIDALIELKNDPYCSMDLTAEHIKPLIMNMSFAVTETIAAAVVWAMTALMKNPRAMQKVQEEIRKVCAGKGFIEEEDVEKLPYFKAVIKESMRLYPILPILLPRETMTNCNIAGYDIPDKTLVYVNALAIHRDPEVWKDPEEFYPERFIGSDIDLKGQDFELIPFGSGRRICPGLNMAIATIDLVLSNLLYSFDWEMPEGAKREDIDTHGQAGLIQHKKNPLCLVAKKRIECV

SEQ ID NO: 549 - protein, 165 aa, Medicago truncatula
MIASSFCNADSMFSSEEGIDVRKMMGHKRSPCSVDQSNYNSIASKKQKPDLSISTKDRKEKIGERIVALQQLVSPYGKTDTSSVLKEAMDYIGFLHKQVKLLSAPYLETAPATQLQDTESCSLRSRGLCIVPVSFTNGVAEGNGADIWAPIKTTSPKHEKDVSQF

SEQ ID NO: 550 - protein, 355 aa, Medicago truncatula
MSSEGVGEDCLAWAARDASGVLSPYKFNRRELGSEDVYVKITHCGVCYADVIWAKNKHGDSKYPVVPGHEIAGVVAKVGPNVQRFKVGDHVGVGTYINSCRECEYCNDRFEVHCVKGSVYTFNGVDYDGTITKGGYSTSIVVHERYCFLIPKSYPLASAGPLLCAGITVYSPMIRHNMNQPGKSLGVVGLGGLGHMAVKFGKAFGLRVTVFSTSMSKKEEALSLLGADQFVVSSNQEDMRALAKSLDFIIDTASGDHLFDPYMSLLKISGVLVLVGFPSEVKFSPASLNLGSRTVAGSVTGGTKEIQEMVDFCAANGIHPDIELIPIGYSNEALERVVNKDVKYRFVIDIENSLK

SEQ ID NO: 551 - protein, 339 aa, Medicago truncatula
MADQNKKPEIFELNNGTMQLLVTNLGCTITSFSVPAKDGVLSDVVLGLDSVESYQKGLAPYFGCIVGRVANRIKNGKFTLDGVEYSLPLNKAPNTLHGGNVGFDKKVWDVLEYKKGETPSITFKYDSHDGEEGYPGDITVTATYTLTSSTTMRLDMEGVAKNKPTIINLAQHTYWNLAGHSSGNILDHSIKISANHVTPVDQNTVPTGEIVPVKGTPFDFTSEKRIGDTINQVGLGYDHNYVLDCGEEKAGLRHAAKVRDPSSSRVLNLWTNAPGVQFYTGNYVDNVTGKGGAVYGKHAGLCLETQGFPDAVNKPNFPSVVVKPGEKYQHSMLFEFSIE

SEQ ID NO: 552 - protein, 350 aa, Medicago truncatula
MATTQTELIPPPQVPLGTQGFQVSKLGFGCMGLTGAYNDPLPEQDGISVINYAFSKGVTFFDTADIYGGSGANEILLGKALKQLPREKIQLATKFGISRRDVSRLADVTIKGSPEYVRSCCEASLKRLDVEYIDLYYQHRIDTSVSIEDTVGELKKLVEEGKVKYIGLSEASPDTIRRAHAVHPITAVQIEWSLWTRDIEEEIVPLCRELGIGIVPYSPLGRGFFGGKGVTENVPAVSSLTSHPRFQAENLNKNKNIYDKIESLGKKHGCTPAQLALAWVLQQGKDVVPIPGTTKIKNLDQNLGALAVKLSEEDLREISAAVPVDDIAGSRYYNGFDHISWKFANTPPKV

SEQ ID NO: 553 - protein, 251 aa, Medicago truncatula
MYISGGSSSMGRSFKESLKLLEADIHHANTLASDFPREYDGACLQMRMSYSPAAHLFLFLVQWTDCNLAGALGLLRILIYKVYVDGTTTMSTHERKASIREFYAVIYPSLLQLEKGVTDAEDKKQKVVCMERYRRREDEEHKQFSDIDFEREEECGICMEMNSKIVLPNCNHVMCLKCYHEWRARSQSCPFCRDSLKRVNSGDLWIFTDSRDIVDMETVTRENLRRLFMYIDKLPLIIPESLFDPYDSHLR

SEQ ID NO: 554 - protein, 537 aa, Medicago truncatula
MGFFSTIFGFFGFGVGISIGLVVGYFLFIYFQPTDVEDPKITPIVDQDDETLQKMLPEIPNWIKNPDFDRVDWLNKFIELMWPYLDKAICKTAKNIAKPIIEEQIPKYKIDSVEFQTLTLGTLPPTFQGMKVYVTDEKELIMEPSIKWAGNPNVTIAVKAFGLKATVQVVDLQVFLLPRITLKPLVPSFPCFANIYVALMEKPHVDFGLKLLGADLMSIPGVYRIVQELIKDQVANMYLWPKNLEVQILDMAKAMRRPVGILHVKVLHAMKLKKKDLLGASDPYVKLKLTDDKMPSKKTTVKHKNLNPEWNEEFNLVVKDPETQVLQLNVYDWEQVGKHDKMGMNVITLKEVSPEEPKRFTLDLLKTMDPNDAQNEKSRGQIVVEVTYKPLNEEEMGKGFDETQTIPKAPEGTPAGGGQLVVIVHEAQDVEGKHHTNPQARLIFRGEEKKTKRIKKNRDPRWEDEFQFIAEEPPTNDKLHVEVVSSSSRTLLHQKESLGYVDINLGDVVSNKRINEKYHLIDSKNGRIQVELQWRTA

SEQ ID NO: 555 - protein, 229 aa, Medicago truncatula
MKMMSLVRPLLMRRGFSTSSEKMVASVLFERLPVVIPKIDPNVYAFQEFSFRWRQQYQRRYPDEFLDRSDARGKGDYQIDYVPAPRITEADKQNDRRSLQRALDRRLYLLLFGDAYGAPSGKPVWHFPEKVYESEDTMRKCAESALKSVLGDLSNTYFVGNAPMAHIVVQPKEEQTGSTSFKKFFFKSQVIAKNKFDIGKGEDFVWVTKDELMEYFPEQAEFLNKMIIS

SEQ ID NO: 556 - protein, 529 aa, Medicago truncatula
MECVGARNLTAMAFCISPSLRLRRKKICWRRREVSSNVIRLRSMKVNAKAGGAGSESCVVAKEDYADEEDFVKAGGSELVFVQMQQKKSMDLQSKLADKLPPICVGDGILDLVVIGCGPAGLALAAESGKLGLKVGLIGPDLPFTNNYGVWEDEFKGLGLEGCIEHVWKDTVVYIDNKNPISIGRSYGRVSRHLLHEELLRRCVESGVSYLGSKVERIVEASNGHNHVVCEYDTVVPCRLATVASGAASGKLLQYEVGGPKVCVQTAYGVEVEVENSPYDPNVMVFMDYRDYMKNNVQSLEAKYPTFLYAMPMSRSKVFFEETCLASKDAMPFDLLKKKLLSRLKTMGIKVTKTYEEEWSYIPVGGSLPNTEQKNLAFGAAASMVHPATGMTSSLSEAPQYASVIATILNDGTARDIVTYGRSKENPSMRAWNTLWPQERKRQRSFFLFGLALIVQLDIEGTRTFFRTFFCLPEWMWQGFLGSSLSSKDLLLFALYMFIIAPNNLRMSLVRHLLSDPTGSTMIKTYLTI

SEQ ID NO: 557 - protein, 377 aa, Medicago truncatula
MAATTTTPAALRFLPPNPTTRKTFNFFSILKPNFNSLRSFSHSSLFSLSHKYPLSPCKCSFTAPVSTTTYEFSDNASEMELRLNIGSMDVRSTKDISVDANDTSLTIRVLQSGSPITLIDTNPLFDRIKPSETIWYIDDDDLVVNFKKNDPELKWPDIMESWESLAAGSSQLLKGTSIYLVGDSTEINQKVAEELATGLGYTPLSTKELLETYSNQTVDSWLLAEGSDSVAEGEGTVLESISSHVRAAVATLGGKHGAAGRSDKWRHLYAGFTVWLSQTEASDEDSAREETHRNVKDRITAYTNADVVVKLQGWDPAYAKSVAQGCLSALKQLILSDKKLPGKKSLYIRLGCRGDWPNIKPPGWDPSSEGGETLGTQ

SEQ ID NO: 558 - protein, 539 aa, Medicago truncatula
MAISDTPETTATATATVTTIETDTDLKRSSLRRRPSATSTAGGLFDAESAAADAVRDSGSDDSLNGKINNEEEVKDRKTDHAEGIVDDDDDNAVKKNGGNDVINDRENVAVDFKFTYRPSVPAHRRSKESPLSSGNIFRQSHAGLFNLCIVVLVAVNSRLIIENLMKYGWLIRSGFWFSSKSLRDWPLFMCCLSLAIFPLAAFVVEKLAQQKRISEPVIVLLHIVITTVAIIYPVLVILWCDSAFLSGSTLMLLTCIVWLKLVSYAHTTYDMRALAVSNEKGETMPDTFNMEEYPHNVSFQSLAYFMVAPTLCYQPSYPRTPSVRKGWVCRQLLKLVIFTGVMGFIIEQYMNPIVQNSQHPLKGNLLYAIERVLKLSVPNVYVWLCMFYCFFHLWLNILAELLRFGDREFYKDWWNAQTVEEYWRMWNMPVHKWMVRHVYFPCIRFGIPKGAAALTAFLVSAVFHELCIAVPCRMFKLWAFIGIMFQVPLVLITNYLKNKYRNSMVGNMIFWFIFCILGQPMCVLLYYHDLMNRKGEID

SEQ ID NO: 559 - protein, 514 aa, Medicago truncatula
MGFLVLLSLLPILILFIIHIYKIRSTSRASSTPPGPKPLPLIGNLHQLDPSSPHHSLWKLSKHYGPIMSLQLGYIPTLIVSSAKMAEQVLKTHDLKFASRPSFLGLRKLSYNGLDLAFAPYSPYWREMRKLCVQHLFSSQRVHSFRPVRENEVAQLIQKLSQYGGDEKGANLSEILMSLTNTIICKIAFGKTYVCDYEEEVELGSGQKRSRLQVLLNEAQALLAEFYFSDNFPLLGWIDRVKGTLGRLDKTFKELDLIYQRVIDDHMDNSARPKTKEQEVDDIIDILLQMMNDHSLSFDLTLDHIKAVLMNIFIAGTDTSSAIVVWAMTTLMNNPRVMNKVQMEIRNLYEDKYFINEDDIEKLPYLKAVVKETMRLFPPSPLLVPRETIENCNIDGYEIKPKTLVYVNAWAIGRDPENWKDPEEFYPERFIMSSVDFKGKNFELIPFGSGRRMCPAMNMGVVTVELTLANLLHSFDWKLPHGFDKEQVLDTKVKPGITMHKKIDLCLFPRKRKP

SEQ ID NO: 560 - protein, 148 aa, Medicago truncatula
MASLRIITFVSLMVLLMINTTEAQSTDIPSCATNLIPCADYLNSTKPPSSCCDPIKKTVETELTCLCNLFYAPGLLATFNINTTQALALSRNCGVTTDLTTCKHNGSAPAPTSGGSPPATTGGNKAAASRVSFTGFSFILLLASMMFN

SEQ ID NO: 561 - protein, 290 aa, Medicago truncatula
MKGEYVEQHSSNPNKGNETPPPSLLFSKPFHPFQLSHHECQPIGEDDNNNTSGGVATTQKPNTSGDGATIEVSRRPRGRPPGSKNKPKPPIIITRDPETVMSPFILDISGGNDVVEAISEFSRRKNIGLCVLTGSGTVANVTLRQPSTTPGTTVTFHGRFDILSITATFVPQQHGVSPAIPSNFSISLAGPQGQIVGGIVAGNLIAAGTVFVIASSFNNPSYHRLPLEEDEGGNSVSGGGEGNSQNVSGAVDSGQGQGGGGESCGMSMYNCHLPSSDVIWAPSARPPPPY

SEQ ID NO: 562 - protein, 231 aa, Medicago truncatula
MQVIAKAKAEEKKIGLTETWLRKHRPIYDAATRHPFILSIRDGTVQSHSFKTWLAQDYLFVRAFVPFVASVLIKACKESDDSDDVEVILGGMASLKDEILWFKREANKWGISFSDVVPQKANINYCRLLESLMSPDVDYTVTLTAFWAIEVVYQESFAHCIEEGSKTPPELKETCERWGNEGFGQYCQSLQKILNQRLQKASDDELKKAEVMLLSIIEHEVHFWNMSRGNV

SEQ ID NO: 563 - protein, 814 aa, Medicago truncatula
MKVESRSHNVHHAHGEEEKVMTRKQKAESKAHEVEHSPKKAKVEDEKNGHTNGKSASDVVQEYDEFCKATNEQLSLEQMKEILEANDLDSSGSDLEITRRCQDLLFFGALEKCMVCNGNMEFDGRRYGCRGFYSEWSSCTFSTREPPRKDEPIKLPDSVQNSPVSDLLKKYQDPSKRPQRDLGLAIKPFTGMMISLMGRLNRTHQYWKKTIEKHGGKVANSIIGASCLVASPAERDRGGTSKLADAMERGIPVVREAWLTDSIEKQEPQPLESYDLVSDLSVDGKGIPWDKQDPGEEAIESLSAELKLYGKRGVYKDTKLHEQDGKIFEKDGILYNCAFSLCDQGRKLNDYCVMQLIVVPENSLHLYFKKGRVGDDPSAEERLEECENVDNAIKEFVRLFEEITGNEFESWEREKKFQKKPLKFYPIDMDDGVEVRHGALGLRQLGIAATHCKLEPMVANFMKVLCSQEIYKYALMEMGYDSPDLPIGMVTNLHLKRCEEILLEFIEKVKTLKETGPKADAIWSDFSQKWFTLMHSTRPFIFRDYQEIADHAAAALEGVRDITLASHLIGDMSGSTIDDPLSDTYKKLGCSITPLEKNSNDYEMIVKYLEKTYEPVKVGDIEYGVSVENIFTVESSACPSYADIVKMPNKVLLWCGSRSSNLLRHLHKGFLPAICSLPVPGYMFGKAIVCSDAAAEAARYGFTAVDRPEGFLVLAIASLGNEITELKSPPEDTTSLEEKKVGVKGLGKKKTDESEHFVWKDDIKVPCGSIIASEHEDSPLEYNEYAVYDPKQVRISYLVGVKYEEKDAVIDTAE

SEQ ID NO: 564 - protein, 103 aa, Medicago truncatula
MERVTKMVSERPVVIFSKSSCCMSHTIKTLFCDFGVNPAVYELDEIPRGREIEQALISRLGSSPSVPTVFIGGELVGGANQVMSLHLNRSLIPMLKKAGALWL

SEQ ID NO: 565 - protein, 268 aa, Medicago truncatula
MATSLSTTTLLSYRRNPQHMYIQPCSVKNEVSRTMHASVSIDSLSINEESDKCSSLLANRRAILASGVSLLGFPGVSLAVVKQGLLAGRIPGLSEPDEQGWRTYRRPDEKSGGHGVGWSPIIPYTFKVPQEWEEVPVSIADLGGTELDLRFSSSKEGRLFVIVAPVLRFSDIIGDDATIEKIGPPDKVISAFGPEMIGENVEGKVLSSNVAEHEGRTYYQFELEPPHIFITATAAGNRLYLFGVTGNGLQWKRHYNDLKKISDSFRVV

SEQ ID NO: 566 - protein, 276 aa, Medicago truncatula
MLRFITSSSAPKFFPTKPFHIISPFSSRLSVRSMADSAAPFSKIQIQRDDNTTFDAYVIGKHDAPGIVVLQEWWGVDFEIKNHAAMISQLGRGFKALIPDLYRGKVGLDVAEAQHLFDGLDWPGAVKDIHASVDWLKANGSKKAGVTGFCMGGALAIASSVLVPHVDAVVAFYGVPSSELADPAQAKAPVQAHFGELDNFVGFSDVTAAKALEEKLKASGIPHEVHIYPGNSHAFMNRSTEGINRRKNMGLPDEDEASVQLAWSRFQSWMTQYLSS

SEQ ID NO: 567 - protein, 384 aa, Medicago truncatula
MLGTTLQFGGVGGDDRFYIPVKTRKNQNQRKQAQRDKNVEEESITVASVEESVSNIDRFLDSTKLLVPAQYFSKTTMRGWKTCDVEYQSYFALNDLWESFKEWSAYGAGVPLLLDQWESVVQYYVPYLSAIQLYGQPTEKSSAKPRYISEDSDGDYYRDSCSEGSSDCESGKRTECFTAQRSSKHLTSGVSSQMSTLSIHDKHNTVQEGFSSSDDSETGNPQELLFQYLEQGHPYGREPLADKILDLARDYPALMSLRSCDLLPNSWMSVVWYPIYRIPTGPTLKDLDTCFLTYHTLHTPLTGSGPTPGPVLVYPSEMDGVPNISIPTFAMAAYKLKGSIWMKKEVSENQVMNSLVQAADKWLRLVQVNHPDHQFFKSHGTYYK

SEQ ID NO: 568 - protein, 512 aa, Medicago truncatula
MAPANTSAAALSETEYEMVKNIIDIEVLEELSLADCSIYKVPHNLRKVKQEAYTPQLISIGPIHLGNEELQPMQQHKKRYFHFFYERLSQFNQQSMIKNYKLYLENKEQEIRKCYAEKFPNISKEKFVETILLDAVFIMELLLRNSSWKSDTSKHEHEYKQSKSFRWKHSDDYILTQAWLSKSITRDLILLENQIPFFVLKHLYDTVVPNDDKKPNHEDFLDLALEYFAFYDTQKSSSLETKFVLDKNQTKKYYYVSGVIGDVGSGNSVSKKKHSDKSMSSNHGFQGPKHFTDLIRFFYLPADLGKSGCSHIFPRTVTKLMDSGVSFEKVVGRRLLDITFEKKPFLSNFLCLGCLPSFSCLNHFKARLRISQLKVDHTTECVLRNLIALEQCQYQEQPYICNYVSLVDSLIHTQVDVDLLVEKEVIVHEMGSDKEVAMLVNGLCKHVVVNSTCYYEIINELNKHYQNIWNRTMAALWLVYFRDAWRASSTLVGIAFLVYTAFNFVRLAKILF

SEQ ID NO: 569 - protein, 350 aa, Medicago truncatula
MSARQIIEVPQTPLLRSHHEGNGGGRRTSLAQLLGRATGRRGPSVLVRETAARELEERRADWGYSKPVVALDMSWNMAFVVVSAVMLAFTVDERPNMPIRVWIVGYALQCFVHVVLVWIEYHRRNRRDSRQRQRESDAEFSSDGNDSDDSDGDVNSTQSRFTKRCESINTGVSFLWWMVGFYWVVSGDDILLQDAPRLYWLAVVFLAFDVFFAIFCVVLACLIGIALCCCLPCIIAILYAVAGQEGASEADLSILPKYRFRLSNNEEKDSGGAGSMVPIETTSAYLATERILLPEDAECCICLCPYEDGVELHTLPCNHHFHSSCIVKWLKMNATCPLCKYNILKGNEQV

SEQ ID NO: 570 - protein, 294 aa, Medicago truncatula
MEKAASSVLKQMNITSRLVLPGSCCCSSFQSSSSSSLHFPFPISVPFKFRSRRSTNSVSDAAFPVPSSVIKVAATDLSLAVKKKAADVSPELKGSSIFLIGMKSSLKTNLGKQLADVLRYYYFDSDNLVEEAIGGASAAKSFKESDETGFYDSETEVLKQLSSMGRLVVCAGNGAVQNSTNLALLRHGITFWIDLPLEIVARDVTENPTQFPSFEISTSGSYPEVMDELCALYNKYKDGYATADAIISLQKVASRLGYESLDDITTEDMALEVLGEIEKLTRVKKMMAEAARPF

SEQ ID NO: 571 - protein, 905 aa, Medicago truncatula
MAGKRKTSSKTTTSGNAVTVDSASGDTVTVTADSSSGNTVRKSRRLTKSSSSSADAANVAADSATGETRSRSRKTTKSSNSNSSGDGPSVSADSTSGKAQKKSGKKTDLDKGKSVVASSGVKKEPKTESDPMNVDGGDNEVSNSKFIGDPIPIEVAKLRWPKRYQEKEKKKSRSRSNSDEEEVILARCHYTETQVDEGVIYKLYDDAYVQGETDDYHFICKIVEMFEAVDGGLFFTAQWYYRANDTVIKQLGNLIEPKRVFFSEIQDDNPLDCLVKKLTILRLELKKDFDATKDIIPPCDYYCDTLYLLPYSTFLKLPSETTENGSEISSTISNETEGNGKAEVDSKCSNTDICVEKKKPQMKLLDLYSGCGGMSTGLCQGGILSGSDIITKWAVDLNQDACQSLKLNHPETEVRNVSAELFLLLLKEWEKLCSYFSLIENSVPHEEYANLFNEEDEEEEENDGAVEENIDGQIFEVSEVHDVRYDDKETGPGLFFKVSWKGYNSDKDTWEPITGLSNCKERIKDFVTRGFKSSLLPLPGHVDVVCGGPPCQGVSGFNRFRNYDNPSEDEKNKQLVVYMDIVQYLRPRFSLMENVVDLLRFSEGFLGRYALGRLVKMNYQSRLGILAAGAYGLPQFRLRVFLWGAAPKENLPQFPLPTHDVIERGSVPVEFEGCLVAYSEGHRAQLQNKLVLNDAISDLPPIENDENRDDMEYGGPPLTEFQKFIRLSQNEMLGGSINKKSPKSLLHDHRSYEMNVDDYQRACRIPKRKGACFRDLPCVRMRNKKVELNPDVERELLPSGKPLVPNYAISFVRGTSPLPFARIWWDETVPTVVTRPEPHNQKILHPEQDRVLSVRENARLQGFPDFYKLCGSVKERYIQVGNAGCGSTWHSSTILSWTCISRCFY

SEQ ID NO: 572 - protein, 594 aa, Medicago truncatula
MFGLAAAAAATRVLCATLYSPSSSFTTTHHFSSHHLPSTLVSLSSLRFRCIPIKAMSETDAPKSASSSHGNKQALISLSDKKDLAFVGNGLQELGFTIVSTGGTASALESAGVAVTKVEQLTQFPEMLDGHVKTLHPNIHGGILARRDQKHHMEALNTHGIGTFDVVIVNLYPFYDKVTSAGGIEFKDGIENIDIGGPAMIRAAAKNHKDVLVVVDSEDYPALLEFLKGNQDGQFRLKLAWKAFQHVASYDSAVAEWFWKQTGGDKFPPSLTVPLSLKSSLRYGENLHQNAAIYFDRRLAEVNAGGIATAIQHHGKEMSYNNNLDADAAWNCVCEFRNPTCVVVKHTNPCGVASRDDILEAYRRAVKADPVSAFGGIVAFNVEVDEVLAKEIREFRSPTDGETRMFYEIVVAPSYTEKGLEILRGKSKTLRILEAKKNEPGKLSLRQVGGGWLAQDSDDLTPSDIKFNVVSEKTPQDGELHDAEFAWLCVKHVKSNAIVIAKDNCMLGMGSGQPNRVESLRIAMRKAGAAIKGAALASDAFFPFAWKDAVEEACESGIGVIAEPGGSIRDQDAVDCCNKYGVSLLFTDVRHFRH

SEQ ID NO: 573 - protein, 448 aa, Sorghum bicolor
MHAPPLVAFAGGACPATAASSSPSPWLASPRAAILAAPARLLRSRRGALRLEAKAAWRAAGGGRGPRVPAKGAVLASYMGAEEVVGPSSLLDEEELISHIRKELDNGKLPADVASNLEELYYNYRNAVLQNGDPNAYEIMLSNMTALFDRVLLDVQNPFTFPPYHKAVREPFDYYMFGQNYIRPLVDFRNSYVGNISLFHDMEEKLHQGHNVVLMSNHQTEADPAIISLLLEKTNPWISENIVYVAGDRVVMDPLCKPFSMGRNLICVYSKKHMNDFPELVEMKRRSNTRSLKEMALLLRGGSQLIWIAPSGGRDRPNPSTGEWYPAPFDSSAVDNMRRLLEHAGVPGHIYPLSLLCYEVMPPPQQVEKEIGEQRVISFHGVGLSVTEEIKYGDITAHTKNADEGRELFTNTLYNSVVNQYDVLKSAIFRDRGAAVSNNVISLSQPWR

SEQ ID NO: 574 - protein, 299 aa, Sorghum bicolor
MRAAQIDPSLAAPPKSRLKRLFERQVLRVSPAERLPSAPPGGGEKQDEVSEPSSLCLDGMVRSFLEDGGGAAERGAAARCCNCFHAGDTSDDEDGPAAADAAAADIAETIKGLVHCASLRERNLLADVSTLVERHRASGARKRDLLRLLAESLRAAGHDAAVCLSRWDKSASHPAGEHAYLDVLLPAASERGERERVLVDVDFRSAFEVARPTKAYRAVLQRLPSVFVGRDDRLRLLVAAAADAARASLKKRGLHLPPWRKLEYMRAKWLSPYDREAPPPPEATTGELAGNGEGGGPSA

SEQ ID NO: 575 - protein, 110 aa, Unknown
  Sequence found in Organisms: Gossypium hirsutum, Oryza sativa, Sorghum bicolor, Glycine max, Solanum lycopersicum, Acacia harpophylla, Amorphophallus konjac, Amsonia hubrichtii and additional organisms as disclosed in Tables 53 and 54
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLFYERKKYGFKKR

SEQ ID NO: 576 - protein, 791 aa, Sorghum bicolor
MSGGGGSSGRAAPRYAPDDPTLPKPWRGLVDGTTGYLYYWNPETNVTQYERPTPPDNQLLPPPPPLPPPPPRSRDRRDRSRSRSRSRTPPRRDHRDRDRDRDRRHDEHASSKSASAHHHPAPVAAAAADPSTEAYRRRHEITVTGDNVPAPITSFEAGGFPSEILKELQRAGFASPTPIQAQSWPIAMQSQDVVAIAKTGSGKTLGYLLPGFMHIKRLQNSTRNGPTVLVLAPTRELATQILDEAVKFGRSSRISCTCLYGGAPKGPQLRDLDRGVDVVVATPGRLNDILEMRRVSLKQVSYLVLDEADRMLDMGFEPQIRKIVKEMPHRRQTLMYTATWPKEVRRIADDLLVHPVQVTIGSVDELVANSAITQHVEVITPSEKQRRLEQILRSQDSGSKILIFCTTKRMCDQLARTLTRQFGASAIHGDKSQSEREKVLNHFRSGRSPILVATDVAARGLDIKDIRVVINYDFPTGVEDYVHRIGRTGRAGATGVAYTFFCDQDSKYAADLIKILEGANQKVPRDLEDMASRGGGRGRKRNRWASHSDRGGSRSELDSRSGRGSHGRDDYGSRGRYDSGETDGRSRRSARGRSRSRSRSHSRSRSPSPKRSRRHEARRSRTKSRSRSRSRSYRNHRASRSKSRSPVASRRYEKTAAISGSARPNSGHAEHKSPPRSHSVDDHVNHSDHKDDHMEDGKMERVDLDRSPSPQDDKSAPYSPVYNGKASGSMSPNVQPEADAKYVKPSGKPEPASPVRHSKGRDDDEEGIIDEDGEIAEDDPRANAAVQNGNN

SEQ ID NO: 577 - protein, 308 aa, Sorghum bicolor
MECLTTSFARNVGKEHSFVCSSKLVSENQWVPRRICCYVSSSTNSSQWCKFTNMAYPMSPIIRKRSHWRSFAASLNLEDGPAPSDSTSSSSEQTTADADGTTNGDASEDLLSQKLSSDELKALLADSERSKLLRRLSEANQYNRFLKRQLQIKDDAVVKFKGELAVLELELQALVGLAEEIANFDVPLGSRRINGKYIQSHLLSRLEAVHDKIVEHIKDVDSLKTKEISVYWVGMAENVQIMGSFDGWSQGEAMSMEYSGDYGRFSATLKLRPGRYEIKFLVDGEWRLSPEYPTAGDGMTQNNILIVE

SEQ ID NO: 578 - protein, 1009 aa, Sorghum bicolor
MDAAEASELQARLAAAVHALNHDASPSARLAANQWLLALQRSPQAWAVATSLLAAPDPPPPADLLFFAAQMLRRKIQSPGSAFPALGLAPQLLDALLLAARRFCAAPAPRQLLTQICLALAALALRAEGGVDGLFARMPHLPPPAVLELLTVLPEEAAQDQGGDTGVDAAARCRFTRELLAHAPAVLEFLHGQSEKAPTDDDGVPLHERNRRILRCLLSWVRVGCFLETPAAALATHPLLTFAFNSLQVSFSFEVAIEVMIELVSQHQEIPEAFLSKTPYIREVLLLPALANRSEKIIAGLACLMCEVGQAAPALVAEGGGQALALTDGLLRCVAFTSEDWEIAESTLQFWCSLAHFILGIDVKTAKRNVVRELFVPVFSSLLDALLFRAQMDTDSDGAPCIPEGLTQFRMNLEELLIDICLLLGAPAYINKLFSGGWDFSSQTIPWKEVEVRMYALSMVADTILQDESSFDFSIIMHFVNILSSRTPVELNGSLFLVYKSFGDVIGSYSKWLSSSQSNIKPLLLFCASGISKSISSNACSLALRKLCEDAPSFIHEPQNLEILFWISEGMNKGNLQLEDEEEIISAITHALSSVSEKELKKSSLARLLCSSYSAVEKIIDIDRDQSLRQNPAAYTQSLDLAVRGLYRMSALFHHLATSVTSGLVDDDIIIVLLGILWPLLEKLFRSSHMENVNLSAAVCRSLSSAMHSCGHHFHILLPKVMECLSANFLLFQRHDCFLRTAANVIEEFGHKEEYGALCVRTFETLSSASSISALNSSYTCDQEPDLVEAYTYFTSMFIRCCQKEAIVASSSLLELSFQKAAICSTAMHRGAALAAMSYMSCFLESVLAAVLESPECIPNGSPGVALIQILARCGEGLLSNVLYALLGVSALSRVHKSATILQQLAALCSFCEATAWKAVLSWNSLCGWLQSTVKSLPSEYLKQGEAEMIVPLWLKVLQDAGSDYLYSRTGDNIRSHQGYMQGKGGRTLKRIIRDFAESHRNVPIPSTS

SEQ ID NO: 579 - protein, 581 aa, Sorghum bicolor
MGSACSRKRGQLVQEDDLYSARFSKSGSFKWLLHTLPRSNSADVQRRTQGPAPGRCPSLVELCVAKVCEDINRYSDFSLLPRDLSQQIFNELVECGCLTEASLGAFRDCALQDVCLGDYPGVTDAWMEVVASQGQSLLSVDLSCSDVTDSGFNLLKDCSSMQSLACDYCDKISEHGLKTLSGFSNLTSLSIKKCAAVTAEGAKAFANLVNLVNLDLERCPKIHGGLIHLKGLKKLEKLNMRYCNCITDSDMKYLSDLTNLRELQLSSCKISDFGVSYLRGLHKLGHLNLEGCSVTAACLEVISELASLVLLNLSRCGICDEGCENLEGLTKLKALNLGFNHITGACLIHLKDLISLECLNLDSCKIGDEGLFHLKGLIQLKSLELSDTEVGSNGLRHLSGLRNLQSINLSFTLVTDIGLKKISGLSSLKSLNLDNRQITDTGLASLTNLTGLTHLDLFGARITDSGMNCFRFFKNLQSLEVCGGLITDAGVKNIKDLKALTLLNLSQNGNLTDKTLELISGLTALVSLNVSNSRVSNSGLHHLKPLLNLRSLSLESCRVTASEIDKLRLVALPNLISVRPE

SEQ ID NO: 580 - protein, 197 aa, Sorghum bicolor
MESPPLTAEAIAFTEKKMDMTLEDIIKMSKKKNPGGKKPPRQPIKKRPFQNGNSNKGNGKVQQFMESRSTIRQGVLAQRRSNLGGSQFPATKQAAKKAAAMPMRNGAVRWNKPSGSTLVQRRPVGDAFQNSKVESSQNQAAPRTMDALFAQMKAQRMRTVPQQQANPAPGRHFNQQRRVQQQQRRGRGYGGRNVGNQ

SEQ ID NO: 581 - protein, 658 aa, Sorghum bicolor
MASSPPPPPIRTVLAATLLLLLVYLLPHNAAAAAAVADASSAVNPFTAKAAFIRYWNRKVPNNRPHPAFFVAKLSPLPAADSASFPTALPDIRARLPELCTKAALLCPGPATTDAASLAASGPRGGGPFKGYSNANFSNYGTGGVAGADSFRNYSPDLNIAADSFRRYGRDSSGRADSFASYESDGNVVTANFTSYAGGATGGSGSFAAYAAETNVPDSTFTNYDAGANGRGRSFASYSQEANHGENGFSGYGKSGNGVRETFSSYGNESNVLGSGFANYGQSANGATDTFTGYGVEGNVPENTFRNYGAGGNAGVDTFKKYRDDANVGDDRFTSYAKGANGGAAEFQSYGNSANPGSTTFKGYGEGSNPNHHIGFKEYAGENNTFKGYAKTGVSFKEYHNTSSSTAALTVSAEAAASMQHHDHLKWSPEPGKFFREQELVSGNRMPMPDIRDKMPPRAFLPRAIAARIPFDPQAVSEAFGLPLDTALGKAVSSTVAECLRAPSKGETKRCATSAEDVVDFAVETLGDDIVVRSTASTAGSGGDVRLGTVTGVDGGKVTRSVSCHQSLFPYLVYYCHSVPKVRVYEADIMAAAAAADDDGGSDAGEKEIINHGVAICHLDTSDWSPTHGAFVALGGKPGEVEVCHWIFEGDMTWTVAD

SEQ ID NO: 582 - protein, 233 aa, Sorghum bicolor
MGLEMEVMSEAAAPTTAVVPAAAAREPGVDVDIYPLTRYYFGARDAAAAVPRGLETAADRALRLKANFAARGLRTSVHGVLLVELFDHPHLLLLQVRNSSFLLPGGRLRPGEEEVQGLKRKLSSKLSFVDADDDQTIEEEDDWQIGECIGMWWRSEFEAIPFPYMPPSFRAPKECIKLFLVRLPMSRQFIVPRNMKLLAVPLSQVHGNAQVYGPIISGIPNLLSKFSFNVISD

SEQ ID NO: 583 - protein, 591 aa, Sorghum bicolor
MGRGGGSRAAPAATAPPWHVLPDEVWEHAFSFLPADSDRGAAAAACRSWLRAERRSRRRLAVANCYAASPQDAVDRFPAVRAVEVKGKPHFADFGLVPPAWGAAAAPWVAAAADGWPLLEEISFKRMVVTDDCLEMIAASFRNFQVLRLVSCEGFSTAGLAAIAAGCRNLRELDLQENEIEDCSIHWLSLFPESFTSLVTLNFSCLEGDVNITVLERLVTRCCNLKTLKLNNAIPLDKLANLLRKAPQIVELGTGRFSADYHPDLFSKLEAAFAGCKSLRRLSGAWDAVPEYLPAFYCVCEGLTSLNLSYATVRGPELIKFISRCKNLQLLWVMDLIEDHGLAVVASSCNKLQELRVFPSAPFDAAEQVSLTERGLVDVSASCPMLESVLYFCRRMTNEALITIAKNRPNFTCFRLCIIEPHTPDYTTHQPLDAGFSAIVESCKGLRRLSVSGLLTDSLFKSIGAHADRLEMLSIAFAGNSDLGLHYILSGCKSLKKLEIRDCPFGDKPLLANAAKLETMRSLWMSTCSLTLGACRQLARKMPRLSVEVMNDPRRGCPLDSLTDESPVETLYVYRTIAGPRSDTPACVQIV

SEQ ID NO: 584 - protein, 116 aa, Glycine max
MTFEEKTIYQTTLASIPHYTLLECVLGICFTVITILLQLPYEYIDNNPVPTIVFKGRPRTFHAFIICIIFAFSGATNALVAFNKSRFSRLCGYYAMASMASALAILLWALCCTCIN

SEQ ID NO: 585 - protein, 143 aa, Glycine max
MPSARLSGSPRLDVAIDMGNPFLNLTVDGFLKIGAVAATRSAAEDTYHIIRNGNISSHDFEKTLKKMCKEGVYWGTLAGVYLGMEYGVERIRGTRDWKNAMIGGAVTATLLSVATTNNKDKIVPDAITGAAIATAAEFINYLT

SEQ ID NO: 586 - protein, 818 aa, Glycine max
MSGPVTIADYSNGGALSCAERTKSVDAIPELDHLSILTNGEIDGFSVGQLLLFNGESYSGSLYGNVSEGHGTYVWCDGCVYEGEWRRGMRNGYGKLRWPSGAVYEGDFSGGYIHGTGTYIRSDKLKYKGRWRLNLKHGLGFQVYPNGDTFEGSWMQGTQEGPGKYTWTNGNVYVGNMKGGIMSGKGTLTWINGDSYEGNWLNGMMHGFGVYTWSDGGCYVGTWTFGLKDGKGTFYPRGSRLPWVQEIYLSALRKRGLLPDLRKQKQVRDVKVPENHMSSHVSSDKFAKGNLLNLEESNRRNVSLERRWSLEVSIEKVIGYDSALRFAESVPESRDGEVDAMIPILEREYMQGVLISEVVLNNMFSSMSRRARRLQKKLVKEIKRPGEAIIKGHRSYDLMLSLQLGIRYTVGKITPIPTRGVRASDFGPKASFWMDFPKEGSQLTPTHQSDDFKWKDYCPMVFRNLRELFKIDAADYMMSICGNDTLRELSSPGKSGSVFFLSQDDRFMIKTLRRSEVKVLLRMLPDYHHHVKSYENTLITKFFGLHRIKPSSGQKFRFVVMGNMFCTDLRIHRRFDLKGSSLGRSSDKIEIDESTTLKDLDLNYSFYLEPSWRESLLKQIEIDSKFLEAQHIMDYSLLLGVHYRAPQHLRSHVSYNQSRSVDGLAMLAEEDPLEDEVFYPQGLVLVPRGGDDDSVVVGSHMRGSRLRASSAGDEEVDLLLPGTARLQIQLGVNMPSRAEQISGKQKQEKQMFHEVYDVVLYLGIIDILQDYNMTKRIEHAYKSLQFDSLSISAVDPTFYSHRFLEFIQKVFPPNATTG

SEQ ID NO: 587 - protein, 346 aa, Glycine max
MGATKSGRVKLGTQGLEVSKLGFGCLGLTGAYNEPLPEQDGISIIKYAFSKGITFFDTADVYGAGANEILLGKALKQLPREKIQLATKFGIARLDFSNMLIKGSPEYVRSCCETSLKRLDVEYIDLYYQHRVDTSVPIEETVGELKKLVEEGKVRYIGLSEASSDTIRRAHAVHPITAVQIEWSIWTRDIEDQIVTICRELGIGIVSYSPLGRGFFGGKGILENVSASSSLKVHPRFQAENMDKNKNIYERIESLAKMHRITPAQLALAWLLQQGEDVVPIPGTTKIKNLDQNIGALAVKLSEKDLREISEAVPIGDVAGGIHYYGLEHITWKYANTPPKDSSIST

SEQ ID NO: 588 - protein, 327 aa, Glycine max
MDSPAVSSIHFHNAHVLPEPDLFMHTPGGNRIPAHATILASASPVLENVIASNRVVKIHGVPDGAVTAFVAFLYSSRCTEEDMDKYGIHLLALSHVYSVPQLKQRCIKGLAQRLSTENVVDVLQLSRLCDAPDLYLKCVKLLRNRFKAVKETEGWKFLESHDPWLELDVLRLMGELEKRKRRVRKWREEERLYVQLSEAMECLEHICTEGCTEVGPYEVEVGRQKTPCSKFATCQGLQVLIRHLGTCNRKLKGGCLRCKRMWQLFRLHSSICLCQNSCKVPLCRQIRLKMEQENMKDDARWKLLVRKVASAKALSSLALPKRKLDQS

SEQ ID NO: 589 - protein, 245 aa, Glycine max
MDRYQRVEKPKAESPINENEIRVTSQGRTRNYITYATTLLQEKGSSEIVLKAMGRAINKTVMIAELIKRRIVGLHQNTQIGSTDITDTWEPLEEGLLPLETTRHVSMITITLSKKELDTSSTGYQPPLPVDQVKPLNEYDEEGEGSPRIRGRGRGRGRGRGRGFYNGGMEYGDGWDGGRGYGGRGRGRARGHAFRGRGRGRGYGVQPVGYYDYGEYDAPPPPRGRGRGRGRGRGRGRGRDQVPAA

SEQ ID NO: 590 - protein, 687 aa, Glycine max
MIDHSLRGEDLMNPMGASTVSNEELKEIESLGREDIEEAPIVPEDVSRIAPWIRQITLRGLVASFLIGIIYSVIVMKLNLTTGLVPNLNVSAALLGFVFIRAWTKVLAKAKIVSTPFTRQENTIIQTCAVACYSISVGGGFGSYLLGLNRRTYEQAGVGTEGNNPGSTKEPGIGWMTAFLFVTSFVGLLALVPIRKIMIIDYKLTYPSGTATAVLINGFHTPKGDVMAKKQVHGFLKFFSASFLWAFFQWFYSGGDNCGFVKFPTFGLKAWKNSFYFDFSMTYVGAGMICSHLVNLSLLLGAVISWGIMWPLIRGLKGEWFPASIAESSMKSLNGYKVFISIALILGDGLYNFVKVLYFTATNIHATVKRKNPETFSDNQKPLPLDDLRRNEVFARESIPIWLACTGYILFSIVSIIVIPLMFPQLKWYYVVFAYLFAPSLSFCNAYGAGLTDMNMAYNYGKVALFVLAALAGKNDGVVAGLVGCGLIKSIVSISSDLMHDFKTGHLTFTSPRSMLLSQAIGTAIGCVVAPLTFFLFYKAFDVGNPDGDYKAPYAIIYRNMAILGVEGFSALPHHCLQLCYGFFAFAIAANLVRDLAPKNIGKWIPLPMAMAVPFLVGGYFAIDMCMGSLVVFLWHKLNRNEAGLMVPAVASGLICGDGLWILPSSILALFKIRPPICMSFLSASAS

SEQ ID NO: 591 - protein, 230 aa, Glycine max
MPLPTVVSPFSSSSGTFLSTVTARSSLPPKRNVSPSPSPFSTLSRRDIALLSFFSLSLSAPSSAIDIGISGPKDWLKEQKKKASKYLLAPVDASRQILRSAYLTLTETDAAYTDEDLEKMQQLFISAARDCVPQDRNSFVTLQANTGVEVCTFRLIVKNAASLLGNKDPVKLKAEALLDNLIRSFTSVSGLASETNIQLASDRKKIADAVSDTISDLDKFEQGIRDCLET

SEQ ID NO: 592 - protein, 411 aa, Glycine max
MVTMEESPRSPEAKLGLRVEDLWDIQEPQLSPDEKFNACFESIPVSAFPPPPSNQEIEIKSDATLAEAVKILAEHNILSAPVVDVDAPNDASWIDRYIGIVEFAGIVVWILHQSEPTSPRSPSGGAANTAAVNGITSEAFGLESASTTSGNFFEDLTSSQLYKNTKVRDISGSFRWAPFLALERSNSFLTMLLLLSKYKMKSIPVVDLGAGRIDNIITQSSVIHMLAECAGLQWFESWGTKKLSEVGLPMVTPNHIIKVYEDEPVLQAFKLMRKKRIGGLPVMDRGSSTAIGNISLKDVQFLLTAPEIYHDYRSITAKDFLTAIRSYLEKHEGAFPMSGDLITCNKDCTIKELIQLLDHEKIHRVYVADNDGNLEGLITLRDIISRLVHEPRGYFGDFFDGVLPMPPNSRV

SEQ ID NO: 593 - protein, 2470 aa, Glycine max
MESVLSPIVERTFNFAVDPIIRQLAYILRCRQNVDELLTSFESLELEKESIDRRCDQAQNNLQNIEAKVKEWSRKVDEFKTELEKFRNDEGHTKTGLSNVLFLFPYFWNRHRLGRQAKKMAEIVKNLIDESAKFNDVSYTDNLTFNDFTLSNPGYMGFASRHSTVEKIIAKLEDSSVRMIGLHGSGGMGKTTLIKAIAKKAMEKKLFNVVAVSEITANPNPQKIQEDIAYRLGLRLEGEGENARAHRLMTRLKQEKENTLIILDDLWDRLDLNKLGIPLDGDVDDNDLNTKTSNAKQGPKEVTKEKSLGDYKGCKILLTSRDKNVLTDKMEVKSTFCVEELDDDDALRLFRKEARIQGEMSKWKQEIVKKYCAGLPMAIVTVGRALRDKSDSEWEKLKNQDLVGIQNSMEISVKMSYDRLENEELKSIFFLCAQMGHQSLIMDLVKYCFGLGILEGVYSLGEARGRISTSIQKLKNSGLVLDGSSSIHFNMHDLVRDAALSIAQNEQNVFTLRNGKLNDWPELKRCTSVSICNSDIIDELPNVMNCPQLKFFQIDNDDPSLKIPESFFKRMKKLRVLILTGFHLSSLPSSIKCLSDLRLLCLERCTLDHNLSIIGKLKKLRILSFSGSQIENLPAELKDLDKLQLLDISNCSVVKRIPPNLISRLTSLEELYVRKCFKEVSEEGERNQSQISFISELKHLHQLQVVDLSIPCAQVFPKELFFDNLSDYKIEIGNFKTLSAGDFRMPNKYEKFKSLALELKDDTDNIHSQKGIKLLFKRVENLLLGELNGVQDVINELNLDGFPHLKHLSIINNPSIKYIINSKDLFYPQDVFPKLESLCLYELRKIEMIYFSSGTEMICFSPFTDCSFTKLKTIKVEKCDQLKNLFSFCMVKLLASLETIGVSNCGSLEEIIKIPDNSDKIEFLKLLSLSLESLSSFTSFYTTVEGSSTNRDQIQITVIENEHSEMAPPLFGELVEIPNLENLNLISMNKIQKIWSDQPPSNFCFQNLIKLVVDDCDNLRYLCSMSVASSLRKLKGLFVSKCKMMEKIFSTEGNSAGKVCVFPKLEEIHLDYMDKLTDIWQAEVSADSFSSLTSVYIKSCDKLDKIFPSHMEGWFASLNSLKVYSCESVKVIFEIKDSQQADASGGIDTNLQVFDVRGLLKLEQVWSRDPGGILNFRKLQSIEMYDCKSLRNVFPASVAKDVPKLEYMSVRWCDGIVEIVACEDGSETNTEQLVFPELTDMCLYDLSSIQHFYRGRHPIECPKLKKLEVRECNKKLKTFGTGERSNEEDEAVMSAEKIFPNLEFLDIDFDEAQKWLLSNTVKHRMHRLKELRLSQVNDGERLCQILYRMPNLEKLQLWEAEHLLKESSESRLGTVLQLKELVLWESEIMDIGFEREPVLQRLEVLSLYECHRLRNLAPPSVSLAYLTNLEVRDCVRLRNLMASSTAKSLVQLKSMKISRCDELEEIVSDEGNEEEEQIVFGKLITIVLEGLEKLKSFCSYKKCEFKFPSLEVLIVRECPMMERFTEGGARAAKLQNIVTAYEEGKEEAKWQWEGDLNATIQNVWEDQLLESASTVSSLSLLGDSPLQVIWLDSRRIPKSCFSNLNSLAVEGCQFLTDVVIPFYLLPFLTNLEELQVRKCGSVKSIFDVKTTTGLGAAAFPRPLPFSLKKLTLERLPKLENVWNEDPHGILTMQLLQHVIVEKCKCLTSVFPASVAKDLEILVVKDCEELMEIVAEDNADPREDNLELTFPCPCVRSLKLQGLPKFKYFYYCSLQCDMFQTPNEDEMPTSNLKCLSLGEKGLEMIKRGEFQRNFIHKLQVLTLCFHNGSDVFPYEILQLAPNIEKLVVYNASFKEINVDYTGLLLQLKDLCLESLPELVSIGLENSSIQPLLGNLETLEVIGCSSLKDLVPSTVSFSNLTYLEVERCHCLLYLFTSSTARSLGQLKRMEIKWCDSIEEVVVSKEGDESHEEGIIFPQLNCLKLERIGKLRRFYRGSLLSFPSLEELSVIKCEWMETLCPGTLKADKLVQVQLEESSDAIKLENDLNSTMREAFRKKFWQSADTAFVIDLKDSPLQEIWLRLHSLHIPPHFCFIWLNTLIVDGCHFLSDAVLPFSLLPLLPDLKTLEVRNCDFVKIIFDMTTMGPLPFALKNLILERLPNLENVWNSNVELTFPQVKSLALCDLPKLKYDMLKPFTHLNQVCIQKLTPNIEHLTLGQHELNMILSGEFQGNHLNELKVLALFFHIESDVFVQRVPNIEKLEVLGGFFREIFCFDSLNVDEAGLLSQLKVICSDSLPELVSIGSENSGIVPFLRNLETLQVISCFSSINLVPCTVSFSNLTYLKVESCKSLLYLFTSSTARSLGQLKTMEISWCNSIEEIVSSTEEGDESDENEIIFQQLNCLKLEGLRKLRRFYKGSLSFPSLEEFTVWRCERMESLCAGTVKTDKLLQVTFKLFLDDIPLETDLNSAMQNR

SEQ ID NO: 594 - protein, 644 aa, Glycine max
MEPHDEEEIHNCLIKLRSNPERRRDKVYIGCGAGFGGDKPLAALKLLQRVQELNYLVLECLAERTLADRYQIMMSGGDGYDSQISNWMHMLLPLALERGTCIITNMGAMDPLGAQQKVLEIANSLGLNVSVAVAHEVSVTNIVGSGFSPAKSYIMEGGISTYLGAAPIVRCLEKYQPNVIITSRIADAALFLAPMVYELGWNWDELEHLAQGSLAGHLLECGCQLTGGYFMHPGDKYRDMSFQQLLDLSLPYAEICFDGQVCVSKSEGSGGVLNFNTCAEQLLYEVGDPGAYVTPDVVIDFQDVSFLPLSSSRVCCHGAKPSTISVPDKLLQLVPQDCGWKGWGEISYGGYECVKRAKAAEYLVRSWMEEIFPGLNHRILSYIIGFDSLKATSGNGNESSQTTSEDNRLRMDGLFEQKEQAIQFTREFIALYTNGPAGGGGISTGYKKETLLEKHLVKREDVFWRTGIKRSTRSQSNKVVDPDHNLRHILTLPPKLQAETDKSLESVSLGSSCSPAPSGQKIPLYSVAHSRAGDKGNDINFSLIPHFPPDNERLKLIITSQWVKSVVSNLLDLSLSPDLDAKIPRDKWVNENVKVEIYEVKGIQSLNIVVRNILDGGVNCSRRIDRHGKTISDLILCQQVVLPP

SEQ ID NO: 595 - protein, 195 aa, Glycine max
MAFTVAIGSGVAIIPCGNTTTAIPYTRGGGHRTRRKLHLHVARAKKPLNGDGVSIYTELLKTEVSVFENKPLGDNDAALKFVEKIDRQFQYPDFWEGSQWDWLGIFVKFSPIIGVAVAACLAIYGCFTFHEPPKEMREAAERLYSVQSGVESSAESGLESSADSSVESGKVIEEPDTYDSDVFDSNPTEVAPSLE

SEQ ID NO: 596 - protein, 361 aa, Glycine max
MALEAVNDRKAEVQAFDDSKTGVKGVLDSGVTKIPTMFHVKLDSTHTSPTHSNFTIPIIDLQNINSNSTLHAEVVDQLRSASQKWGFFQVINHGVPVEVLDEMISGIRRFHEQDAEARKPFYSRDSSKKVRYFSNGKLFRDMAGTWRDTIAFDVNPDPPNPQDIPAVCRDIVAEYSKQVKALGTTIFELLSEALGLDPSYLEEMDCTKALYVMGQYYPKCPEPELTMGISKHTDCDFITILLQDQIGGLQVLHENHWVNAPPVRGALVVNIGDILQLMTNDKFISVYHRVLLRNMGPRISVATFFMNFTISKCTSKSYGPIKELLSEENPPVYRDMNMKEILTNYYAKGLDGSSYLLPLRL

SEQ ID NO: 597 - protein, 378 aa, Glycine max
MATTTSSSSEEAPNTKKNKKERLGWIEWLRGWFYLVYEMLFQRIMASHLHNPMPLPPVNDLTCIVTGSTSGIGLEIARQLAQSGAHVVMAVRNTKAAQELIQKWQVDSEGLSIPLNVEVMQVDLLSLDSVTRFAEAWNARSAPLHVLINNAGIFSIGEPQKFSKDGYEQHLQVNHLAPALLSILLLPSLIRGSPSRIVNVNSIMHHVGFVDTEDMNVTSGKRKFSSLVGYSSSKLAEIMFSSILNKRLPAESGISVLCVSPGIVQTNVARDLPKLVQAAYHLIPYFIFSAQEGARSALFAATDPQVPEYCDMLKADEWPVCAFISQDCRPANPSEEAHNVQTSYEVWEKTLEMIGLPSDAVERLLDGEEVKSHYRQEQ

SEQ ID NO: 598 - protein, 196 aa, Glycine max
MAFTVASGSGVAIIPCGNTGTAALFPHRTRRNLHVARAKKPLNGDDVSVYAELLKAEVSVLENNKPLDDNDAALKFLEKIDRQFQQPDLWEGPQWDWLGIFIKFSPIIGIAVAASLAIYGCFTFHEPPKNVREAAERLYSVQSGVESNAESDDVESSAETDVESSAESSSEVFKEPDAYDSDVFDSNPTEVAPSLE

SEQ ID NO: 599 - protein, 249 aa, Glycine max
MILCFWFSFRLVQVGNLGLQLPWYFLQIIVSAWYFISVVGNLFESYFISLKKYKSLHSGKVRYLAIVIESEEAYQISKVVKLSQWLDSIGVKNVCLYDMNGVLKKSKETMFQKLKNAKSIEEVSEVVTLHAPDHMTLEFLSYLDGKEAVAKAANLIFVENSKRHNLGGELDLQILLEPQMNKALQIVGSKGPEPDLLLVYGPVRSHLGFPAWRLRYTEIIHMGSLNFMRYGSLMKVINNFTKVHQNYGT

SEQ ID NO: 600 - protein, 62 aa, Unknown
  Sequence found in Organisms: Zea mays, Oryza sativa, Sorghum bicolor, Glycine max, Solanum lycopersicum, Amaranthus tuberculatus, Amsonia hubrichtii, Aristolochia fimbriata and additional organisms as disclosed in Tables 53 and 54
MGKVHGSLARAGKVRGQTPKVAKQDKKKKPRGRAHKRMQYNRRFVTAVVGFGKKRGPNSSEK

SEQ ID NO: 601 - protein, 507 aa, Glycine max
MMELFLSCMVLFVLTLATLGAHWIWVVSSSRAGSKLPPGPFPLPIIGNLLALGKKPHQSLAKLAETHGPIMTLKFGQVTTIVVSSADMAKEVLLTHDHSLSSNRVIPQAVQVHNHHNHSITFLPVSPLWRDLRKICIANLFSNKTLDASQDLRRSKLHQLLHDIHRSSLAGEAVDVGKAVFNTSMNLLSNTFFSLDLVHSSSSAAAVDFKDLVLKIMEESGKPNLADFFPVLKFMDPQGIKTRTTVYTGKIIDTFRALIHQRLKLRENNHGHDTNNDMLNTLLNCQEMDQTKIEHLALTLFVAGTDTITSTVEWAMAELLQNEKAMSKAKQELEETIGRGKAVEESDIGRLPYLQAVIKETFRLHPAVPFLIPRKANADVEISGGYTIPKDAQVFVNVWAIGRNSSIWKNNANVFSPERFLMDSEDIDVKGHSFELTPFGAGRRICLGLPLAMRMLYLVLGSLINCFNWKLVEDDDVMNMEDSFGITLAKAQPVILIPEKVHGVIVS

SEQ ID NO: 602 - protein, 375 aa, Glycine max
MSKTSEIITCKAAICWGIGKPVTVEEIQVDPPKATEVRVKMLCASICSTDISSTKGFPHTNFPIALGHEGVGIIESVGDQVTNLKEGDVVIPTYIGECQECENCVSEKTNLCMTYPVRWTGLMPDNTSRMSIRGERIYHIFSCATWSEYMVSDANYVLKVDPTIDRAHASFISCGFSTGFGAAWKEAKVESGSTVAVFGLGAVGLGAVIGSKMQGASRIIGIDTNENKRAKGEAFGITDFINPGDSNKSASELVKELSGGMGADYSFECTGVSTLLSESLEATKIGTGKAIVIGVGIEITLPLGLFAILLGRTLKGSVFGGLRAISDLSILADKGHKKEFPLQELFTHEVTLADINKAFELLKQPNCVKVVINMP

SEQ ID NO: 603 - protein, 309 aa, Glycine max
MRSLAAPHSFRVFVNSPIFRPIKLPFLTLNPLSSPSRRSPASVQCAVQFRPCIDIHKGKVKQIVGSTLQDLKGGDGSDPVTNFESDKSAAEYAALYKQDGLTGGHVIMLGADPLSKASALEALHAYPGGLQVGGGINSDNCLSYIEEGASHVIVTSYVFNNGQMDLGRLKDLVQIVGKDRLVLDLSCRKKDGKYAIVTDRWQKFSDVFVDPDVMEFLANFADEFLVHGVDVEGKKLGIDEELVALLGKHSPIPVTYAGGVTEMSDLERIKTAGMDRVNVTVGSALDIFGGNLAYEEVVAWHAQQNASAV

SEQ ID NO: 604 - protein, 169 aa, Glycine max
MAQQSSPPRRQTPPPSQYLEVNCRSSGKIRRFAAGTGAGFAVALINRKLKGTVVAASHIEAVKDGKEEEPIAFGPTSLLSNFGEGWKLQTVTLTDLSSEVGNGQFQQMAMQKPGLVPGVPGPARVSNPISFVYLVKIMFAFILIFVLVAIFTLFLDNLPAFILFLKSIT

SEQ ID NO: 605 - protein, 389 aa, Glycine max
MGLIRSMRSRSQRVVQEQEAAECVGVVVGDSMRQSCWANMPQELLREVLLRIEASEDTWPPRKSVVSCAGVCRSWRHITKDIVKTPELSSKITFPISVKQPGPRENLLRCFIKRNRSTQTYYLFLSLTSTLAEDGKFLLAARKCRRPTCTDYIISLDADDMSKGSNSYVGKLRSNFLGTKFTIYDSQLPHTGAKIMKSRSTRLVNLKQVSPKVPTGNYPVAHISYELNVLGSRGPRRMHCVMDSIPATAIEPGGVAPTQTEFSLNNIDMFPSFPFFRSKSNRAENSMSGPLVDQKDGMLVLKNKAPRWHEQLQCWCLNFHGRVTIASVKNFQLVASAENGPAGPEHDKIILQFGKVGKDLFTMDYRYPISAFQAFAICLSSFDTKIACE

SEQ ID NO: 606 - protein, 655 aa, Glycine max
MFDWNDEELANIVWGEVGEGDDHIVPYPEASEDLNDKKEWSQEASATKLIDQKRIEAKTDFHQGKLGSSSKLDIIEGQSASESGTNSWPDLSLSTAAKTDQGSLGAADVSKTLEETTQLEKDVEKQGDFVNYAWDNIGSFDDLDRIFSNDDDPIFGHVSLENSDELWSSKDVSNSTVPILLETPNPTSALRNRSEPLEIKAEYVQQNDRSFSPRFKRIGDSLSHDIEKAPANIFNVGYDRDRIAPADKEQQDFGQNNQLKARKKSQGKLEGKSLKEFYGSWSPSSTTSGQFQNQLVSSVIQSSPSSILGQWNELQGPETLYQDITNTYVTSSAYGNLTNTYSSMSMLPQAQSGVLMRQPLLSRYEASLGVMNPVSKSVDLVKPLTMTPQEKIEKLRRRQQMQAMLAIQKQQQEFGHQVPSTNKSMNEKCAIEIHSQLCDGADPEIEDLRTALDPPTEQDDSNTMSLAIDDHFVEDTILYMLQDAISKLDVKIRLCIRDSLFRLAQSAMQRNYANDTSSTNNTSREELKVAAREESNSQNRYARIADVETKTNPIDRTVAHLLFHRPLELTGNYPDKLESPISAKIQFESREANMEKFHMGCLPDEDLKSNQQFSHQGLEAQPEDQFKNSRCIDTSENASNNVLADAGDQVLEALQ

SEQ ID NO: 607 - protein, 459 aa, Glycine max
MVTIHCSHLVVPSEPTPSSTLSLSLCDQIKLPNHGSQLYLYSNTSITHHHLIHTLSASLSKALTHYYPFAGRLRRIPGGRFQLLCNASGAVLIEATCSSQFSFKYFRDFAPVHAVPKINYDDVPIEDVPLLVAQVTRFPNGFITLGLSLCRALLDGNSASSFVNSWAKLAKGENLDSSLIPLLDRTKLDSFKLNKPPRFEHPEFLPPPLLTQQHTQMEGQLGSTILELTKGQVEKLKKKASDFGSGYGINNGNGSVRPYTSFEVITGHLWRCVCKVRYAGGDLGQPTRLTTLVNCRNRLRPSLPTAYFGNATFPTVTPTCSFDEIMHKPLSYAVGKVREAIGKMSDEYVRSALDYIASVEDFDLFRDTFYGSGDGKGKFKGDPNLYMVGWTNFKYFETDFGWGKPVSLIPGNINSNGKAFLLENASGDGFIVAVCLLESHVDALRKLFYEDMEDASSKL

SEQ ID NO: 608 - protein, 817 aa, Glycine max
MEAIPYSIPSTKLHSSLHIYTGVTRIRSLPLRPPPISIKPLYSPNFLILHRHRLRCVAESSNNHHHHDHDHHHGHHHHHHHHHHSHGANLTGPQKAVIAFAKATRWMDLADILREHLHLCCFSTALFVAAAICPHTLPKPLVKPLQNSLIFVAFPLVGVSASLDALIEISSGKVNIHVLMAMAAFASIFMGNSLEGGLLLAMFNLAHIAEEYFTSRSMVDVRELKENNPDFALVLDTNDDDKLPNTFDLAYKRVPVHDVTVGSFILVGTGESVPVDCEVFQGSATITIEHLTGEVKPLEAKVGDRIPGGSRNLDGRIIVEVMKTWKESTLSRIVQLTEEAQSNKPKLERWLDEFGERYSQVVVVLSIAIAVIGPFLFKWPFVSTSACRGSIYRALGLMVAASPCALAVAPLAYAIAISSCARKGILLKGGHVLDALASCHTIAFDKTGTLTTGGLVFKAIEPIYGHHVRNNESNVPSCCIPTCEKEALAVASAMEKGTTHPIGRAVVDHSEGKDLPSVSVESFEYFPGRGLTATVNSIESGTGGAKLLKASLGSIDFITSLCQSEDESEKIKEAVNTSSYGSEYVHAALSVNQKVTLIHLEDRPRPGVVNVIQELQDEAKLRVMMLTGDHESSARRVASGVGINEFHCNLKPEDKLSHVKDISRDMGGGLIMVGEGINDAPALAAATVGIVLAHRASATAIAVADVLLLRESISAVPFCIAKSRQTTSLIKQNVALALTSILMASLPSVLGFLPLWLTVLLHEGGTLLVCLNSVRALNEPSWSWKHDIFHLISEIKSRLLSLKTNITGSNSIITTNL

SEQ ID NO: 609 - protein, 120 aa, Unknown
  Sequence found in Organisms: Glycine max, Glycyrrhiza uralensis
MVQRLTYRKRHSYATKSNQHRVVKTPGGKLVYQTTKKRASGPKCPVTGKRIQGIPHLRPAEYKRSRLPRNRRTVNRAYGGVLSGGAVRERIIRAFLVEEQKIVKKVLKIQKAKEKQASKS

SEQ ID NO: 610 - protein, 883 aa, Glycine max
MEQGSTDTRVDANPSLSSHEEIQSLDFDTECETKMTNSAGNGAGGSSYVEEGVRKKRGRKSKKEMGKMLDATAMEGGVSEQRPSRKRKKYDEMAEFEMSGTEKKYGLRGCKQEMEPKANRRKAKCDEEGPLTCHQCKRNDKGRVVRCKCCNKRRFCLLCLQAWYPHLKENDIAEKCPVCRGNCNCKACLSCDELIKQMREFAKADKEEKVELCMYLLQVLLPYLRQLDEEQLIENETEAKIQAKDHFALKSDCIREIIICFIIMDKIFTFELPDCYVLQTISSSYSPLLPMYDNCKTSIFDYHRSCTKCSFDLCLICCRELRGGQLVGGADPIELEFVWQGRGYLHAEKKDEEVKQNASDDDCKPEVREWSRSGWLAQSDGSIPCPKVNDECNHGFLELRSILGQHFVSELVCKAKELVQAYKLQNVVKTADNFCSCLKLDRNTDVSYSNMRKAASREDLTDNYLYCPKAVDLQYKDLRHFQWHWEKGEPVIVSNVLECTSGLSWEPLVMWRALRHVTNTKRGQHLAEKTIDCLDWTEGEINIHQFFTGYTNGRKDWLAWPQILKLKDWPPSNLFEEQLPRHCAEFISSLPFKEYTDPHKGSLNLAVKLPNGSLKPDLGPKTYIAYGFPQELGRGDSVTKLHCDMSDAVNVLTHIAEVKLDSDQLTIIEKLKQKHLEQEKRELLGDDQDGGTNVDMLNNSSSTINALDKQIKINQGDLLFGGDASDGALWDIFRRQDVPKLQEYLKKHFREFRHVHCCPLKQVIHPIHDQTFYLTMEHKRKLKEEYGIEPWTFIQKLGDAVFIPVGCPHQVRNLKSCIKVAMDFVSPENVGECFRLTEEFRTLPINHRSTEDKLEVKKMTIYAMEDVIGKLEKARSGLTKGPE

SEQ ID NO: 611 - protein, 729 aa, Glycine max
MISEPASSLRKSNFQDRRLSIIDVSSADDSLLDGNPLSHQRSENQEQADVLYTPNSKKFEDAATKLQQWDHEPHSNDSSGIGKPKKNSKCNLRKSLAWDSAFFTSAGVLDPEELTIIIEGVEKDEKPELPSIQEDVYKSCESISTLASDSLTFESVEMEGDLFEDVRASIQKSSKKSSPAASNIKVPSSPSVPLFQTHDSSKKVGMVSCNKMKVPPASKNPSAGMQGFGKMTKKNNPIFPQIPQKHVATRRESSILMQSKVPGRSSLSSTIPSKRDSLGNPHVKSERDKAKRIVGDRVSSVAKASVVRGSRGSVPKPTLPSKSPSGPTVSTRTKSVTSTSSVVKTPSRVASRNKAEPEISSLSRLMSATKLSSSISPASSISDWSSSESSSTTSMAKRVCNSSRPSIDCGSSRKVLLNTDADQGTHPQTPLSDSSLERQEARQSGIISQKERTVPGATVLPPVSKKPSGLRLPSPKIGYFDGVKPLVRTPRGSVVPGGLPKHGAESPREGQNKAELGKLQPSRSFVSIDNTKPNNQQPPHPNPFHESLDVAIKTSNSVQNGKSSSDISIGAVENTSHFHVVEKAHHDLPPLKGVNNQENAHHDDQIDCLSKQVGHMDINFEIGEKFNSDSLYLLQNDISFQDKSNGLDLSSHKELIDCPKKDELFNGLSTTYLYVSPTSFDVVASTRRPFAVKDSFCNMDGVVFTDSTVSEAKSTNLPVPESIIMKENE

SEQ ID NO: 612 - protein, 755 aa, Glycine max
MVVKMMRWRPWPPLLSKKFQVRLHVRRLQGCDLLQNAALQGSRLVLEIRWKGPKLILGSLRWNSVARNFTKEADFELDGGGAAVVHWDEEFQTMCNLNGYRDNVFHPWEIAFTLFNGLNQRPKNKVPAIGTALLNIAEFASSTDQKDFDLNIPLTLTGGSGEPSPLLCISISLMELSVAQESLEPVQRSIVPVPSPSAKSGETALAEKDELSAIKAGLRKVMILTEFVSPKKAKKGCREEEGSEGRCSRSEDGEYNYPLDSESLDDSEEGETDGGKEDSSVRKSFSYGTLASANAGGFFHSNARVNCNDEDWVYYSHRKSDVGCSQREDSTASSSQPYLVQSSKRSILPWRKRKLSFRSPKAYKGEPLLKKVYAEEGGDDIDFDRRQLSSDESLSLTWYKIEDDTSAHRSSISDFGDDSFAVGSWEQKEVTSRDGHMKLQTQVFFASIDQRSERAAGESACTALVAVIADWFQNNCDLMPIKSQLDSLIREGSSEWRNLCENDAYRERFPDKHFDLETVIQAKIRPLTVAPGKSFIGFFHPEGMDEGRFDFLHGAMSFDNIWDEISRAGQECPSNGEPHIYIVSWNDHFFILKVEYDCYYIIDTLGERLYEGCNQAYILKFDSNTMMYKTPNVAHSSDDKTSNDQQTVAEILDPNNSQTQQVNSKEVDSVAGEKEQLRTEQEEQVICRGKEACKEYIKSFLAAIPIRELEADAKKGLISSASLYHRLLQIEFHYTQLLGETSPMAELRDLSSCNN

SEQ ID NO: 613 - protein, 424 aa, Glycine max
MHRKLSPLKPQILKDITGLTETERMKRNSVYPSALNCDDILHEILLRIPPPTISKLIIVSKIWLRVICSPSFRQCYLRQWGQSFRLLGFFVCNFLYLGRPRDGYRRPRWEPALPILSTCKDGDDLKLSGILKHLGYFIDSSKGIILSGFHPKTYYVYNTVTKQKYELPEPQQFYKVLCMALIVEEYLDSDICYKVIRARCECKLKERNTVSIETYSSKTRQWKQSTLMCSTTFALCPRTAAMVVGGVVHWFAMWGKLAIYDPRLGDRYIALIKLPTGVLTHEHEESVLGESSDGLLQYGQSNNLGLEIWILEKESGANSSIYCNCTHLKYKWILRWRLNFKVLWKQMPSLSTHSKETQILSFLPQNSTSIFIRSGWNILLCDLETKTVEIVNYQGRGGTISWESSKVVPYFLPAWPHTSSVSVS

SEQ ID NO: 614 - protein, 337 aa, Glycine max
MALKLVNLGFHSSIPCSPRPLKDRFVLRSSKVEQISFTESENSLIEALLGIQGRGRSSSRQQLNAVERAVQVLERLGGVPDPTKSNLIEGRWQLIFTTRPGTASPIQAAASIEDGKRILFRFDRAAFSFKFLPFKVPYPVPFRLLGDEAKGWLDTTYLSSSGNLRISRGNKGTTFVLQKQTEPRQRLLTAISSGKGIKEAIDELISLKQNTGQEDPELEEGEWQMMWNSQTVTDSWIENAVNGLMGKQIIRKNGRIKFLVDILLGLKFSMSGNFVKTGSGVYGVTMDDAAIIGGPFGYPLELKNNFILELLYSDEKLRVSRGNNSILFVHVRTDALR

SEQ ID NO: 615 - protein, 419 aa, Glycine max
MDMGKKEGEAPVLWFETSDSVCCQHQFEPDGRLSVVIVDDSRPLYQRMAGSFMNKFFPSGYPYSVNEGYLRYTQFRALQHVTSAALSVLSTQSLLFAAGLRPTPAQATAVSWILKDGMQHVGKLICSNWGARMDSEPKRWRLLADVLYDIGIGLEVLSPLCPHLFLEMAGLGNFAKGMAVVAARATRLPIYSSFAKEGNLSDLFAKGEAFSTLFNVVGIGVGIQLASTICASIQGKLVAGPLLSIIHLYSVSEEMRATPINTLNPRRTAMVVADFLKAGIVSSPADLRYRDNLLFNVQVKEDTGNVRVGKNVHKVIKPSRLLELKQVFPEEKFLLNFGNKCIDMVLEQDASGEDALRGWLVAAYAARTESSSHELSATSVLHEAYEKMNGVFPVFLRELQNKGWHTDRFLDGTGSRFSF

SEQ ID NO: 616 - protein, 211 aa, Glycine max
MEESKKRVRDESSYSPESQTQLVDSPESESQRVDSPESKIRRVDSSESQLDSVLDSEVRLQDDIFNILDDADNVPERDSVQGLDSVIKSFEDEINAPGSDSGSGDPTQEPDSGELQSNLGYLLEASDDELGLPPTVVDGEETGRVGPEMTELARLMGFEDDIPSYDAFGFGSGFAAESDGGAGGFVTVDGLFDYSDPAADVLWRSESLQAM

SEQ ID NO: 617 - protein, 235 aa, Helianthus annuus
MSGPECCQNPPAPSSGGESGDLLQIASLNSYVSGNPDSKVAVILISDVYGYGAPKLRQLADKVAAAGYYVVVPDFFYGDPLTPGTNIEDWLKNHAPEQAVDFAKRVIQALKEKGVTKIGAAGFCWGAKVVVELAKDGEIQFAALLHPSFVTLDDIKGVKIPIGILGAEIDKRSPPELVKEFEAALVANEVNNFVKIYPGVAHGWTVRYKDEDAAEVKCAEEAHQDLVDWFGKCRH

SEQ ID NO: 618 - protein, 762 aa, Solanum lycopersicum
MDPYSSGEELVVKTRKPYTITKQRERWTEEEHNRFLEALKLYGRAWQRIEEHIGTKTAVQIRSHAQKFFTKLEKEALTKGVPTSQALDIEIPPPRPKRKPSNPYPRKTSAAGHSSQVGAKDGKYSTTFSSICEERNLFDLEKEPITEKPGGNEKLGNVKETQNKKNCSQGLTKEGASAASMSSGKSLQAHVAPTDVCAFSESVSVTKGVVNNDNANKSFLIVESKEHQQSEILDIRQSFQGNSSCNTFDGGKSCQSSEKLAQGEKKHPSFQPNHLGEFSRNDMQVLHNYPRHVPVHILDGTNGSQIAPDMFNHESTSQQINGVPGLPNLYSNPASSTTSEHHSNAPQSSIHQSFSCFHPIFTPIRDPDDYRSFFQLSSTFSSLIVSALLQNPAAHVAASFAASFWPYANMERPTDSPTDNTASQINSAPSMAAIAAATVAAATAWWAAHGLLPLCSQFQSSFTCVPTSATSMQVDACQPRVDKNEGREGTHDSPHVQEPVPECSEALQEQQSGSKLPPSLSSESEESEGRKLKTGLTATDTEQGAAVTKINEPNAEKGGKQVDRSSCGSNTPSSSEIETDALEKDEKGKEEPQESNINLLAGEAANRRYRNFISPTESWKEVSEEGRIAFQALFTREVLPQSFSPSLDLKNKGKIILEKLKQKPDEKVQCGPQLDLNDMASNICSSHQTMEDNVLLIGNKEDVETCLPMIELGQVRLKARRTGFKPYKRCSLEANDSRVTSSNCQDEEKSSKRLRLEGEAST

SEQ ID NO: 619 - protein, 689 aa, Solanum lycopersicum
MEETSLDSEQNVAGQGSGRFQEIESDDQNSEKIESDELFVQNGVQIEANGLDDHNCVTEDGQKEFVAPAVGMEFESYDDAYNYYNCYSREVGFRVRVKNSWFKRNSREKYGAVLCCSSQGFKRIKDVNRLRKETRTGCPAMMRMRMVDSKRWRVLEVTLEHNHSLGTKAYKTIMKTGTGNKKKLDSNCNAEVQTIKLYRALVIDAGATRNANFSARRCQTSSDCHDKLNLRKGDTQAMYNYFCRMQLTNPNFFYLMDLNDEGQLRNVFWIDARSRAAYAYFVDVIYIDNSYLSNKYEIPLVAFVGTNHHGQSMLLGCGLLAGETKASYVWMFKAWLTCSLGRFPQTIITERCKVLETAIHEVFPRSLHRFALSHILRKVPEKLGGLRNYDVIRKALFKTIYEGLKPFDFEAAWRVMIQRSGVGDHEWLCSLYNDRAKWAPVYLKDTFFAGMATARSNETLTAFFDKYVHKQTPLKEFLDKYELALQKKFKEEALADMESRSSNPELKTRCSFELQLSKVYTREIFKRFQLEVEEMYSCFSTTKLHVDGQVVIFLVKERVLEEGNRREIRDYEVLYNREAAEVRCICSCFNFYGYLCRHALCVLNFNGVEEIPSKYILSRWKKDYKRLCALDVESSFTESTEQVQWYSQLYISALQVVEEGVISLDHYKVALNAFEESLSRVHHIEEKTK

SEQ ID NO: 620 - protein, 442 aa, Solanum lycopersicum
MIASTVRKPLFGVTLFTLSLFLILFFFAPFSFFSDPSVTFNSSRRARPEIWSIRRLAEWRPCNWWLQPPTNALPAKANGYIRVDCYGGLNQMRRDLCDGVGIARLLNATLVLPKFEVAAYWNESSGFEDVFDVDFFIQQMKGFVNVVKELPIEIATKDPVRVDCSKRKGQFDYVESVLPSLLKHGYISITPAMSQRRDRYPLYAKAALCQGCYSALRLTSTLEKKALELLEAIPKPFLSLHLRFEPDMVAYSQCEYSGLSLASAKAIDAARVDRKPWTGETARIWRNRGKCPLTPNETAFVLEALAIPTNTTIYLAAGDGLMELEGLTSVYTHVVTKSSLLSGEDFTTMHGNTKAALDYYVSINSDSYMATYFGNMDKMVAAMRAFRGLYKTIFLNRKAFALLTSQGFKGKELTEALWKVHRDDFIMGRGSALPDCFCEFNV

SEQ ID NO: 621 - protein, 155 aa, Solanum lycopersicum
MNGAMNMHGDMAPPVPHAAVNNHNMMMHMTFFWGKNAEILFSGWPGYDNIGMYVFALIVVFLLAFFVELLSHSNYIKESANHVTAGLIQTALYGVRIGLAYLVMLSVMSFNGGIFLAAISGHTLGFLVFGSRVFKKSPLTAYAKASDLPSMPCNC

SEQ ID NO: 622 - protein, 710 aa, Solanum lycopersicum
MGKLGKKARKFAKKNLPSVLRDRRKKKALFKKRYSSKNVQSNVEDQAKVIDHSNERNTEVEAFEDLPLEAPFMENDCDGVVDSSDSDGYLSEDINYENGTESEPEKLLEGDKCTSELMMQNIKIQENLAIQKRKLERLKRKDPSFSKFLEKHKDIEAMQNGVVFSDEDEMSNHGRDSATEDNQGKDEGRVLTVSAISSWCRLIKEEHKEEVFVCLLNAYRAACHYGAESIGLRFQNAETFCSLVMSVLSEADNILRGLLGLSSFSYKKEAVLELKDTPQWVNVKPLIKSYLRSTLSLLDQVTDSEILAFALTRLRDSLPFFDAFPYLLQRLIKTTIHLWATGGGMLSSSSFSILLDVASLFTTDWFDNCLAKAFVAYLAQSRAMDIVNNKHLQFLRNSLVDLCSLDVQKSLSKATVSVRQLAKVLQWGLHTKKKEALQRICSWEYANCINLWVGFIARNVRDYDLQAFFFTMVQLINGVVRLFPGPRYFPLRLNCIQWLNDLSNSTGVFIPIASFVLDVLEYKTVGERGKPGPALFFQSVLKLPKSCLKSQTFQDECITSAIEQLSSHFLQWSYHISFPDLATVPLIRLKKFNESKTKESQCRVVKHLIEQVEKNVDSVQKKRNEVAFSPNDHQSVETFLQFEKSSLSSPFTQYCRSVLDKAALRGSHKNEKISLPTRDKSKRKRDDSSINVFGHKDVDTVNGSKKRVKR

SEQ ID NO: 623 - protein, 238 aa, Solanum lycopersicum
MVELKFLGMDFGCALGSLSNGQFPEKDCLLPLISKLLGYAIVAASTTVKLPQILKILQHKSVRGLSVVAFELELIGYTIALSYCLHKGLPFSAFGEYLFLLIQAIILVAIIYYFSQPLGMKTWMKGLLYCAVAPTVLAGQINPVLFEALYASQHAIFLCARIPQIWKNFKGKSTGELSFLTFFMNFAGSMVRVFTSLQEKAPMSVALGSVIGVLMNGTILSQIIIYQKPTPPKGKKKD

SEQ ID NO: 624 - protein, 489 aa, Solanum lycopersicum
MATDMEVQQNGKETVAVVNGCCKKGPGYASPLAAMDGPKESLIYVTCIYTGMGRGKPDYLATVDVDPNSPSYSKVIHRLPMPYEGDELHHSGWNSCSSCYGDPSAARRYLVLPSLISGRIYAVDTQKDPKAPSLYKVVQPDDVVKKTGLAFPHTAHCLASGEIMLSCLGDKDGNAEGNGFLLLDSDFNVKGRWEKPGHGPLFGYDFWYQPRHNTMISSTWGAPSAFTKGFNLQDVADGHYGRHLHVYTWPGGELKQTLDLGNTGLLPLEIRFLHNPSEAIGYVGCALTSNMVRFFKNPDDSWGHEVAISVKPVKVQNWILPEMPGLITDFLISLDDRFLYLANWLHGDIRQYNIEDPANPKLTGQVFVGGVFQKGNAVLAEAEDGSTYQVDVPEVQGHRLRGGPQMIQLSLDGKRLYVTNSLFSTWDRQFYPEMIEKGGHMLQIDVDSEKGGLAINPRFFVDFGAEPDGPSLAHEMRYPGGDCTSDIWI

SEQ ID NO: 625 - protein, 941 aa, Solanum lycopersicum
MSGKSRNFRRRGGDDGDDDETATKSTNGTAAKPTTTASASAAKPKKKSLLSFADDEESDDTPFVRPSSKPSSASSRITKPSSSSSAHKLTSGKDRITPKPTSFTSNVQPQAGTYTKEALLELQKNTRTLVGSRSSQPKPEPRPGPVEPVIVLKGLVKPPFSVSAQTQQNGKESEDDEMDVDQFGGTVNRLGSMALEKDSRKKDDVGSVIPDKMTIDAIRAKRERLRQARPAAQDFIALDEGGNHGEAEGLSDEEPEFQQRIGFYGEKIGSGRKGVFEDFDDKALQKDGGFRSDDDEEDEEDKMWEEEQVRKGLGKRLDDGSNRGVMSSVVSSAAAVQNAQKANFGSSAVGASVYSSVQSIDVSDGPTIRGGVVGGLPSLDALSISKKAEVAKKALYESMGRLKESHGRTVTSLHKTEENLSASLSKVTTLENSLSAAGEKYMFMQKLRDFVSVICALLQDKGPYIEELEDQMQKLHEERAAAILERRAADNDDEMKELEAAVSAARQVLSRGGSNAATIEAATAAAQTSTAAMRKGGDLPVELDEFGRDKNLQKRMDTTRRAEARKRRRMKNDVKRMSAIKCDSSYQKIEGESSTDESDSESTAYQSNRDQLLQVSEQIFGDAHEEYSQLSVVVEKFDRWKKDYASSYRDAYMSLSIPVIFSPYVRLELLKWDPLHENTDFMDMNWHNSLFSYGISPEGETEISADDTDVNLIPQLVEKLAIPILHNQLANCWDMLSTSETVCAVSAMRLVLRYGPFSGSALSNLIAVLRDRLADAVANLKVPTWDTLVMRAVPDAARVAAYRFGMSIRLIRNICLFHEIFAMPVLEELVLDQLLSGKIVPHLRSIQSNIHDAVTRTERVVTSLHGVWAGPKATGDCSPKLRPLVDYLLSLARVLEKKHSSSSGEIETSKFARRLKKMLVELNQYDYARDISRTFNIKEAL

SEQ ID NO: 626 - protein, 434 aa, Solanum lycopersicum
MEEGETGLLLQSNKEMVSSGFSTNESSEEIKKIKSALTWVFLDQSNLWRAGLSWSFFSILTIGVPLVSHFMFACLTCDTMHQRPFDALVQVSLSLFATLSFVSLSSFARKYGIRKFLFLDKLYEDSEKVQQGYTEQLHRSMKILSSFVLPSFIVESIYKIWWFSSGGTQIPYLYNAALSNIFVCILLISSWLYRISISFLVCVLFRLICSLQILRLEEFAQVFEKETDVSSIMMEHLRIRRNLRVISHRFRVFILSTLILVTISQFLALLLTTEPSSTVNIFTAGELALSSITLVTGLFMCLRSAAKITHKAQAVTSLAAKWHACATISSLDDMTEETPMARSVAPQVVYPINSSWDTDEEGDGDDVLDNTNMVPIHASTISYQKRQALVTYFEHNKAGITVYGFMLDRTWLHTIFAIQLSLTLWILNKTIGIS

SEQ ID NO: 627 - protein, 583 aa, Solanum lycopersicum
MEDKSIPFESSHSVSNNDNNHGWQKVTYVKKQKKKQQKISDSGKVIANGSAISGADNVYKSLEKHSDERRKRIAAQTAAMYGVGDAPVRSAMKHRSDDEDEDYYAEGGAENGAVGEKKKEKVKKPKKPKVTVAEAAAKIDAADLDAFLADITVSYESQQEIQLMRFADYFGRSFAAVAGSQFPWLKLFRESAISKIADVPVSHLPEPVYKTSVDWINQRSFEALGSFVLWGLDSILVDLTAQLAGSKGSKKGGQQTSSKSQVAMFLVLAMVLRRKPDVLITVLPTIRESPKYQGQDKLIVIAWMIVQACQGDLCVGLYLWAHHTLPLVGGKSGSNPQTRDLILQVVERILSAPKARTILVNGAVRKGERLMSPSSLDLLLRVTFPAPSVRVKATERFEAVYPTLKEVALAGSPGSKAMKQVSQQILLLAVKAVGGGNPELSREATNIFNWCLTQSADCYKQWDKIYLDNIEASAAVLRKLNEEWKELSRRQSSTEALKETLKSFREKNEKSLTGGADAHQSHFRDADKYCKMLLARLSRGHGCVKGFVVVLLAMAVGGAIVSQNLEDWDWNKFLALLDIPQTS

SEQ ID NO: 628 - protein, 587 aa, Solanum lycopersicum
MNIHYIFLKSSVPFCNSQRTKINTFETPFSRNGCSNFWHNNRNNNTIFLCCLCNHHRRHLQEPLFLIPNTLYPNTPLSSHPSINLGFLADFVLAQIDKMSKKIDALVKQICFFLIVSTSLWLVIFGSSVEAKALEDPKQEFHQCSHGHGHHGHEGHHHDHDHGSSGVEQRKLLEELAEEEDLKLYGFGSHASMDEHHHHHHHDGHGVKDLTGLGLWVNAMGCSLLVSLASLICLILLPLIFIHGKPSKAVVDSLALFGAGAMLGDAFLHQLPHAFGGGHSHSHDDHLHDHSGHSHAHSLEDLSVGLSILAGIVLFLIVEKLVRYVEEFSGGVNERSHGHHHHHHMHYTKLKDDNDADDNLRELSQEKDGSSSEKVAGGSRVDGVSTDSPNGEKPNGGAILRKRNTGSSAAEDNTALDAANCSTNSTSTGEEQAKSRSSLVFGYLNLFSDGVHNFTDGMALGSAFLLHGSVGGWSRTLFLLAHELPQEIGDFGILVRSGFSVSKALFFNFLSALVALAGTALALTLGQDSGHSSLIEGFTAGGFIYISVAGVLAEMNNTGRTTLVNTVIQLISLVSGMAVALCISLIE

SEQ ID NO: 629 - protein, 1019 aa, Solanum lycopersicum
MVFINLPNHKTLTLEINPFVTSLQTLTLAIHQKFHIPITQQRLYSSCRRLLDVEALLSDLGISPNSTLTLHVPLFGGMQAPGAPKARLEFLNTRPPPNYVAGLGRGATGFTTRSDIGPARAAPDLPDRSAVGGAPATGVGRGRGKGAGEEDEEEDAEEKGYDENQKFDEFEGNDVGLFASAEYDEDDKEADAIWESIDQRMDSRRKDRREARLKQEIEKYRASNPKITEQFADLKRKLYTLSSDEWDSIPEIGDYSLRNKKKRFESFVPVPDTLLEKARQEKEHVTALDPRSRMVGGMETPSSQTPVADLTAVGEGRGTVLSVRLDRILDSVTGQTVVDPKGYLTDLKSMKITSDAEISDIKKARLLLKSVTQTNPKHPPGWIAAARLEEVAGKMQVARQLIKKGCEECPKNEDVWLEACRLASPLEAKAVIAQGVKANPNSVKLWMQASKLEDDTANKSRVLRKGLEHIPDSVRLWKAVVELANEEDARLLLQRAVECCPLHVELWLALAKLETYENAKKVLNKAREKLPKEPAIWITAARLEEADGNTASVGKIIERAIRALQREGLEIDREAWMKEAEGCERAGSLGTCQAIINNTVGVGVEEEDRKRTWVADAEECKKRGSIETAKYIYAHALTVFRTKKSIWLKAAQLEKSHGTRESLDAVLRKAVTYIPKAEVLWLMGAKEKWLAGDVPAARAILEEAFAAIPDSEEIWLAAFKLEFENCETERARKLLAKARERGGLERVWMKSVIVERELGNVDEERRLLDEALRRFPSFFKLWLMLGQLEERLGNSNKAKDAFESGIKNCPNCIPLWLSLASLEEKMNGLSKARAVLTMARKRNPQNPELWLAAVRAEARHGYKREADVMMAKALQECPNSGILWAASIEMAPRPQRKTKSSDALKKCDHDPHVIAAVAKLFWQERKVDKARNWFNRAVTLAPDIGDFWALYFKFEQQHGAEEQRSDVLKRCVAAEPKHGEKWQATSKAVENSHEPTESILKKVVATLKKEENLAENNHN

SEQ ID NO: 630 - protein, 150 aa, Solanum lycopersicum
MGQNTGASGKGKKEAETEKETVVEEEEEEVEEGGEEAEQDGMSVHSPCKPASSALRKEQSQVELEIRLLEALEIYPPAKLRGIHRHFVLYGLTEHLRRSFNRQFAPDDVLKLLDRFYNLDMVKPEDEDSEILNQEEEFCLPHSYFSRDEP

SEQ ID NO: 631 - protein, 335 aa, Triticum aestivum
MAAEPEICVLSNGRITANIASWGATITSLLVPDAQGDLADVVLGFDTLEPYLKGMAPYFGCIVGRVANRIKNGKFDLNGVEYSLPINNGPNSLHGGLKGFDKVVWDVVERKDGEYPSITFQYESKDGEEGYPGDVTVRATYSLPEATTLRLDMEAIPANKATPISLAQHTYWNLAGHNSGSILDHSIQIWAKHVTPVNENTIPTGEIMPVQDTPFDFTTEHKIGDRISDVPGGYDHNYVLDSGDEKNGLKHAAKLKDPSSSRTLDLWTDAPGMQFYTANYVNGITGKGGAVYGKHAGVCLETQGFPNAINQPNFPSVVVQPGAKYKHAMLFEFSA

SEQ ID NO: 632 - protein, 422 aa, Brassica juncea
MFGRGPSKKSDNTKSYEILGVPKSASPEDLKKAYKKAAIKNHPDKGGDPEKFKELAQAYEVLSDPEKREIYDQYGEDALKEGMGGGGGGGHDPFDIFSSFFGGSPFGGGGSSRGRRQRRGEDVVHPLKVSLEDLYLGTTKKLSLSRNALCSKCNGKGSKSGASMKCGGCQGTGMKVTMRQLGPGMIQQMQHACNECKGTGETINDRDRCPQCKGDKVIPEKKVLEVNVEKGMQHSQKITFEGQADEAPDTVTGDIVFVIQQKEHPKLKRKGEDLFVEHTLSLTEALCGFSFVLTHLDGRNLLIKSNPGEVVKPDSYKAISDEGMPIYQRPFMKGKLYIHFTVEFPDSLSPDQTKALEAVLHKPSTTQLSDMEIDECEETTLHDVNIEDEMRRKAQAQREAYDDEDDDDDHPGGAQRVQCAQQ

SEQ ID NO: 633 - protein, 213 aa, Brassica juncea
MMNRLFGKPKQETNALQTLDKLNETLEMLEKKEKVLLKKAGQEVEKAKEYTRAKNKRAAIQCLKRKRLYEQQVEQLGNFQLRIHDQMIMLEGAKATTETVDALRSGASAMKAMQKATNIDDVDKTMDEINEQTENMKQIQEALSTPIGAAADFDEDELEAELEELEGAELEEQLLQPTTALPSVPAGRQQVRPTPKRTAEEEELAALQAEMAL

SEQ ID NO: 634 - protein, 172 aa, Unknown
  Sequence found in Organisms: Brassica napus, Brassica juncea, Brassica rapa
MSLASPIQCIRIINPSSSSSSSLTTWSSLRFSTSKPCVFIIRCSQAEGPLRRPSAPPTLREPTPPQKPVTPTPSSSPPPPQKAVAVDGKSVVTTVEFQRQKAKELQDYFKQKKLEAAGQGPFFGFQPKNEISNGRWAMFGFAVGMLTEYATGSDLVDQVKILLSNFGILDLE

SEQ ID NO: 635 - protein, 342 aa, Brassica juncea
MATLNPFDLLGDDAEDPSQIAVSIAADKPKKPAPVSAKSSAPSRQLPQPVREARSDAPRGGGRGGGGDRGSSRGRGGYNRDFRGGDGNSGGYNKPSEEGGISKPFYEKRSVYGGAPRGGGRRGEAGEGERPRRTFERRSGTGRGGDFKREGAGRGNWGTPGEEVLVVETEEVAGVETEKPAGDEVAADAKKENAAEVEEQKEPEDKEMTLDEYEKILEEKKKSLQSQTTSERKVDTKVFESMQQLSNKKKSNDEIFIKLGSDKDKRKDDKEEKAKKAVSINEFLKPAEGENYYRGGGRGGGRGRGRGGRDRGVVSGGGFDGYRSEAAPAIGDTAQFPSLGGK

SEQ ID NO: 636 - protein, 365 aa, Brassica juncea
MRRWICCGGHRSGDSDISNDEKHLKTQWQQPDANNKQPRPQAVAKTEAPKEALPIEVPLLSVEEVEEKTDNFGSKSLIGEGSYGRVYYATLSDGKAVALKKLDVAPEAETNTEFLSQVSMVSRLKHENFIQLAGYCVDENLRVLAYEFATMGSLHDVLHGRKGVQGAQPGPTLDWITRVKIAVEAARGLEYLHEKVQPPVIHRDVRSSNVLLFEDYQAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKPPAPAPVPES

SEQ ID NO: 637 - protein, 106 aa, Gossypium hirsutum
MAKLVAAFFLALIAISMLQVMVLASHGHGGHHYDQKHYGPGSLKSYQCPSQCSRRCRKTQYHKPCMFFCQKCCNKCLCVPPGYYGNKAVCPCYNNWKTKEGGPKCP

SEQ ID NO: 638 - protein, 139 aa, Zea mays
MASTNMASATSRFMLAAGVPTASSGSGRVSFASAPNRLGRRLVVRADEESPAEPAPTAEGEGAVATKPKAEKPPPIGPKRGAKVKILRRESYWYNGIGNVVTVDQDPNTRYPVVVRFNKVNYAGVSTNNYALDEILEVK

SEQ ID NO: 639 - protein, 314 aa, Medicago truncatula
MATIVVHSQTSPVQDAEALRLAFKGWGADNKAIIAILGHRNVHQRQQIRKAYEELFEEDLIKRLESEISGDFERAVYRWMLDPADRDAVLINVAIRNGNKDYHVVAEIASVLSTEELLAVRRAYHNRYKRSIEEDVSAHTTGHLRQLLVGLVSSFRYEGDEINAKLAQTEANIIHESVKEKKGNNEEVIRILTTRSKTQLVATFNRYRDEHGISISKKLLDQTSDDFQKTLHTAIRCINDHKKYYEKVLRNAIKKFGTDEDGLSRVIVTRAEKDLRDIKELYYKRNSVHLEDEVSKETSGDYKKFILTLLGKHD

SEQ ID NO: 640 - protein, 314 aa, Medicago truncatula
MATLIAPINHSPVADAEALHGAFKGWGTDEKSVITILGHRNVYQRQQIRKSYQEIYQEDILKRLESELSGDFERAVYRWMLEPADRDAVLANVAIKDGSKSYHVIIEIVSVLSPEEVLAMRRAYHNRYKHSLEEDLAAHTTGHLRQLLVGLVTSFRYGGAEINPKLAKTEADILHESIKEKKGNHEEAIRILTTRSKTQLLATFNRYRDDHGISITKKLLDNASDDFHKALHTTIRCINDHKKYYEKILRGALKRVGTDEDGLTRVVVTRAEKDLKDIKELYYKRNSVHLEDAVAKEISGDYKKFILTLLGKQD

SEQ ID NO: 641 - protein, 301 aa, Medicago truncatula
MDMRKRGRPEHGFNNNGGFKKSRHEMESLSTGVGSKSKPCTKFFSTSGCPFGESCHFLHHVPGGYNAVSQMMNLTPAAPPAPRNVPAPRNAHAPNGSAPSAVKSRICSKFNTAEGCKFGDKCHFAHGEWELGKPVAPSFDDHRHNDHRHMGPPNAGRFGGHRMEPPPVPASFGANATAKISVEASLAGAIIGKGGVNSKQICRQTGAKLAIREHEDPNLKNIELVGTFEQIKDASNMVKDLLLTLQMSAPPKSNQGPPGHHGAPGHHGNNLKTKLCENFAKGSCTFGDRCHFAHGAVELRK

SEQ ID NO: 642 - protein, 136 aa, Sorghum bicolor
MPGKHHQQMAAAAAGAVAPKGCVTVRVGLEGEEQRRFAVPLGHLKHPLFGALLEEAEREYGFRHQGAIAIPCRVDRFVHVERLIGQDLHGTSPCAHHLVDLDGGALAATAGAGAAHHHHHHHVHLHLPRFVGCFRA

SEQ ID NO: 643 - protein, 328 aa, Sorghum bicolor
MDRPVGASYQRFPRVRIRDLKDDYAKFELRDTDASMANALRRVMIAEVPTVAIDLVEIEVNSSVLNDEFIAHRLGLIPLTSAAAMQMRFSRDCDACDGDGSCEYCSVEFHLAARATDSDQTLEVTSNDLRSMDPKVCPVDQARAYQQALGGTDPFGANTSNENRGILIVKLRRGQELRLRAIARKGIGKDHAKWSPAATVTFMYEPDIRINEELMETLTVEERRRLIESSPTKVFKLDSANQVVVDNAEAYTYDDEVIKHAEALGKPGLVEINAKEDSFIFTVETTGAITAYELIMNAITVLRQKLDAVRLQDDDGDLGELGAHLGGP

SEQ ID NO: 644 - protein, 435 aa, Sorghum bicolor
MYGAPVPKDLNLPAAALPQPTTRAGARTPPHQQQQMSSPGLLRYRSAPSTLLGEVMCGDQDFPAAAAAAGGAGAGHGPPPDHAAAADNVLARFLAGHHHCSEARDCKPPRPAASAHHFMDEAAAAAASMAASQQQQLMYQSSQQQMAAMEGLYRNVSSGGTEHGAAVGGAGNNSLIRQSSSPAGFLSHLNMDNGYGSMLRAGMAGGGFRTNGAVSDARLKGQLSFSSRQGSVMSQISEVGSEELDGGSSPETAAGSNGSGAPRGYSGIPGYTMGVSPGAWTDEPSPSPTSGAKRPRDFAGPVPQNVHQQPLAPQLSLPSGNNGGGKPAAASAEMAAIEKFLQFQDAVPCKIRAKRGCATHPRSIAERVRRTKISERIRKLQELVPNMEKQTNTADMLDLAVDYIKDLQKQVKVLNDGRANCTCSAGKLLQDQFTS

SEQ ID NO: 645 - protein, 116 aa, Sorghum bicolor
MDNVESAPDSPAQAPPSSASSLPKEQSQVELELRLLQALEFYPPSKLKGIHRHFVLYGLMEFLRKSLDRQFSPDEVLQLLDRFFNLEMLKPEDDEKDNFSQGEEFSLPESFLNKEE

SEQ ID NO: 646 - protein, 71 aa, Glycine max
MAGGAPKQLFGFGVVALLATLILPLFMPAAVQAQSAAPAPAPTSDGSSLDQGIAYVLMLLALVLTYIIHSA

SEQ ID NO: 647 - protein, 65 aa, Unknown
  Sequence found in Organisms: Glycine max, Vigna unguiculata
MESQVKHALVVKVMGRTGSRGQVTQVRVKFLDDQNRHIMRNVKGPVREGDILTLLESEREARRLR

SEQ ID NO: 648 - protein, 124 aa, Glycine max
MSRGGAAAAKGKKKGATFTIDCAKPVEDKIMDIASLEKFLQERIKVGGKAGALGDSVTVTREKTKIILTSDCNFSKRYLKYLTKKYLKKHNVRDWLRVIASNKDRSVYELRYFNIAENEGEEED

SEQ ID NO: 649 - protein, 298 aa, Glycine max
MMVQKEDLGLSLSLNFPHHSTPNPQHLSLMSSSTHSSSPSGFNPQKPSWNEAFASSDPDRNSDTCRGETRSFLRGIDVNRLPSAVDAEEEAGVSSPNSTVSCVSGKRSEREPNGEEHDMDRACSRGISDEEDAETSRKKLRLSKDQSAILEESFKEHNTLNPKQKLALAKQLGLRPRQVEVWFQNRRARTKLKQTEVDCEVLKRCCENLTEENRRLQKEVQELRALKLSPQFYMQMSPPTTLTMCPSCERVAVSSSAVGSATRHHPMAHAHAHARPMPNGPWASAAPIPHRPFDAFHQ

SEQ ID NO: 650 - protein, 87 aa, Glycine max
MADLQEKLDALKGLVGVLNNMDEGETHNNNATSSPNNSHSPAPMPGRNRSVGKYNNSGTQKIKGLSNQTGFTEGNANGAINFGNLHA

SEQ ID NO: 651 - protein, 243 aa, Glycine max
MDGHHQKQKNKYSIIVPTYNERLNIGLIVYLIFKHLGDADFEIIIVDDGSPDGTQDVVKQLQQVYGEDRILLRARPRKLGLGTAYIHGMKHASGNFVVIMDADLSHHPKYLPSFIRKQSETGADIVTGTRYVKGGGVHGWNLMRKLTSRGANVLAQTLLWPGVSDLTGSFRLYRKSVLEDIISCCVSKGYVFQMEMIVRASRKGYHIEEVPITFVDRVFGSSKLGGSEIVEYLKGLAYLLVTT

SEQ ID NO: 652 - protein, 94 aa, Glycine max
MVLDSILTSPRLKSPSFRRQFTKDELGSWSTLFQRHRFLLSALVLLTLLCTVYLYFAVTLGASGTCSGLTGAQKASCHMELVKDSVAKGKLKIL

SEQ ID NO: 653 - protein, 289 aa, Glycine max
MGEKDDEFGLSLSLSLGGVNQQQQPPSLNHMHQPQQQQPVPMNHNKTLFGDLFQLPDRSSDMVRGIDVNSAAEYDGVSSPNSAVSSVSGGGKQSERDDDNAAAVAGERTSCSRGSDDDDGGGSDAARKKLRLTKEQSMVLEETFKEHNTLNPKRKQALAEELNLKPRQVEVWFQNRRARTKLKQTEVDCEYLKKCCENLTEENRRLHKEVQELRALKLSPQMYMHMNPPTTLTMCPSCERTHSSASSSPATIHSTVAAATSSNCKLLGANIRRPVPVNTWPFEGPIPRP

SEQ ID NO: 654 - protein, 420 aa, Glycine max
MAMATMGESPRSPEAKLGMRVEDLWDVQEPQLSPTEKLNACFESIPVSAFPLDPSNTEIEIKSDATLADAVKILARHNVFSAPVVDVEAPEDASWMDRYIGIVEFAGIVVWILHQSEPTSPRCPSTPSSARAIAAAANGAAFALELEALGLGSAATTAGNFFEDLTSSELYKNTKVRDISGTFRWAPFLALERSNSFLTMLLLLSKYKMKSVPVLDLGSGTIDNIITQSAVIHMLAECAGLQWFESWGTKKLSEVGLPLVTGNQIIKVYEDEPVLQAFKVMRKKRVGGVPVIERETKKAVGNISLRDVQFLLTAPEIYHDYRGITVKNFLTEVRSYLEKNKNASPMLSEYVTCKKDCTIKELIQLLDQEKIHRVYVVEDDGDLQGLITLRDIISRLVHEPRGYFGDFFDGVLPLPANTRV

SEQ ID NO: 655 - protein, 118 aa, Glycine max
MGLKNNMVVLKVCLVLLFLVGGTTSANLRLSKLGLLMKSDHHQHSNDDESSKPCCDQCACTKSNPPQCRCSDMRLNSCHSACKSCICALSYPAQCFCVDITDFCYEPCKPSEDDKENY

SEQ ID NO: 656 - protein, 85 aa, Brassica juncea
MTPANMASTRVLRLTGSDAPSSAPGSAPGSAPGSVPGSAQGPTTPGASTTPGQAGGPENAGSMSTSVNFGVNFGILVMLATIFIF

SEQ ID NO: 657 - protein, 128 aa, Brassica juncea
YNQVVNGEWNVAGIAYRAYDLEGKTVGTVGAGRIGKLLLQRLKPFGCNLLYHDRLQMGPEMEKETGAKYVESLDEMLPKCDVVVVNTPLTEKTRGMFNSEMIGKMKKGVLIVNNARGAIMDRQAVVEA

SEQ ID NO: 658 - protein, 61 aa, Brassica juncea
GPSVYLVIEGTGKLQTGSSQLLVNRGDVLFVPAHNEIHLTGESDVMKLYRAGVSSRFFQTL

SEQ ID NO: 659 - protein, 250 aa, Brassica juncea
MDRREVYVLTIFVALSVRCVGCVANYNRNDFPTDFAFGSGTSAYQWEGAYDEDGKKPSVWDTYVHSRNMENGDIACDGYHKYKEDVQLMVETGLEAFRFSISWSRLIPNGRGPVNPKGLEFYKNFILELVTHGIEPHVTLYHYDHPQYLEDEYRGWLNRRIIKDFTAYADVCFREFGKHVKFWTTINEANIFTVGGYDGGNTPPGRCSTCMSGNSSTEPYIVAHNLLLAHASASRLYKQKYKDTQGGSVG

SEQ ID NO: 660 - protein, 313 aa, Brassica juncea
VLREAEDRSVSPIPVWDIPIWKDISPRQRKVATSLKLINDTLNDLIATCKRMVEEEELQFHEEYMNERDPSILHFLLASGDDVSSKQLRDDLMTMLIAGHETSAAVLTWTFYLLTTNPNVVAKLQEEVDSVIGDRFPTLEDMKKLKYTTRVMNESLRLYPQPPVLIRRSLENDTLGPYPIKRGEDIFISVWNLHRSPLHWDDAEEFNPERWPLDGPNPNETNQNFSYLPFGGGPRKCIGDMFASFENVVAIAMLIRRFNFQTAPGAPPVKMTTGATIHTTEGLKLTVTKRTPPLSVPILPMEAPRDEVSSALS

SEQ ID NO: 661 - protein, 267 aa, Brassica juncea
IDSVAIIAANAIGAIPYFSSGLKGVARSMPTSAALDVVAKSLNLKFFEVPTGWKFFGNLMDAGMCSVCGEESFGTGSDHIREKDGIWAVLAWMSILAHKNKENLEGDAKLVTVEDIVRKHWATYGRHYYTRYDYENVDAGKAKELMEHLVKLQSSIPEVNKMVKGIRSDVANVSSADEFEYKDPVDGSISKHQGIRYLFEDGSRLVFRLSGTGSEGATIRLYIEQYEKDASKTGRESQEALSPLVDIALKLSKMEEFTGRSAPTVIT

SEQ ID NO: 662 - protein, 283 aa, Brassica juncea
PCTSLSSATGNSGSCSASTCVYGIQYGDQSFSVGFLAKEKFTLTSSNVFDGVYFGCGENNQGLFTGVAGLLGLGRDKLSFPSQTATTYNKIFSYCLPSSASYTGHLTFGSAGVSRSVKFTPISTITDGTSFYGLDIVGISVGGQKLAIPPTVFSTPGALIDSGTVISRLPPKAYAAMRSAFKARMSQYKNASAVSILDTCFDLTGFKTVTIPTVSFYFSGGAVVELGSKGILYAFKMSQVCLAFAGNSDDNNAAIFGNVQQQTLEVVYDGAGGRVGFAPNGCS

SEQ ID NO: 663 - protein, 215 aa, Brassica juncea
IQDLPPGLRRDIKRYLCVDLINKVPLFRGMDDLILDNICDRAKPRVYSKDEKIIREGDPVQRMIFIMRGRVKRNQSLSKGVVATSTLEPGGYLGDELLSWCLRRPFIDRLPPSSATFVCLDNIEAFSLGSEDLRYITDHFRYKFANERLKRTARYYSSNWRTWAAVNIQMSWRRYRKRTCSMSPVSEHSVEGNSERRLLQYAAMFMSIRPHDHLE

SEQ ID NO: 664 - protein, 153 aa, Brassica juncea
DGSEIVCEGPRCSLRSKKVYSDLAVDYFKMFLLNVPATVVALGLFFFLDDLTGFEITYLLELPEPFSFIFTWFAAVPAIVYLALSLTKLIIRDSLILKGPCPNCGTENTSFFGTILSISNDSSTNNVKCSGCGTAMVYDSSTRLITLPEGGNA

SEQ ID NO: 665 - protein, 118 aa, Brassica juncea
LRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKTDGADD

SEQ ID NO: 666 - protein, 361 aa, Brassica juncea
LGSSITRSLSHAPDENSHHPHTVAGDHQSFPDHIMSSLLQTPALYTAASFASTFWPPDTSVGPQGNNLTPNLAAMASATVAAASAWWAANGLLPLCAPFSSGGLTSHPPTITYGPSSGEVDVTKTTDQEHSEASKARSSLDSEETKNGSKPDCHEHHPCAATETDAKGSDGARERKQVDRSSCGSNTPSSSDDVEADALERQENGGNNDDEVKEVNADTTNNNPQTTSESNARRSRISSNLADPWKSVSDEGRIAFRALFAREVLPQSFTYQREEGQQQQQRYPMELDLNSAADDQEENRNIAFLGASKQQQLSRGRTGFKPYKRCSMEAKESRVISNTNPIISVEQKDPKRIRLETQTST

SEQ ID NO: 667 - protein, 196 aa, Brassica juncea
LDDCNFHESVRLDSFDSDRTLSLVPPDGEFPVMNYRMTQEFKPPFHVNTLIEEAGRLKAEVIIKIRAEFPSDVVANTITIQMPLPNYTSRASFELELGAAGQKTDFKETSKMLEWSFKKIVGGAEHTLRAKLTFSQEFHGNITKEAGPVSMTFTIPMYNVSKLQVKYLQIAKNSSSNNPYRWVRYVTQANSYVARI

SEQ ID NO: 668 - protein, 132 aa, Brassica juncea
GERVALLGYGSAVQSCLGAAAMLQERGLNITVADARFCKPLDRALIRSLAKSHEVLITVEEGSIGGFGSHVVQFLALDGLLDGKLKWRPMVLPDRYIDHGSPADQMAEAGLMPSHIAATALNLIGAPWEALY

SEQ ID NO: 669 - protein, 134 aa, Brassica juncea
INALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFETNAGSGATTGVADPFATSAAAAADDDDLYN

SEQ ID NO: 670 - protein, 118 aa, Brassica juncea
GCCQLDIQFSNLEELQVNYNNDRSRDYTNPNLPSEQKGRLPHPGYGDAGVAYPQMANTSAIAAAFGGGLPPGITGTNDRCTILVSNLNTDSVDEDKLFNLFSLYGNIVRIKLLRNNLT

SEQ ID NO: 671 - protein, 113 aa, Brassica juncea
LYTIRTWSMTVLENVNSLVGKTATPEYLQKLTYLCWNHHKAIRHIDTVRAYTFGSHYFVEVDIVLPADMPLQVAHDIGESLQEKLELLQEIERAFVHLDYEYTHKPEHARSHC

SEQ ID NO: 672 - protein, 145 aa, Brassica juncea
ERHKPCSIMCKRTSNLYLGFITILGISTVLVSLLPVFQSPEFRVVRASLFFGMGFSGAAPILHKLIIFWDQPEALHTTGYEVLMGLLYGLGALVYATRIPERWMPGKFDIAGHSHQLFHVLVVAGAFTHYRAGLVYLKWRDIEGC

SEQ ID NO: 673 - protein, 131 aa, Brassica juncea
LCGCVLITDESVVALADWCVHLRSLGLYYCRNITDRAMYSLAQSGVKNKPGGQWKSSAKKSKFDEEGLRSLNISQCTALTPSAVQAVCDTFPALHTCSGRHSLVMSGCLNLTSVHCACILQAHRSVPHSAH

SEQ ID NO: 674 - protein, 110 aa, Brassica juncea
LLIFKRATSHVPLKILSIEDGTVLKSFNHLLHRNKKVDFIEQFNEKLLVKQENENLQILDVRNAELMEVSRAEFMTPSAFIFLYENQLFLTFRNRNVSVWNFRGELVTSF

SEQ ID NO: 675 - protein, 492 aa, Hordeum vulgare
DTLSPEEYSDEGWQAATLKGRSSNVRKKSIRRRPSLTKLLVDRTEDGRTPSAHRSGVQPQAKEHKEEAVNSPSQLSFGNFIRSDKLNGDPVITEDKSSKGTSKSEWKVKPTGSKRPTTIASKLVSYKDVAVSPPGTVWKPILEQKEAKEKDNEQDTDAAPSSEEGDRKLIDEEKEKSSDESIKEIVSIQPEESSPTEPEKASDSNSDGSSSPGKKTSGSKLSASAPPFKPGSLLSVSHPYSTVAIYDASVVLQPIPSQAMEILPHAVDTRVPRGPRSTLYYRTGHSFQRKQGYTQSQSTILRGSTSPPTMNPHAAEFVPGKTVQQADLATEEQANSVTDPAGQQLASHASDEVKVDVREADKAGQVEKTTPGKGKERAKDAMRDSYKAELARQILLSFIVKSVHDSLGSTRPQPDRKPSGSDEASNEQSSNITKTALSPKEFDKQPKATEAPKSEKDTEGFTVVSKRRKSKQHFVNPINGLYSQQSICTSVS

SEQ ID NO: 676 - protein, 181 aa, Brassica napus
HEANVCCVQFSSYSNHLLAFGSADYKVYCYDLRYVKTPWCTLAGHEKAVSYVKFMDSETIVTASTDNSLKLWNLNKTNSTGLSTGACSMTYKGHTNQKNFVGLSVLDGYIACGSETNEVYSYYRSLPMPMTSYKFGSVDPISGNEYFDDNGQFVSSVCWRKKSNMLVAANSTGNMKLLKLV

SEQ ID NO: 677 - protein, 389 aa, Brassica napus
MFDWDDEELTNMIWGDEGETDDHIVPFKVRNRKEQGDESNKAVKPAESKTHLHDSKLGGSSSGQNIECMSSWPDSSVSNARKADPGPDSSEPARYDSTRSEKASELAKGPDIFHSTDESKEQGDFDEYGWANIGSFDDLDRMFSSDVPIFGDGTLSGADELWSSSKDASKPLPSILDSQDLGLDIRTEFEQQENQQFPLTGETNGPSSQSAPRVRVTPKAEQYHEHKRQSSVDDQPYQQNKMMKFSEMLGTCEAGSFQDPYGQRTLSRRKFANQLGPSRSSMMGVNLQSESQGSGTSHYPHMPNQYMATSGFGNPYSAVPVVSAFQRPDVNKNQLMHPSYNPATAISANMVTDAASARPSTMTPQEKLEKLRRRQQMQAMLAIQRQQQQ

SEQ ID NO: 678 - protein, 114 aa, Brassica napus
KPQTDRWVFPDTKSGIIVLAEGRLMNLGCATGHPSFVMSCSFTNQVIAQLELWNEKSSGKYEKKVYVLPKHLDEKVAALHLGKLGARLTKLTKDQSDYVSIPIEGPYKPGHYRY

SEQ ID NO: 679 - protein, 846 aa, Gossypium hirsutum
MAVKKRKERAVGGESGNSKKFKKYSNSKGPMKKNKNDTRKKGKGPRLPSALRTELDRLDPKIASDSDDGIDLDVGNDVYEYEEEVPQEESRKNRRFDPVENYEYELPEDFEDENVPSDDDDDDGDFGVGGNKGSLNDDVDASDGDEEEDDERHLRMLQGVTGMSTDAFGGKKKRNSVVISEAHPESEYNPTRDVLEGDSHITLQDLLDPIQGKAGYSKLRKRVQHMDRKSTSVQAPLPKVDREKLERMAVYEHSKKDITKWEHLVKRNREAPTVFFGGDVDLGFSTVGAIASEFEPRTEFEKKIASLVYDDKVMEAHKADGSKLLELNKISEEDYMKHQDHVAKMRGLLFRHEMKQKRIKKIKSKTYHRLKNKDKLKVESAEMLMDPEAAKEQARKQEFKRAEERMTLKHKNKSKWARRILERGLNAQDEGTRAAMAEQLHQHALLTRKINTVKDSSSSSDSSSDDDDEVSNEDRASELLEKAKEKTLKVLEDDEELPNSGVLSLPFMVRGLKKRREEAIEEAKLALQEYEQLEGTNDAENSKPATASGRRVFGRANNEVPDSNKKTKTDNKMKMDNYYGNSDSEDDLKAKENVNIEGGKRNDVEKDVGPNYDRKEAADVSIFKNFDDNGDPGSKTTYEVAIFASDSRRKMKSENGIDKNAKKLQQVKEAIVHDKDMEEGEEDSDSESKQMVDGILSSAPKESYELPSQSELIRHAFAGDYVEEEFEKDKQEILNEENPEPDKPVLLPGWGQWTHVQQKKVCLGGCLRNTKTLSGRGKKVLRKGRMHSSSMSLYPKRWIKKLRNCRQNLCPTRSHPRNFLNKVCECLLDQNLTRRQQSEVLIDQKW

SEQ ID NO: 680 - protein, 933 aa, Gossypium hirsutum
MITRAFKQVVKAVVASVEKIEDLPVVIASTLNFLLGSCEVDVNAPSANDDYLIKLTWLRKFLGAKFGWKLKDEFQHLRKLSVLRGLCYKIGLELVPRDYDMECQEPFRSCDIISMYPVCKHVGCSSADGRTLLESSKIALDKGKLEDAVNYGTKALTKMIAVCGPYHRTTASAYSLLAVVLYHTGDFNQAAVYQQKALDINERELGLDHPDTMKSYGDLSVFYYRLQHMEMALKYVNRALFLLHFTCGLSHPNTAATYINVAMMEEGMGNVHVALRYLHEALKCNQRLLGADHIQTAASYHAIAIALSLMEAYSLSVQHEQTTLKILQAKLGPDDLRTQDAAAWLEYFESKALEQQEAARTGTPKPDASIASKGHLSVSDLLDYISPDQGSKGSDVQRKQRRSKVLQISDKTHDTHHNLQTDGAVFIDATDKATATVDINEIGTLTSIHPEEPEETDNISSIEATVTTEVVEDTTLDEGWQEANSKGRSGNATGKKYGRKKPVFAKLKVNGCEYSNGRESGSRRDIISPAGKTVPKNIIREMQTVKQSKSSSLNPRGTSIGLPASVSRGSSPSANLSAIASKSLSYKEVAAAPPGTVLKPLSEPSEGKMEQSMCAETANVEHGNNISVVDDVVDDNGETEGTHDTESQSEETAPEIDKVSSCSQEKGLEAKRSKLSASAEPFNPGALYHPLNSVSVTCVYDVTASQGMLVEPVVPPVAARVPCGPRSPLFYRNNNSYGSFLRYQTPILEQNGFGSPRVMNPHAPEFVPSKIWQMTGTGDLSGSEEAMNTEVKEVDKKLSREVNGSNPKKSSAEEKSELARQILLSFIVRSAKQNMDGECEALINDKRLNHSQNSSDAVTSDTAIIKILYGNEGKDLDSQSSSNEEPKALDINNKKPGDGEGFTVVKKRRKNRQQLTNEVTGLYNQQSICASVR

SEQ ID NO: 681 - protein, 561 aa, Gossypium hirsutum
MDRLGANFFRTRDMIVTNLGAKPLVIQLPVGAEDNFKGVIDLVKMKAVLWSGEELGAKFEYADIPADLQELAEEYRSQMIETIVELDDQAMENYLEGVEPDEETIKKLIRKGTIGISFVPVLCGSAFKNKGVQPLLDAVMDYLPSPLELPAMKGTDPENPEVIIERTASDEEPFSGLAFKIMTDPFVGSLTFVRVYSGKLAAGSYVLNANKGKKERIGRLLEMHANSREDVKVALAGDIVALAGLKDTITGETLSDPDHPIVLERMDFPDPVIKVAIEPKTKADVDKMANGLIKLAQEDPSFHFSRDEEINQTVIEGMGELHLEIIVDRLKREFKVEANVGAPQVNYRESISKVSEVKYVHKKQSGGQGQFADITVRFEPMEAGSGYEFKSEIKGGAVPKEYIPGVMKGLEECMCNGVLAGFPVVDVRAVLVDGSYHDVDSSVLAFQLAARGAFREGIRKAGPRMLEPIMKVEVVTPEEHLGDVIGDLNSRRGQINSFGDKPGGLKVVDALVPLAEMFQYVSTLRGMTKGRASYTMQLAKFDVVPQHIQNELATKQQEVVA

SEQ ID NO: 682 - protein, 120 aa, Gossypium hirsutum
MAAKPLTSEAIALTEKKMDMTLDDIIRMSKTSSNKTKKQQRVLNKGQKPFNNAAKAKALKVQQYMDSRSSVRQGFLAQRRSNIPGNQFPLAAEAARRAAVAPVRIKNVNGVRVANLNKPR

SEQ ID NO: 683 - protein, 805 aa, Medicago truncatula
FDFMEILKVESRSHNVHHAHGEEEKVMTRKQKAESKAHEVEHSPKKAKVEDEKNGHTNGKSASDVVQEYDEFCKATNEQLSLEQMKEILEANDLDSSGSDLEITRRCQDLLFFGALEKCMVCNGNMEFDGRRYGCRGFYSEWSSCTFSTREPPRKDEPIKLPDSVQNSPVSDLLKKYQDPSKRPQRDLGLAIKPFTGMMISLMGRLNRTHLNFSGASCLVASPAERDRGGTSKLADAMERGIPVVREAWLTDSIEKQEPQPLESYDLVSDLSVDGKGIPWDKQDPGEEAIESLSAELKLYGKRGVYKDTKLHEQDGKIFEKDGILYNCAFSLCDQGRKLNDYCVMQLIVVPENSLHLYFKKGRVGDDPSAEERLEECENVDNAIKEFVRLFEEITGNEFESWEREKKFQKKPLKFYPIDMDDGVEVRHGALGLRQLGIAATHCKLEPMVANFMKVLCSQEIYKYALMEMGYDSPDLPIGMVTNLHLKRCEEILLEFIEKVKTLKETGPKADAIWSDFSQKWFTLMHSTRPFIFRDYQEIADHAAAALEGVRDITLASHLIGDMSGSTIDDPLSDTYKKLGCSITPLEKNSNDYEMIVKYLEKTYEPVKVGDIEYGVSVENIFTVESSACPSYADIVKMPNKVLLWCGSRSSNLLRHLHKGFLPAICSLPVPGYMFGKAIVCSDAAAEAARYGFTAVDRPEGFLVLAIASLGNEITELKSPPEDTTSLEEKKVGVKGLGKKKTDESEHFVWKDDIKVPCGSIIASEHEDSPLEYNEYAVYDPKQVRISYLVGVKYEEKDAVIDTAE

SEQ ID NO: 684 - protein, 95 aa, Medicago truncatula
CFLTYHTLHTPLTGSGPTPGPVLVYPSEMDGVPNISIPTFAMAAYKLKGSIWMKKEVSENQVMNSLVQAADKWLRLVQVNHPDHQFFKSHGTYYK

SEQ ID NO: 685 - protein, 239 aa, Medicago truncatula
MAPANTSAAALSETEYEMVKNIIDIEVLEELSLADCSIYKVPHNLRKVKQEAYTPQLISIGPIHLGNEELQPMQQHKKRYFHFFYERLSQFNQQSMIKNYKLYLENKEQEIRKCYAEKFPNISKEKFVETILLDAVFIMELLLRNSSWKSDTSKHEHEYKQSKSFRWKHSDDYILTQAWLSKSITRDLILLENQIPFFVLKHLYDTVVPNDDKKPNHEDFLDLALEYFCILRHSEIVIT

SEQ ID NO: 686 - protein, 209 aa, Medicago truncatula
SDLPPIENDENRDDMEYGGPPLTEFQKFIRLSQNEMLGGSIKKKSPKSLLHDHRSYEMNVDDYQRACRIPKRKGACFRDLPCVRMRNKKVELNPDVERELLPSGKPLVPNYAISFVRGTSPLPFARIWWDETVPTVVTRPEPHNQKILHPEQDRVLSVRENARLQGFPDFYKLCGSVKERYIQVGNAGCGSTWHSSTILSWTCISRCFY

SEQ ID NO: 687 - protein, 531 aa, Medicago truncatula
FFCYETGNKQALISLSDKKDLAFVGNGLQELGFTIVSTGGTASALESAGVAVTKVEQLTQFPEMLDGHVKTLHPNIHGGILARRDQKHHMEALNTHGIGTFDVVIVNLYPFYDKVTSAGGIEFKDGIENIDIGGPAMIRAAAKNHKDVLVVVDSEDYPALLEFLKGNQDGQFRLKLAWKAFQHVASYDSAVAEWFWKQTGGDKFPPSLTVPLSLKSSLRYGENLHQNAAIYFDRRLAEVNAGGIATAIQHHGKEMSYNNNLDADAAWNCVCEFRNPTCVVVKHTNPCGVASRDDILEAYRRAVKADPVSAFGGIVAFNVEVDEVLAKEIREFRSPTDGETRMFYEIVVAPSYTEKGLEILRGKSKTLRILEAKKNEPGKLSLRQVGGGWLAQDSDDLTPSDIKFNVVSEKTPQDGELHDAEFAWLCVKHVKSNAIVIAKDNCMLGMGSGQPNRVESLRIAMRKAGAAIKGAALASDAFFPFAWKDAVEEACESGIGVIAEPGGSIRDQDAVDCCNKYGVSLLFTDVRHFRH

SEQ ID NO: 688 - protein, 988 aa, Sorghum bicolor
MDAAEASELQARLAAAVHALNHDASPSARLAANQWLLALQRSPQAWAVATSLLAAPDPPPPADLLFFAAQMLRRKIQSPGSAFPALGLAPQLLDALLLAARRFCAAPAPRQLLTQICLALAALALRAEGGVDGLFARMPHLPPPAVLELLTVLPEEAAQDQGGDTGVDAAARCRFTRELLAHAPAVLEFLHGQSEKAPTDDDGVPLHERNRRILRCLLSWVRVGCFLETPAAALATHPLLTFAFNSLQVSFSFEVAIEVMIELVSQHQEIPEAFLSKTPYIREVLLLPALANRSEKIIAGLACLMCEVGQAAPALVAEGGGQALALTDGLLRCSLAHFILGIDVKTAKRNVVRELFVPVFSSLLDALLFRAQMDTDSDGAPCIPEGLTQFRMNLEELLIDICLLLGAPAYINKLFSGGWDFSSQTIPWKEVEVRMYALSMFMKVYKSFGDVIGSYSKWLSSSQSNIKPLLLFCASGISKSISSNACSLALRKLCEDAPSFIHEPQNLEILFWISEGMNKGNLQLEDEEEIISAITHALSSVSEKELKKSSLARLLCSSYSAVEKIIDIDRDQSLRQNPAAYTQSLDLAVRGLYRMSALFHHLATSVTSGLVDDDIIIVLLGILWPLLEKLFRSSHMENVNLSAAVCRSLSSAMHSCGHHFHILLPKVMECLSANFLLFQRHDCFLRTGKELYFYAQLFFFASKILLKKDYSLHLVITRVNTANVIEEFGHKEEYGALCVRTFETLSSASSISALNSSYTCDQEPDLVEAYTYFTSMFIRCCQKEAIVASSSLLELSFQKAAICSTAMHRGAALAAMSYMSCFLESVLAAVLESPECIPNGSPGVALIQILARCGEGLLSNVLYALLGVSALSRVHKSATILQQLAALCSFCEATAWKAVLSWNSLCGWLQSTVKSLPSEYLKQGEAEMIVPLWLKVLQDAGSDYLYSRTGDNIRSHQGYMQGKGGRTLKRIIRDFAESHRNVPIPSTS

SEQ ID NO: 689 - protein, 653 aa, Sorghum bicolor
MASSPPPPPIRTVLAATLLLLPHNAAAAAAVADASSAVNPFTAKAAFIRYWNRKVPNNRPHPAFFVAKLSPLPAADSASFPTALPDIRARLPELCTKAALLCPGPATTDAASLAASGPRGGGPFKGYSNANFSNYGTGGVAGADSFRNYSPDLNIAADSFRRYGRDSSGRADSFASYESDGNVVTANFTSYAGGATGGSGSFAAYAAETNVPDSTFTNYDAGANGRGRSFASYSQEANHGENGFSGYGKSGNGVRETFSSYGNESNVLGSGFANYGQSANGATDTFTGYGVEGNVPENTFRNYGAGGNAGVDTFKKYRDDANVGDDRFTSYAKGANGGAAEFQSYGNSANPGSTTFKGYGEGSNPNHHIGFKEYAGENNTFKGYAKTGVSFKEYHNTSSSTAALTVSAEAAASMQHHDHLKWSPEPGKFFREQELVSGNRMPMPDIRDKMPPRAFLPRAIAARIPFDPQAVSEAFGLPLDTALGKAVSSTVAECLRAPSKGETKRCATSAEDVVDFAVETLGDDIVVRSTASTAGSGGDVRLGTVTGVDGGKVTRSVSCHQSLFPYLVYYCHSVPKVRVYEADIMAAAAAADDDGGSDAGEKEIINHGVAICHLDTSDWSPTHGAFVALGGKPGEVEVCHWIFEGDMTWTVAD

SEQ ID NO: 690 - protein, 676 aa, Glycine max
MNPMGASTVSNEELKEIESLGREDIEEAPIVPEDVSRIAPWIRQITLRGLVASFLIGIIYSVIVMKLNLTTGLVPNLNVSAALLGFVFIRAWTKVLAKAKIVSTPFTRQENTIIQTCAVACYSISVGGGFGSYLLGLNRRTYEQAGVGTEGNNPGSTKEPGIGWMTAFLFVTSFVGLLALVPIRKIMIIDYKLTYPSGTATAVLINGFHTPKGDVMAKKQVHGFLKFFSASFLWAFFQWFYSGGDNCGFVKFPTFGLKAWKNSFYFDFSMTYVGAGMICSHLVNLSLLLGAVISWGIMWPLIRGLKGEWFPASIAESSMKSLNGYKVFISIALILGDGLYNFVKVLYFTATNIHATVKRKNPETFSDNQKPLPLDDLRRNEVFARESIPIWLACTGYILFSIVSIIVIPLMFPQLKWYYVVFAYLFAPSLSFCNAYGAGLTDMNMAYNYGKVALFVLAALAGKNDGVVAGLVGCGLIKSIVSISSDLMHDFKTGHLTFTSPRSMLLSQAIGTAIGCVVAPLTFFLFYKAFDVGNPDGDYKAPYAIIYRNMAILGVEGFSALPHHCLQLCYGFFAFAIAANLVRDLAPKNIGKWIPLPMAMAVPFLVGGYFAIDMCMGSLVVFLWHKLNRNEAGLMVPAVASGLICGDGLWILPSSILALFKIRPPICMSFLSASAS

SEQ ID NO: 691 - protein, 436 aa, Glycine max
MCKEKKRIIINLLALALQRERERVIMVTMEESPRSPEAKLGLRVEDLWDIQEPQLSPDEKFNACFESIPVSAFPPPPSNQEIEIKSDATLAEAVKILAEHNILSAPVVDVDAPNDASWIDRYIGIVEFAGIVVWILHQSEPTSPRSPSGGAANTAAVNGITSEAFGLESASTTSGNFFEDLTSSQLYKNTKVRDISGSFRWAPFLALERSNSFLTMLLLLSKYKMKSIPVVDLGAGRIDNIITQSSVIHMLAECAGLQWFESWGTKKLSEVGLPMVTPNHIIKVYEDEPVLQAFKLMRKKRIGGLPVMDRGSSTAIGNISLKDVQFLLTAPEIYHDYRSITAKDFLTAIRSYLEKHEGAFPMSGDLITCNKDCTIKELIQLLDHEKIHRVYVADNDGNLEGLITLRDIISRLVHEPRGYFGDFFDGVLPMPPNSRV

SEQ ID NO: 692 - protein, 731 aa, Glycine max
MTNGRMRRKFFSSCVGPTQIQELTPQHNLIRSSILTRGFQSRSVPPIFIHKSFSLYFCIALSGFCIIILSIFHSFVSGHRSNPERRRDKVYIGCGAGFGGDKPLAALKLLQRVQELNYLVLECLAERTLADRYQIMMSGGDGYDSQISNWMHMLLPLALERGTCIITNMGAMDPLGAQQKVLEIANSLGLNVSVAVAHENLGDFLIILCAKFYNLYIHTTSFRFRIFTSKIIYHGGCKNLFSRPMRLTYLGAAPIVRCLEKYQPNVIITSRIADAALFLAPMVYELGWNWDELEHLAQGSLAGHLLECGCQLTGGYFMHPGDKYRDMSFQQLLDLSLPYAEICFDGQVCVSKSEGSGGVLNFNTCAEQLLYEVGDPGAYVTPDVVIDFQDVSFLPLSSSRVCCHGAKPSTISVPDKLLQLVPQDCGWKGWGEISYGGYECVKRAKAAEYLVRSWMEEIFPGLNHRILSYIIGFDSLKATSGNGNESSQTTSEDNRLRMDGLFEQKEQAIQFTREFIALYTNGPAGGGGISTGYKKETLLEKHLVKREDVFWRTGIKRSTRSQSNKVVDPDHNLRHILTLPPKLQAETDKSLESVSLGSSCSPAPSGQKIPLYSVAHSRAGDKGNDINFSLIPHFPPDNERLKLIITSQWVKSVVSNLLDLSLSPDLDAKIPRDKWVNENVKVEIYEVKGIQSLNIVVRNILDGGVNCSRRIDRHGKTISDLILCQQVVLPP

SEQ ID NO: 693 - protein, 310 aa, Glycine max
MRSLAAPHSFRVFVNSPIFRPIKLPFLTLNPLSSPSRRSPASVQCAVQFRPCIDIHKGKVKQIVGSTLQDLKGGDGSDPVTNFESDKSAAEYAALYKQDGLTGGHVIMLGADPLSKASALEALHAYPGGLQVGGGINSDNCLSYIEEGASHVIVTSYVFNNGQMDLGRLKDLVQIVGKDRLVLDLSCRKKDGKYAIVTDRWQKFSDVFVDPDVMEFLANFADEFLVHGVDVEGKKVTECTGRNKTTEENGNQIPVTYAGGVTEMSDLERIKTAGMDRVNVTVGSALDIFGGNLAYEEVVAWHAQQNASAV

SEQ ID NO: 694 - protein, 765 aa, Glycine max
MFDWNDEELANIVWGEVGEGDDHIVPYPEASEDLNDKKEWSQEASATKLIDQKRIEAKTDFHQGKLGSSSKLDIIEGQSASESGTNSWPDLSLSTAAKTDQGSLGAADVSKTLEETTQLEKDVEKQGDFVNYAWDNIGSFDDLDRIFSNDDDPIFGHVSLENSDELWSSKDVSNSTVPILLETPNPTSALRNRSEPLEIKAEYVQQNDRSFSPRFKRIGDSLSHDIEKAPANIFNVGYDRDRIAPADKEQQVSDRGLWPNYIRPMIRGLIKRDQIEGIRKTVPQGKPSPTGDLLSPTDLSDFRIYSVKNKIKLDTVKTCSSHVHCVLVLKTCRGVRHILSRCVCASYAIGFIVQSIFVLSEDFGQNNQLKARKKSQGKLEGKSLKEFYGSWSPSSTTSGQFQNQLVSSVIQSSPSSILGQWNELQGPETLYQDITNTYVTSSAYGNLTNTYSSMSMLPQAQSGVLMRQPLLSRYEASLGVMNPVSKSVDLVKPLTMTPQEKIEKLRRRQQMQAMLAIQKQQQEFGHQVPSTNKSMNEKCAIEIHSQLCDGADPEIEDLRTALDPPTEQDDSNTMSLAIDDHFVEDTILYMLQDAISKLDVKIRLCIRDSLFRLAQSAMQRNYANDTSSTNNTSREELKVAAREESNSQNRYARIADVETKTNPIDRTVAHLLFHRPLELTGNYPDKLESPISAKIQFESREANMEKFHMGCLPDEDLKSNQQFSHQGLEAQPEDQFKNSRCIDTSENASNNVLADAGDQVLEALQ

SEQ ID NO: 695 - protein, 377 aa, Glycine max
MALKLVNLGFHSSIPCSPRPLKDRFVLRSSKVEQISFTESENSLIEALLGIQGRGRSSSRQQLNAVERAVQVLERLGGVPDPTKSNLIEGRWQLIFTTRPGTASPIQRTFVGVDFFSVFQEVYLRTNDPRVCNIVSFSDAIGELKVEAAASIEDGKRILFRFDRAAFSFKFLPFKVPYPVPFRLLGDEAKGWLDTTYLSSSGNLRISRGNKGTTFVLQKQTEPRQRLLTAISSGKGIKEAIDELISLKQNTGQEDPELEEGEWQMMWNSQTVTDSWIENAVNGLMGKQIIRKNGRIKFLVDILLGLKFSMSGNFVKTGSGVYGVTMDDAAIIGGPFGYPLELKNNFILELLYSDEKLRVSRGNNSILFVHVRTDALR

SEQ ID NO: 696 - protein, 941 aa, Solanum lycopersicum
MSGKSRNFRRRGGDDGDDDETATKSTNGTAAKPTTTASASAAKPKKKSLLSFADDEESDDTPFVRPSSKPSSASSRITKPSSSSSAHKLTSGKDRITPKPTSFTSNVQPQAGTYTKEALLELQKNTRTLVGSRSSQPKPEPRPGPVEPVIVLKGLVKPPFSVSAQTQQNGKESEDDEMDVDQFGGTVNRLGSMALEKDSRKKDDVGSVIPDKMTIDAIRAKRERLRQARPAAQDFIALDEGGNHGEAEGLSDEEPEFQQRIGFYGEKIGSGRKGVFEDFDDKALQKDGGFRSDDDEEDEEDKMWEEEQVRKGLGKRLDDGSNRGVMSSVVSSAAAVQNAQKANFGSSAVGASVYSSVQSIDVSDGPTIGGGVVGGLPSLDALSISMKAEVAKKALYESMGRLKESHGRTVTSLHKTEENLSASLSKVTTLENSLSAAGEKYMFMQKLRDFVSVICALLQDKGPYIEELEDQMQKLHEERAAAILERRAADNDDEMKELEAAVSAARQVLSRGGSNAATIEAATAAAQTSTAAMRKGGDLPVELDEFGRDKNLQKRMDTTRRAEARKRRRMKNDVKRMSAIKCDSSYQKIEGESSTDESDSESTAYQSNRDQLLQVSEQIFGDAHEEYSQLSVVVEKFDRWKKDYASSYRDAYMSLSIPVIFSPYVRLELLKWDPLHENTDFMDMNWHNSLFSYGISPEGETEISADDTDVNLIPQLVEKLAIPILHNQLANCWDMLSTSETVCAVSAMRLVLRYGPFSGSALSNLIAVLRDRLADAVANLKVPTWDTLVMRAVPDAARVAAYRFGMSIRLIRNICLFHEIFAMPVLEELVLDQLLSGKIVPHLRSIQSNIHDAVTRTERVVTSLHGVWAGPKATGDCSPKLRPLVDYLLSLARVLEKKHSSSSGEIETSKFARRLKKMLVELNQYDYARDISRTFNIKEAL

SEQ ID NO: 697 - protein, 205 aa, Triticum aestivum
YPGDVTVRATYSLPEATTLRLDMEAIPANKATPISLAQHTYWNLAGHNSGSILDHSIQIWAKHVTPVNENTIPTGEIMPVQDTPFDFTTEHKIGDRISDVPGGYDHNYVLDSGDEKNGLKHAAKLKDPSSSRTLDLWTDAPGMQFYTANYVNGITGKGGAVYGKHAGVCLETQGFPNAINQPNFPSVVVQPGAKYKHAMLFEFSA

SEQ ID NO: 698 - protein, 261 aa, Brassica juncea
ASMKCGGCQGTGMKVTMRQLGPGMIQQMQHACNECKGTGETINDRDRCPQCKGDKVIPEKKVLEVNVEKGMQHSQKITFEGQADEAPDTVTGDIVFVIQQKEHPKFKRKGEDLFVEHTLSLTEALCGFSFVLTHLDGRNLLIKSNPGEVVKPDSYKAISDEGMPIYQRPFMKGKLYIHFTVEFPDSLSPDQTKALEAVLPKPSTTQLSDMEIDECEETTLHDVNIEDEMRRKAQAQREAYDDEDDDDDHPGGAQRVQCAQQ

SEQ ID NO: 699 - protein, 92 aa, Brassica juncea
MSLASPIQCIRIINPSSSSSSSLTTWSSLRFSTSKPCVFIIRCSQAEGPLRRPSAPPTLREPTPPQKPVTPTPSSSPPPPQKAVAVDGKSVV

SEQ ID NO: 700 - protein, 58 aa, Brassica juncea
KPADGENYYRGGGRGGGRGRGRGGRDRGVVSGGGFDGYRSEAAPAIGDTAQFPSLGGK

SEQ ID NO: 701 - protein, 112 aa, Brassica juncea
MTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKPPAPAPVPES

SEQ ID NO: 702 - protein, 296 aa, Glycine max
MMVQKEDLGLSLSLNFPHHSTPNPQHLSLMSSSTHSSSPSGFNPQKPSWNEAFASSDRNSDTCRGETRSFLRGIDVNRLPSAVDAEEEAGVSSPNSTVSCVSGKRSEREPNGEEHDMDRACSRGISDEEDAETSRKKLRLSKDQSAILEESFKEHNTLNPKQKLALAKQLGLRPRQVEVWFQNRRARTKLKQTEVDCEVLKRCCENLTEENRRLQKEVQELRALKLSPQFYMQMSPPTTLTMCPSCERVAVSSSAVGSATRHHPMAHAHAHARPMPNGPWASAAPIPHRPFDAFHQ

SEQ ID NO: 703 - protein, 527 aa, Arabidopsis thaliana
MASLSLPITLKNPRFFSSSPQNIFKTQPQTLVLTTKFKTCSIICSSSCTSISSSTTQQKQSNKQTHVSDNKREEKAEEEEEEKEVSLREIWREVQGCNNWEGQLDPMNNHLRREIIRYGEFAQACYDSFDFDPHSKYCGSCKYHPSDFFLNLDLHLHKGYTITRYLYATSNINLPNFFQKSKLSSIWSQHANWMGFVAVATDEEEVSRLGRRDIVIAWRGTVTYLEWIYDLKDILCSANFGDDPSIEIELGFHDLYTKKEDSCKFSSFSAREQVLAEVKRLIEYYGTEEEGHKTSITVTGHSLGASLALVSAYDIAELNLNHVPENNYKIPITVFSFSGPRVGNLRFKERCDELGVKVLRVVNVHDKVPSVPGIFTNEKFQFQKYVEEKTSFPWSYAHVGVELALDHKKSPFLKPTKDLGCAHNLEALLHLVDGYHGKDEEAEKRFCLVTKRDIALVNKSCDFLRGEYHVPPCWRQDENKGMVKNGDGQWVLPDRPLLEPHGPEDIAHHLQQVLGKVNDDNFKPTTT

SEQ ID NO: 704 - protein, 119 aa, Arabidopsis thaliana
MMSEFAPISIYLVISLLVSLILLGVPFPFASNSSTYPEKLSAYECGFDPSGDARSRFDIRFYLVSILFLIPDLEVTFFFPWAVSPNKIDLFGFWSMMAFLFILTIGFLYEWKRGASDRE

SEQ ID NO: 705 - protein, 193 aa, Arabidopsis thaliana
MSSVCGKLDFKDADFDISTSSPTQCSKGSEHTSFTGSEDSQESDGDETGYIDPTVNDETAVQDFGKSVLSPNSSDDEDKDENLMTTPIVLIPAIKGSREKYGLSLRKSSVSWGADVYDPPPSIASHTVTRSKKQQQKSKSKDNHRKTGKKGQKSKDNSSSRGGSSKDKKQASRKHSRDKFDWVTQMPIVAASS

SEQ ID NO: 706 - protein, 259 aa, Arabidopsis thaliana
MLLKTVSSSSSSALSLVNFHGVKKDVSPLLPSISSNLRVSSGKSGNLTFSFRASKSSTTDALSGVVFEPFKEVKKELDLVPTSSHLSLARQKYSDECEAAINEQINVEYNVSYVYHAMYAYFDRDNIALKGLAKFFKESSLEEREHAEKLMEYQNKRGGRVKLQSIVMPLSEFEHVDKGDALYGMELALSLEKLVNEKLLNLHSVASKNNDVHLADFIESEFLTEQVEAIKLISEYVAQLRRVGKGHGTWHFNQMLLEG

SEQ ID NO: 707 - protein, 463 aa, Arabidopsis thaliana
MGRTCLPRWRLGRLMAGLQVILGLLVITVSLSCLYRFHSVGYFLQNEDTCNNIYTIKEVSSEGFDLKALHDRVDEVLEKMDNLYEKLEKTVKDMEKSKDGSKKEMKKFLEDEVMKPFYYAHIGLRQIRLPKPEGIRNSTEKEEPLINKFLIEEIRQYITPKENRVGKINMFGTERVYNTIGHACALMKMELEKYMDYDVGAYCDDDWNLAQKLMLNGCDPLPRRRCLTRASMTYQKPYPINESLWKLPDDRNVRWGNYQCRNFACLSSKNPKRGYTKCSGCFEMEKEKDKWVKNSSLLVDFMIEDVLRLKPSEIRIGLDYGVGTGTFAARMREKNVTIVTTALNLGAPFNEMIALRGLIPLYISLNQRLPFFDNTMDMIHTTGLMDGWIDLLLMDFVLYDWDRVLRPGGLLWIDRFFCKKKDLDDYMYMFLQFRYKKHKWAISPKSKDEVYLSALLEKPPRAI

SEQ ID NO: 708 - protein, 383 aa, Brassica juncea
MAMRRVTGAAIRACVSSSSSGSLARQFHASSGDSKKIVGVFYKANEYASKNPNFLGCVENALGIRSWLESQGHQYVVTDDKEGPDCELEKHIPDLHVLISTPFHPAYVTAERIKKAKNLQLLLTAGIGSDHIDLQAAAAAGLTVAEVTGSNVVSVAEDELMRILILMRNFVPGYNQVVNGEWNVAGIAYRAYDLEGKTVGTVGAGRIGKLLLQRLKPFGCNLLYHDRLQMGPEMEKETGAKYVESLDEMLPKCDVVVVNTPLTEKTRGMFNSEMIGKMKKGVLIVNNARGAIMDRQAVVEAVESGHIGGYSGDVWDPQPAPKDHPWRYMPNQAMTPHISGTTIDAQLRYAAGTKDMLEKYFKGEDFPAQNYIVKDGELAPQYR

SEQ ID NO: 709 - protein, 444 aa, Brassica juncea
MGADAIQTNGQDPAKLTVVEGIERLRCAVKNYEWGKLGHDSLVARLHEANSGNRVDPAVPHAELWMGTHESGPSHVVKEEELGSGHDGSECMITLKSWVSDNPDVLGSRVVDKWGCDLPFLFKVLSVTKALSIQAHPNKALAEKLHREEPLLYRDANHKPEIALAITPFQALCGFISLKELKEVIANVPEITELVGSKAADQIFTVNEKDGDESIKSIVRLIFTQLMSASNNETKRVIYEMKMRLITETNHRELTEKEKLVLELEKQYPGDVGVISAFFFNYVKLNPGEALYLDADEPHAYISGDCVECMAASDNVVRAGLTPKHRDVQTLCSMLTYKLGYPEILKGFPLTPYITRYLPPFDEFEVDHCDLPTGKSTIFPAISGPSVYLVIEGTGKLQTGSSQLLVNRGDVLFVPAHNEIHLTGESDVMKLYRAGVSSRFFQTL

SEQ ID NO: 710 - protein, 509 aa, Brassica juncea
MDRREVYVLTIFVALSVRCVGCVANYNRNDFPTDFAFGSGTSAYQWEGAYDEDGKKPSVWDTYVHSRNMENGDIACDGYHKYKEDVQLMVETGLEAFRFSISWSRLIPNGRGPVNPKGLEFYKNFILELVTHGIEPHVTLYHYDHPQYLEDEYRGWLNRRIIKDFTAYADVCFREFGKHVKFWTTINEANIFTVGGYDGGNTPPGRCSTCMSGNSSTEPYIVAHNLLLAHASASRLYKQKYKDTQGGSVGFSIFTIGFRPSTNSKDDEMAIQRFKDFFYGWMLGPLTYGDYPEGMKRKLGTRLPVFTKEEAEQVKGSSDFVGVIHYLAATISNAEPKPLLPGDSAFFAEIGATLTYSGNFSGFEYEVAPWAMEVVLEYIKQSFGNPPVYILENGEPMKQDLQLQEKDTPRIEFLDAYIGAVLKAVRNGSDTRGYFVWSFMDLYELLSGYNFSFGLYSVNFSDPHRKRSPKLSAHWYSAFLKKGNTNFPGFQGTSHLQTNLSSSSLAASS

SEQ ID NO: 711 - protein, 593 aa, Brassica juncea
MAMAFPLSYTPVSVKPVTHSRRSKLVVFSSSSNGRDPSPSEEKSVPNGVKSIEKLQEEKRRAELSARIASGAFTVRKSSFPSTVKNGLSKLGVPSNVLDFMFDWTGANEDYLKVPEAKGSIQAVRNEAFFIPLYELFLTYGGIFRLTFGPKSFLIVSDPSIAKHILKDNAKAYSKGILAEILDFVMGKGLIPADGEIWRRRRRAIVPALHMKYVAAMISLFGEASDRLCQKLDTAASTGEEVEMESLFSRLTLDIIGKAVFNYDFDSLTNDTGVIEAVYTVLREAEDRSVSPIPVWDIPIWKDISPRQRKVATSLKLINDTLNDLIATCKRMVEEEELQFHEEYMNERDPSILHFLLASGDDVSSKQLRDDLMTMLIAGHETSAAVLTWTFYLLTTNPKVVAKLQEEVDSVIGDRFPTLEDMKKLKYTTRVMNESLRLYPQPPVLIRRSLENDKLGPYPIKRGEDIFISVWNLHRSPLHWDDAEEFNPERWPLDGPNPNETNQNFSYLPFGGGPRKCIGDMFASFENVVAIAMLIRRFNFQTAAGAPPVKMTTGATIHTTEGLKLTVTKRTPPLSVPILPMEAPRDEVSSALS

SEQ ID NO: 712 - protein, 583 aa, Brassica juncea
MAFKVTLVSTSPIDGQKPGTSGLRKKVKVFKQPNYLENFVQATFNALTPEKVKGATLVVSGDGRYYSKDAVQIIIKMAAANGVRRVWVGKNTLMSTPAVSAVIRERSGADGSKATGAFILTASHNPGGPTEDFGIKYNMENGGPAPESITDKIYENTKTIKEYPIAEDLPNVDISAIGVTSFEGPEGKFDVEVFDSADDYVKLMKSIFDFESIRKLLSSPKFTFCYDALHGVAGAYAHRIFVEELGAQESALLNCVPKEDFGGGHPDPNLTYAKELVARMGLGKSDTGGEPPEFGAAADGDADRNMILGKRFFVTPSDSVAIIAANAIGAIPYFSSGLKGVARSMPTSAALDVVAKSLNLKFFEVPTGWKFFGNLMDAGMCSVCGEESFGTGSDHIREKDGIWAVLAWMSILAHKNKETINGDTKLVTVEDIVRQHWATYGRHYYTRYDYENVDAGKAKELMEHLVKLQSSIPEVNKIVKGIRSDVANVSSADEFEYKDPVDGSISKHQGIRYLFEDGSRLVFRLSGTGSEGATIRLYIEQYEKDASKIGRESQEALSPLVDIALKLSKMEEFTGRSAPTVIT

SEQ ID NO: 713 - protein, 476 aa, Brassica juncea
MSFNRNLLNIIIILCVCLNWDCSEGAQEKQRRAIDSHTIQLSSLFPSSSSPCVLSTRASSTKSSLHVTHRHGTCSRITSAKAKSPDHAEILRLDQARVNSIHSKLSKKLTDRVRQSKSTDLPAKDGSTYGSGNFVVTLGIGTPKHDLSLIFDTGSDLTWIQCEPCVRTCYSQKEPIFNPSSSSSYHNVSCSSAECSSLSSATGNSGTCSASNCVYGIQYGDQSFSVGFLAKEKFTLTASNVFDGVNFGCGENNQGLFTGVAGLLGLGRDKLSFPSQTAATYNKIFSYCLPSSASYTGHLTFGSAGVSRSVKFTPISTITDGTSFYGLDIVGISVGGQKLAIPPTVFSTPGALIDSGTVISRLPPKAYAALRGAFKAKMSQYKNTSGVSILDTCYDLTGLKTVTIPTVSFYFNGGAVVQLGSKGVLYAFKMSQVCLAFAGNSDDNNAAIFGNVQQQTLEVVYDGAAGRVGFAPNGCS

SEQ ID NO: 714 - protein, 720 aa, Brassica juncea
MPSHTNFLFRWIGLFSQKLRRETAGISENNGGESSSSSDDTPVLSSGECYACTQVGVPAFHSTSCDQANAPEWRASAGSSLVPIQEGSAPTNPVRPRLRRLKGPFGEVLDPRSKRVQRWNRALLLARGMALAVDPLFFYALSIGRTTGPACLYMDGAFAAVVTVVRTCLDALHLWHVWLQFRLAYVSRESLVVGCGKLVWDPRAIASHYARSLTGFWFDVIVILPVPQAVFWLVVPKLIREEKVKLIMTILLLIFLFQFLPKIYHCICLMRRMQKVTGYIFGTIWWGFALNLIAYFIASHVAGGCWYVLAIQRVASCIRQQCMRTANCNLSLSCQEEVCYQFVSPTSTIGFPCLSGNLTSVVKKPMCLDSDGPFRYGIYGWALPVISSNSLAVKILYPIFWGLMTLSTFGNDLEPTSNWLEVVFSIVMVLSGLLLFTLLIGNIQVFLHAVMAKKRKMQIRCRDMEWWMKRRQLPSRLRQRVRRFERQRWTALGGEDELELIQDLPPGLRRDIKRYLCVDLINNVPLFRGMDDLILDNICDRAKPRVYSKDEKIIREGDPVQRMIFIMRGRVKRNQSLSKGVVATSTLEPGGYLGDELLSWCLRRPFIDRLPPSSATFVCLDNIEAFSLGSEDLRYITDHFRYKFANERLKRTARYYSSNWRTWAAVNIQMSWRRYRKRTCGGVGGSMSPVSEHSVEGNSERRLLQYAAMFMSIRPHDHLE

SEQ ID NO: 715 - protein, 360 aa, Brassica juncea
MTMNSLPRRFGRDQGYLDRDHRRGRRSGSDSDEELKGLSHEEYRRLKRLKMRKSGKHCIWRNTPSPPRDPNEVESDENAADEEVPEKDEEDPKSESGKSESESDRSRKKRKSKSSRSKRSRRYSDSESDDDSDEEDRRRRRRKKKQKSSRKRRGHRRKRRYSDSDDESEISASSSSGEERSKNIDSKGKLEEAVKEPELDEEEMKMIIESKKKALPEDEEEEGEVGPMPLPKAEGHISYGGALRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKTDGADD

SEQ ID NO: 716 - protein, 573 aa, Brassica juncea
METNSSGEDLIVKTRKPYTITKQRERWTEEEHNRFLDALRLYGRAWQKIEEHVATKTAVQIRSHAQKFFSKVEKEAEAKGVPVAQALDIAIPPPRPKRKPNNPYPRKTGTGSLPISKTGLNDGKQSLGSDKVLVPEMTNEDLQEDNCSDCLTHQHLSAASSIKTSNASTFREFLPSREQGNNKESNSANYSENIEAEPQTYPRHIPMLVPLGSSITRSLSHAPDENSHHPHTVAGDHQSFPDHIMSSLLQTPALYTAASFASTFWPPDTSVGPQGNNLTPNLAAMASATVAAASAWWAANGLLPLCAPFSSGGLTSHPPTITYGPSSGEVDVTKTTDQEHSEASKARSSLDSEETKNGSKPDCHEHHPCAATETDAKGSDGARERKQVDRSSCGSNTPSSSDDVEADALERQENGGNNDDEVKEVNADTTNNNPQTTSESNARRSRISSNLADPWKSVSDEGRIAFRALFAREVLPQSFTYREEGQQQQQQRYPMELDLNSTAELTPADDEEENRNIAFLGASKLSRGRTGFKPYKRCSMEAKESRVINTNPITIHVEQKDPKRIRLETQTST

SEQ ID NO: 717 - protein, 451 aa, Brassica juncea
MMISQFFVLSQRGDNIVFRDYRAEVPKGSTETFFRKVKFWKEDGNAEAPPIFNVDGVNYFHVKVVGLYFVATTRVNVSPSLVLELLQRIARVIKDYLGVLNEDSFRKNFVLVYELLDEVIDFGYVQTTSTEVLKSYVFNEPILIAPARLQPIDPAAIFTQGSKRMPGTAVTKSVVANDPGGRRREEIFVDVIEKISVTFSSSGYILTSEIDGTIQMKSYLSGNPEIRLALNEDLNIGRGERSVYDYRSSSGSGVILDDCNFHESVRLDSFDSDRTLSLVPPDGEFPVMNYRMTQEFKPPFHVNTLIEEAGRLKAEVIIKIRAEFPSDIVANTITIQMPLPNYTSRASFELEHGAAGQKTDFKETSKMLEWSFKKIVGGAEHTLRAKLTFSQEFHGNITKEAGPVSMTFTIPMYNVSKLQVKYLQIAKNSSSNNPYRWVRYVTQANSYVARI

SEQ ID NO: 718 - protein, 716 aa, Brassica juncea
MALSAFAFPSYITTKGGLTDSCCKSNSLSSSRSLSADLPSPCLRPNTSHSNRKAKVNASLAEKGEYYSNRPPTPLLDTINYPIHMKNLSTKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKNNNVVAVIGDGAMTAGQAYEAMNNAGYLDSDMIVILNDNKQVSLPTATLDGPSPPVGALSSALSRLQSNPALRELREVAKGVTKQIGGPMHQLAAKVDEYARGMISGTGSTLFEELGLYYIGPVDGHNIDDLVAILKEVKSARTTGPVLIHVITEKGRGYPYAERADDKYHGVVKFDPATGKQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFNIVATAAAIDDRPSCFRYPRGNGIGVALPPGNKGVPVEVGKGRILKEGERVALLGYGSAVQSCLGAAVMLQERGLNVTVADARFCKPLDRALIRSLAKSHEVLITVEEGSIGGFGSHVVQFLALDGLLDGKLKWRPMVLPDRYIDHGSPADQMAEAGLMPSHIAATALNLIGAPREALY

SEQ ID NO: 719 - protein, 810 aa, Brassica juncea
MSNPAESSDSKSKKDFSTAILERKKSPNRLVVDEAINDDNSVVSLHPATMEKLQLFRGDTILIKGKKRKDTVCIALADESCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGGGGDAGGAADRVLNQLLTEMDGMNAKKTVFIIGATNRPDIIDSALLRPGRLDQLIYIPLPDEDSRLNIFKACLRKSPVAKDVDINALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFETNAAGSGATTGVADPFATSAAAAADDDDLYN

SEQ ID NO: 720 - protein, 432 aa, Brassica juncea
MAESSKVIHVRNVGHEISENDLLQLFQPFGVITKLVMLRAKNQALLQMQDVSSAITALQFFTNVQPTIRGRNVYIQFSSHQELTTAEQNIHGREDEPNRILLVTVHHMLYPITVDVLHQVFSPYGFVEKIVTFQKSAGFQALIQYQAQQCAASARTSLQGRNIYDGCCQLDIQFSNLEELQVNYNNDRSRDYTNPSLPSEQKGRLPHPGYGDAGVAYPQMANTSAIAAAFGGGLPPGITGTNDRCTILVSNLNTDSVDEDKLFNLFSLYGNIVRIKLLRNKPDHALVQMGDGFQAELAVHFLKGAMLFGKRLEVNYSKHPNITPGTDSHDYVNSNLNRFNRNAAKNYRYCCSPTKMIHLSTLPQDVTEEEVVNHVQEHGAILNTKVFEMNGKKQALVQFENEEEAAEALVCKHATSLGGSIIRISFSQLQTI

SEQ ID NO: 721 - protein, 394 aa, Brassica juncea
MARPAIRDGDEGISLLVFNGHGDRSWQLNFDDFQVSPEHKEKKSPSKLHNCLGCLGPEDNVADYYQQQVEMLEGFTEMDELAERGFVPGMSKEEQDNLAKSETLAIRISNIANMVLFAAKVYASVTSGSLAIVASTLDSLLDLLSGFILWFTAFSMQTPNPYQYPIGKKRMQPLGILVFASVMATLGLQIILESLRTMVSSHKEFSLTKEQESWVVGIMLSVTLVKLLLVLYCRSFSNEIVKAYAQDHFFDVITNIIGLIAVILANYIDNWMDPVGAIILALYTIRTWSMTVLENVNSLVGKSATPEYLQKLTYLCWNHHREIRHIDTVRAYTFGSHYFVEVDIVLPADMPLQVAHDIGEALQEKLEQLQEIERAFVHLDYEYTHKPEHARSHC

SEQ ID NO: 722 - protein, 382 aa, Brassica juncea
MGGGEEEIKERLQPATEKKQHNVKGKRLWQKVKYQLVEYHALPAYLRDNEYILGHYRSEWPIKQILLSIFTIHNETLNVWTHLIGFFLFLALTIYTATKVPSVVDLHSLQHRLPDVLRKTDLHKLHSDLMSRLPSSPSKWHVMELLYNCLPERFSHGNSTDMCVLHSVKEDLANMIAPLIFRPITRWPFYAFLGGAMFCLLASSTCHLLSCHSERVSYIMLRLDYAGIAALISTSFYPPVYYSFMCDPFFCNLYLGFITILGISTVLVSLLPVFQSPEFRVVRASLFFGMGFSGAAPILHKLIIFWDQPEALHTTGYEVLMGLLYGLGALVYATRIPERWMPGKFDIAGHSHQLFHVLVVAGAFTHYRAGLVYLKWRDIEGC

SEQ ID NO: 723 - protein, 362 aa, Brassica juncea
MVMVVGETSMELDQCFQMMMMKMEGVSIKEWKDIPVELLMRILSLVDDRNVIAASGVCCGWRDAISLGLTRLRLSWCNNNMNSLVLSLAPKFVKLQTLILRQDKPQLEDNAVDAIANHCHELQELDLSKSLKLTDRSLYALAHGCPNLTKLNLSGCTSFSDKAIAYLTRSCRNLKVLNLCGCVNAVSDYTLEAIGNNCNQMQSLNLGWCEKISDDGVMSLAYGCPDLRTLDLCGCVLITDESVVALADWCVHLRSLGLYYCRNITDRAMYSLAQSGVKNKPGGQWKSSAKKSKFDEEGLRSLNISQCTALTPSAVQAVCDTFPALHTCSGRHSLVMSGCLNLTSVHCACILQAHRSVPHSAH

SEQ ID NO: 724 - protein, 471 aa, Brassica juncea
MEGRRITASPRPCSGRRVVAAEKKRSRPDGFVNSVKKLQRREISSRKDRAFSISTAQERFRNMRLVEQYDTHDPKGHCLVALPFLMKRTKVIEIVAARDIVFALAHSGVCAAFSRETNKRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKHVQEIKISPGIMLLIFKRATSHVPLKILSIEDGTVLKSFNHLLHRNKKVDFIEQFNEKLLVKQENENLQILDVRNAQLMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITSSSGPPKEDESSSSSSSSLGNNSKLRRNAVAEALEDITALFYDEERNEIYTGNRHGFVHVWSN

SEQ ID NO: 725 - protein, 385 aa, Hordeum vulgare
MVTIVGTREQFVQPQSCLRATMQLKSPTRPKLSFCFTPQGDCDQYCALIPGLPEDLAKICLALVPRTHFPVMGGVSKRWMSFLESKELIAVRKEVRKLDECVYVLTTDAGAKGSHWEVLGCQGQKNTPLPPMPGPTKAGFGVVVLDGKLVVIAGYAADHGKECVSDEVYQYDCFLNRWTAISKMNVARCDFACAEVNGVIYVAGGFGPDGDSLSSIEVYDPEQNKWALIGRLRRPRWGCFGCSFEDKMYVMGGRSSFTIGNSRFIDVYDTNSGAWGEFRNGCVMVTAHAVLGEKLFCIEWKNQRSLAIFNPADNSWQKVPVPLTGSSSTRFSLGTHDGKLLLFSLEEEPGYQTLMYDPAAPTGSEWCKSTLRPSGSCLCSVTIKA

SEQ ID NO: 726 - protein, 221 aa, Brassica napus
MVLWVFGYGSLIWNPGFDFDEKLIGYIKDYKRVFDLGCIDHRGTPEHPARTCTLEDSAGAICWGAAYCVRGGPEKEKLAMEYLEGRECEYDSKTLVQFYTETDTTKQSKPILTGVIVFTSTPDKVSNKYYLGPAPMEEMAMQIATATGPCGNNREYLFKLEKAMHDIEHEDEYVIELANEVRKHLDLPKEVKALLKPVVSRVSIKSHSQAHVSTLQRVFAS

SEQ ID NO: 727 - protein, 611 aa, Brassica napus
MFDWDDEELTNMIWGDDGETGDHIVPFKVRNRKEQGDESNKAVKPAEQKTTHLHDSKLGGSSSGQNIECMSSWPDSSVSNARKADPGPGSSEPARYDSTRSEKTSELGKGPDIFHSTDESKEHGDFDEYGWANIGSFDDLDRMFSSDVPIFGDGSLSGADELWSSSKDVSKPLPSILDSQDLGLDIRTQFEQQENQQFPLTGETNGGPSSQSAPRVRVTPKAEEYHEHKSQSSVDDQPYQQHKMMKLSEMLGTCEAGSFQDPYGQRSRRKFVNQLAPSRSTLMGVNLRSESQGSGTSHYPQMPNQYMATSGFGNPYSAVHVVSAFQCPDVNKNQLMHPSYNPASAISANTVTDVCARPSTMTPQEKLEKLRRRQQMQAMLAIQRQQQQFRHQVPVADQSITQLVDKTSLQGLTAIPSFDPNSSLELDDSGNFAAAVDNPSEFSVLYRLQDVVAKLDMETRTCIRDSLFRLADSAGQRHHTSDTPHSNKSSQDDREVIPQEKSRYRYAGMLDTETVTNPTDRTVAHLLFHRPFDMYAAKHTEGLESPSSSKMGAEVKGSFPSTRESRMIKQKAKEEDVPAGSLALGYASNSGSSSTVAERVVEASQGNKRKL

SEQ ID NO: 728 - protein, 485 aa, Brassica napus
MALLVEKTSSGREYKVKDMSQADFGRLEIELAEVEMPGLVSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQVPDPSSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMQGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTKLTKDQSDYVSIPIEGPYKPGHYRY

SEQ ID NO: 729 - protein, 243 aa, Brassica napus
MAISRTFMSVNLFIFFLVIATTNGQAPAPTPSGPTNITAVLEKAGQYTMFIRLLKSTQAADQINTQLNSSSSQGLTVFAPTDNAFSSLKSGTLNSLSDQQKVQLVQFHVLPTLLTMPQFQTVSNPLRTQAGDGQNGKFPLNITSSGNQVNITTGVVSATVANSVYSDKQIAVYQVDQVLLPLAMFGSSSAAPAPAPEKGGSVTTGSASGSDGGGDSTDSSDAERIRYGIIATVAAIAASSLWI

SEQ ID NO: 730 - protein, 382 aa, Gossypium hirsutum
MAMKQVANSAIKAIANSGSSSLLTRQLHASPGSKKIVGVFYKANEYFTKNPNFVGCVEGALGLRPWLESQGHQYIVTDDKEGPDCELEKHIPDLHVLISTPFHPAYVTAERIKKAKNLQLLLTAGIGSDHVDLKAAAEAGLTVAEVTGSNVVSVAEDELMRILILVRNFVPGYHQVITGDWNVAGIAYRAYDLEGKTVGTIGAGRIGKLLLQRLKPFNCNLLYHDRVKIDPELEKQTGAKFEEDLDAMLPKCDIIVINMPLTEKTRGMFDKDRIAKMKKGVLIVNNARGAIMDTQAVADACSSGHIAGYSGDVWYPQPAPKDHPWRYMPNQAMTPHISGTTIDAQLRYAAGVKDMLERYFKGEDFPEQNYIVKAGELAPQYR

SEQ ID NO: 731 - protein, 1680 aa, Gossypium hirsutum
MAPRSGKSKSSKAKAEKKRKEEKIVPYVLDITVTTPYETQVVLKGISTDRILDVRRLLASHVETCHLTNYSFAHEVKGKRLSDKVEMVTLKPCLLKMVEEKYAEEAEAVAHVRRLVDIVACTSRFSRPKRPRSQSLSAPSDSKAEKVNRPNNSALPPAPSDGETTPIPENLDMAAIHPTPKLSEFYDFFSFSHLSPPILNLRKCDPKDVEGWRDGDYFVMQIKICNGKLIQVVASVKGFFTVGKHFFQSHSLLDLLQNLSQAFANAYESLMKAFVGHNKFGNLPYGFRANTWLVPPPVAECPANFPSFPSEDEEWGGNGGGQGRNGEYDLRPWATDFSILASLPCKTEEERIIRDRKAFLLHSQFIDVSIFKAVAAIQHVMNSRLNVKGHPDSVLHEDRTGDLSILVKHDSEDVKLECGVKVAGHQSSDMTTNEIARRNLLKGITADENVVVHDTSALGTVIVRHCGYTAIVSVVGDVKKEKSGAPDIEIDDQPDGGANVLNINSLRVLLHKSSPAEVTGGGQSNQSNLIDSKSSRCLVQRVIKENLKKLEENLAAPERTIRWELGSCWVQYLQKQETSTDATSKGPANDQEAEAAVKGLGKQFKFLKKRDKKPSNISSTVEKEDNGSELCSEDVKSNLGQESNVELSSEMELKHLISKEAFSRLEESGTGLHLKSAEELIKMACKYYDDIALPKLVTDFGSLELSPVDGRTLTDFMHLRGLQMHSLGRVVELSEKLPHIQSLCIHEMITRAFKQVVKAVVASVEKIEDLPVVIASTLNFLLGSCEVDVNAPSANDDYLLKLTWLRKFLAAKFDWKLKDEFQHLRKLSVLRGLCYKIGLELVPRDYDMECQEPFRSCDIISMYPICKHVGCSSADGRTLLESSKIALDKGKLEDAVNYGTKALAKMIAVCGPYHRTTASAYSLLAVVLYHTGDFNQAAVYQQKALDINERELGLDHPDTMKSYGDLSVFYYRLQHMEMALKYVNRALFLLHFTCGLSHPNTAATYINVAMMEEGMGNVHVALRYLHEALKCNQRLLGADHIQTAASYHAIAIALSLMEAYSLSVQHEQTTLKILQAKLGPDDLRTQDAAAWLEYFESKALEQQEAARTGTPKPDASIASKGHLSVSDLLDYISPDQGSKGNDVQRKQRRSKVLQISDKTHDTHHNLQTDGAVFIDATDKATATVDINEIGTLTSIHPEEPEETDNISSIEATVTTEVVEDTTLDEGWQEANSKGRSGNATGKKYGRKKPVFAKLKVNGCEYSNGRESGSRRDIISPAGKTAPKNIIREMQTVKQSKSSSLNPRGTSIGLPASVSRGSSPSANLSAIASKSLSYKEVAAAPPGTVLKPLLEPSEGKMEQSMCAETANVEHGNNISVVDDVVDDNGETEGTHDTESQSEETAPEIDKVSSCSQEKGLEAKGSKLSASAEPFNPGALYHPLNSVSVTCVYDVTASQGMLVEPVVPPVAARVPCGPRSPLFYRNNNSYGSFLRYQTPILEQNGFGSPRVMNPHAPEFVPSKIWQMTGTGDLSGSEEAMNTEVKEVDKKLSREVNGSNPKKSSAEEKSEVARQILLSFIVRSAKQNMDGECEALINDKRLNHSQNSSDAVTSDTAIIKILYGNEGKDLDSQSSSNEEPKALDINNKKPGDGEGFTVVKKRRKNGQQLTNGVTGLYNQQSISASVR

SEQ ID NO: 732 - protein, 257 aa, Gossypium hirsutum
MTHFVLVHGMCHGAWCWYKIVSLLKSGGHRVTPLDLGASGINPKTITDLASLSDYAEPLMALMASLPEDEKVILVGHSYGGVIISLAMESFPMKVLAAVYLTAFMPNHDSSIATGVAEYFRRVMAEPLMDFQLLFEDGSENPPTHALFGPKYMEAMVYQLSPKEDIELANTLLRQGKWFMKDLSKESLLSKEKFGSVDRVYIVCKDDLLIKESLQKWYIENSPTDDVKFIAGADHMPMFSKPQEVCKCLQEVAEKYN

SEQ ID NO: 733 - protein, 447 aa, Gossypium hirsutum
MGSGGSKGCCRVEGGGRDTAPAASSSSSGGLRGRSKVKNRVFRSSCLGALSRSASPKPNFDHRKQPASESDLVKRESNRKLEGEAASNEEMQLPLPTPCISSGGSTSGAAVTAAHRSPSRCLSGISFLPGNLSFRFSRANSMGSSAEMLNPDDDSETLEPQQPPRNSCSPIIFNDSDGSGETLESNARFSRALSVGRLRDRVLGRAPTFCPLQQDIQITQQQLATSPSTTASAHASSVISHDEIETSRSREARYHDLLHNRSNFLERRRRIRSQVRALQRLGSRFENFSGHERSCILSGQHRSGRCTCRVNNRDSSSNDDTTGARSSVSRIVMLAEALFEVLDEIHQQSMVLSSRPSVSPIGSVPAPNEVVESLPVKVYKSPKLKNDEAVQCYICLVEYEEGDSIRRLPCNHEFHRTCIDKWLKEIHRVCPLCRGDICGPDLMPGEK

SEQ ID NO: 734 - protein, 472 aa, Gossypium hirsutum
MSIEPFNRLVKLAARGFYDDVTTKGDNQPKTGRGDNRGIAVVVLDALTRRQWVREEDLAKELKLHSKQLRRILRLFEEEKLVTRDHRRETAKGAKIYSAAVAATADTQMGGKEGEEKIKLHTHSYCCLDYAQIYDVVRYRMHRMKKKIKDELEDKNTVQEYVCPGCGKRYNALDALRLVSLEDEYFHCERCNGELVAESDKLAAQDVGDGDDNARRRRREKLKDMLQKMEVQLKPLMEQLNRVKDMPIPEFGSLQAWEARASAAGRAVNGDSGSNDPSKNSQGYGGTPMPFLGETKVEVAFSGLDGKEDVKSESASTSLKVLPPWMIKQGMNLTKEQRGEVKQESKPDGSSAQPEFSDDKKSTVENDDKKKIQDEYLKAYYAALYKKQQELEEAAKKQQELLDIPLATGLSDSSNRQVGMKAKRDDNEGEDDIDWEEAPVAGNTTESYKVNDLNVEAEESGDDEDDVDWEEG

SEQ ID NO: 735 - protein, 783 aa, Gossypium hirsutum
MTAETALRVSSSSSTVCNLNGFQRRPTPLSSSTRFLGLRPRASSSSISSSLSQFMGSVRIGSRLPISRQQKGKRRNFSLFAMAADESKRAVPLKDYRNIGIMAHIDAGKTTTTERILYYTGRNYKIGEVHEGTATMDWMEQEQERGITITSAATTTFWKDHRINIIDTPGHVDFTLEVERALRVLDGAICLFDSVAGVEPQSETVWRQADKYGVPRICFVNKMDRLGANFFRTRDMIVTNLGAKPLVIQLPVGAEDNFKGVIDLVKMKAVLWSGEELGAKFEYADIPADLQELAEEYRSQMIETIVELDDQAMENYLEGVEPDEETIKKLIRKGTIGISFVPVLCGSAFKNKGVQPLLDAVMDYLPSPLELLAMKGTDPENPEVIIERTASDEEPFSGLAFKIMTDPFVGSLTFVRVYSGKLAAGSYVLNANKGKKERIGRLLEMHANSREDVKVALAGDIVALAGLKDTITGETLSDPDHPIVLERMDFPDPVIKVAIEPKTKADVDKMANGLIKLAQEDPSFHFSRDEEINQTVIEGMGELHLEIIVDRLKREFKVEANVGAPQVNYRESISKVSEVKYVHKKQSGGQGQFADITVRFEPMEAGSGYEFKSEIKGGAVPKEYIPGVMKGLEECMCNGVLAGFPVVDVRAVLVDGSYHDVDSSVLAFQLAARGAFREGIRKAGPRMLEPIMKVEVVTPEEHLGDVIGDLNSRRGQINSFGDKPGGLKVVDALVPLAEMFQYVSTLRGMTKGRASYTMQLAKFDVVPQHIQNELATKQQEVVA

SEQ ID NO: 736 - protein, 196 aa, Gossypium hirsutum
MAAKPLTSEAIALTEKKMDMTLDDIIRMSKTSSNKTKKQQRVLNKGQKPFNNAAKAKALKVQQYMDSRSSVRQGFLAQRRSNIPGNQFPLAAEAARRAAVAPVRIKNVNGVRVANLNKPRTGVPPVQRRAKNGGFAAKPRQHQPQQQQGGNVVTKQRPHTLDSLFANMKKERMNGPAQRNGSSRQRMPWRRGRFGN

SEQ ID NO: 737 - protein, 366 aa, Zea mays
MVAIENQNQSQAAVAVAAEAVPAPASRIPREARRLLHELAAAWADVADCRALEVVPLKGAMTNEVYQARWLTAGPAGQEEEPRAEREVRKVLVRIYGDGVDLFFDREDEVRTFECMSRHGQGPRLLGRFPNGRVEEFIHARTLSAADLRDPEISALVASKLREFHNLDMPGPKSVLIWDRLRNWLRTAKSLCPPEEAKEFRLDSLENQITALENECSGDYQWIGFCHNDLQYGNIMIDEETNVLTIIDYEYASFNPVAYDIANHFCEMAADYHSSKPHILDYSRYPDVDEQKRFVKTYLNISGEEPDAEVVENLLQSIEKHTLASHLVWGLWGIISDHVNDIDFDYKEYARQRFEQYWHKSAILTS

SEQ ID NO: 738 - protein, 421 aa, Zea mays
MAVDPRQVVAGFLTLSMFVMLGNMIKHDHFSPVTEELGLEATGVVSNTRKLDSNAEMSSVDTAGVEDLMDAVEEVKPCWTKPSPKNQPSNGFVTFSLTMGPEYHISQITDAVVIARYLGATLVLPDIRGNELGNKRKFQDMYNVDKFVRSLDSVVEVIEDIPDEVSAKKPAVIRVPNRVTESFITGTIQPIFQKNKYLRLAVIFSSISLRPKETNNKDMDTTACLAMFGGLELKHEYSEVARKMLDRLQELSKKSDGKVLAIDLRTDLLEQKSCKTTRGARRKGCYSPDEVLAFLRSVGFSANTTIYLTETSWHKGLDVLKEEFPNTWYKGDIMPAENKAEFLKSSNADLARALDLEICSQSDVFVPAVAGLFYGHVTGKRIASGRTQILVPSQSSTSTHASDFISTYISNKNHLAYACYC

SEQ ID NO: 739 - protein, 506 aa, Medicago truncatula
MNKSMSPLILLPFALLLFFLFKKHKTSKKSTTLPPGPKGLPFIGNLHQLDSSVLGLNFYELSKKYGPIISLKLGSKQTVVVSSAKMAKEVMKTHDIEFCNRPALISHMKISYNGLDQIFAPYREYWRHTKKLSFIHFLSVKRVSMFYSVRKDEVTRMIKKISENASSNKVMNMQDLLTCLTSTLVCKTAFGRRYEGEGIERSMFQGLHKEVQDLLISFFYADYLPFVGGIVDKLTGKTSRLEKTFKVSDELYQSIVDEHLDPERKKLPPHEDDVIDALIELKNDPYCSMDLTAEHIKPLIMNMSFAVTETIAAAVVWAMTALMKNPRAMQKVQEEIRKVCAGKGFIEEEDVEKLPYFKAVIKESMRLYPILPILLPRETMTNCNIAGYDIPDKTLVYVNALAIHRDPEVWKDPEEFYPERFIGSDIDLKGQDFELIPFGSGRRICPGLNMAIATIDLVLSNLLYSFDWEMPEGAKREDIDTHGQAGLIQHKKNPLCLVAKKRIECV

SEQ ID NO: 740 - protein, 355 aa, Medicago truncatula
MSSEGVGEDCLAWAARDASGVLSPYKFNRRELGSEDVYVKITHCGVCYADVIWAKNKHGDSKYPVVPGHEIAGVVAKVGPNVQRFKVGDHVGVGTYINSCRECEYCNDRLEVHCVKGSVYTFNGVDYDGTITKGGYSTSIVVHERYCFLIPKSYPLASAGPLLCAGITVYSPMIRHNMNQPGKSLGVVGLGGLGHMAVKFGKAFGLRVTVFSTSMSKKEEALSLLGADQFVVSSNQEEMRALAKSLDFIIDTASGDHLFDPYMSLLKISGVLVLVGFPSEVKFSPASLNLGSRTVAGSVAGGTKEIQEMVNFCAANGIHPDIELIPIGYSNEALERVVNKDVKYRFVIDIENSLK

SEQ ID NO: 741 - protein, 339 aa, Medicago truncatula
MADQNKKPEIFELNNGTMQLLVTNLGCTITSFSVPAKDGVLSDVVLGLDSVESYQKGLAPYFGCIVGRVANRIKNGKFTLDGVEYSLPLNKAPNTLHGGNVGFDKKVWDVLEYKKGETPSITFKYDSHDGEEGYPGDITVTATYTLTSSTTMRLDMEGVAKNKPTIINLAQHTYWNLAGHSSGNILDHSIKISANHVTPVDQNTVPTGEIVPVKGTPFDFTSEKRIGDTINQVGLGYDHNYVLDCGEEKAGLRHAAKVRDPSSSRVLNLWTNAPGVQFYTGNYVDNVTGKGGAVYGKHAGLCLETQGFPDAVNKPNFPSIVVKPGEKYQHSMLFEFSIE

SEQ ID NO: 742 - protein, 350 aa, Medicago truncatula
MATTQTELIPPPQVPLGTQGFQVSKLGFGCMGLTGAYNDPLPEQDGISVINYAFSKGITFFDTADIYGGSGANEILLGKALKQLPREKIQLATKFGISRRDFSRLADVTIKGSPEYVRSCCEASLKRLDVEYIDLYYQHRIDTSVSIEDTVGELKKLVEEGKVKYIGLSEASPDTIRRAHAVHPITAVQIEWSLWTRDIEEEIVPLCRELGIGIVPYSPLGRGFFGGKGVTENVPAVSSLTSHPRFQAENLNKNKNIYDKIESLGKKHGCTPAQLALAWVLQQGKDVVPIPGTTKIKNLDQNLGALAVKLSEEDLREISAAVPVDDIAGSRYYNGFDHISWKFANTPPKV

SEQ ID NO: 743 - protein, 531 aa, Medicago truncatula
MECVGARNLTAMAFCISPSLRLRRKKICWRRREASSNVIRLRSMKVYAKAGGAGSESCVVAKEDYADEEDFVKAGGSELVFVQMQQKKSMDLQSKLADKLPPISVGDGILDLVVIGCGPAGLALAAESGKLGLKVGLIGPDLPFTNNYGVWEDEFKGLGLEGCIEHVWKDTVVYIDNKNPISIGRSYGRVSRHLLHEELLRRCVESGVSYLGSKVERIVEASNGHNHVVCEYDTVVPCRLATVASGAASGKLLQYEVGGPKVCVQTAYGVEVEVENSPYDPNVMVFMDYRDYMKNNVQSLEAKYPTFLYAMPMSRSKVFFEETCLASKDAMPFDLLKKKLLSRLKTMGIKVTKTYEEEWSYIPVGGSLPNTEQKNLAFGAAASMVHPATGYSVVRSLSEAPQYASVIATILNDGNARDIVTYGRSKENPSMRAWNTLWPQERKRQRSFFLFGLALIVQLDIEGTRTFFRTFFCLPEWMWQGFLGSSLSSKDLLLFALYMFIIAPNNLRMSLVRHLLSDPTGSTMIKTYLTI

SEQ ID NO: 744 - protein, 377 aa, Medicago truncatula
MAATTATPAALRFLPPNPTTRKTFNFFSILKPNFNSLRSFSHSSLFSLSHKYPLSPCKCSFTAPVSTTTYEFSDNASEMELRLNIGSMDVRSAKDISVDANDTSLTIRVLQSGSPITLIDTNPLFDRIKPSETIWYIDDDHLVVNFKKNDPELKWPDIMESWESLAAGSSQLLKGTSIYLVGDSTEINQKVAEELATGLGYTPLSTKELLETYSNQTVDSWLLAEGSDSVAEGEGTVLESISSHVRAAVATLGGKHGAAGRSDKWRHLYAGFTVWLSQTEASDEDSAREETHRNVKDRITAYTNADVVVKLQGWDPAYAKSVAQGCLSALKQLILSDKKLPGKKSLYIRLGCRGDWPNIKPPGWDPSSEGGETLGTQ

SEQ ID NO: 745 - protein, 536 aa, Medicago truncatula
MAISDTPETTATATATVTTIETDTDLKRSSLRRRPSATSTAGGLFDAESAAADAVRDSGSDDSLNGKINNEEEVKDRKTDHAEGIVDDNAVKKNGGNDVINDRENVTVDFKFTYRPSVPAHRRSKESPLSSGNIFRQSHAGLFNLCIVVLVAVNSRLIIENLMKYGWLIRSGFWFSSKSLRDWPLFMCCLSLAIFPLAAFVVEKLAQQKRISEPVIILLHIVITTVAIIYPVLVILWCDSAFLSGSTLMLLTCIVWLKLVSYAHTTYDMRALAVSNEKGETMPDTFNMEEYPHNVSFQSLAYFMVAPTLCYQPSYPRTPSVRKGWVCRQLLKLVIFTGVMGFIIEQYMNPIVQNSQHPLKGNLLYAIERVLKLSVPNVYVWLCMFYCFFHLWLNILAELLRFGDREFYKDWWNAQTVEEYWRMWNMPVHKWMVRHVYFPCIRFGIPKGAAALTAFLVSAVFHELCIAVPCRMFKLWAFIGIMFQVPLVLITNYLKNKYRNSMVGNMIFWFIFCILGQPMCVLLYYHDLMNRKGEID

SEQ ID NO: 746 - protein, 148 aa, Medicago truncatula
MASIRIITFVSLMVLLMINTTEAQSTDIPSCATNLIPCADYLNSTKPPSSCCDPIKKTVETELTCLCNLFYAPGLLATFNINTTQALALSRNCGVTTDLTTCKHNGSAPAPTSGGSPPATTGGDKAAASRVSFTGFSFILLLASMIFN

SEQ ID NO: 747 - protein, 291 aa, Medicago truncatula
MKGEYVEQHSSNPNKGNETPPPSLLFSKPFHPFQLSHHECQPIGEDDNNNTSGGGATTQKPNTSGDGATIEVSRRPRGRPPGSKNKPKPPIIITRDPETVMSPFILDISGGNDVVEAISEFTRRKNIGLCVLTGSGTVANVTLRQPSTTPGTTVTFHGRFDILSITATFVPQQHGVSPAIPSNFSISLAGPQGQIVGGIVAGNLIAAGTVFVIASSFNNPSYHRLPLEEDEGGNSVSGGGGEGNSQNVSGAVDSGQVQGGGGESCGMSMYNCHLPSSDVIWAPSARPPPPY

SEQ ID NO: 748 - protein, 231 aa, Medicago truncatula
MQVIAKAKAEEKKIGLTETWLRKHRPIYDAATRHPFILSIRDGTVQSHSFKTWLAQDYLFVREFVPFVASVLIKACKESDDSDDVEVILGGMASLKDEILWFKREANKWGISLSDVVPQKANISYCRLLESLMSPDVDYTVTLTAFWAIEVVYQESFAHCIEEGSKTPPELKETCERWGNEGFGQYCQSLQKILNHRLQKASDDQLKKAEVMLLTIIEHEVHFWNMSRGNV

SEQ ID NO: 749 - protein, 814 aa, Medicago truncatula
MKVESRSHNVHHAHGEEEKVMTRKQKAESKAHEVEHSPKKAKVEDEKNGHTNGKSASDVVQEYDEFCKATNEQLSLDQMKEILEANGLDSSGSDLEITRSCQDLLFFGALEKCMVCNGNMEFDGRRYGCRGFYSEWSSCTFSTREPPRKDEPIKLPDSVQNSPVSDLLKKYQDPSKRPQRDLGLAIKPFTGMMISLMGRLNRTHQYWKKTIEKHGGKVANSIIGASCLVASPAERDRGGTSKLADAMERGIPVVREAWLTDSIEKQEPQPLESYDLVSDLSVDGKGIPWDKQDPGEEAIESLSAELKLYGKRGVYKDTKLHEQDGKIFEKDGILYNCAFSVCDQGRKLNDYCVMQLIVVPENSLHLYFKKGRVGDDPNAEERLEECENVDNAIKEFVRLFEEITGNEFESWERDKKFQKKPLKFYPIDMDDGVEVRHGALGLRQLGIAATHCKLEPMVANFMKVLCSQEIYKYALMEMGYDSPDLPIGMVTNLHLKRCEEILLEFIEKVKTLKETGPKADAIWSDFSQKWFTLMHSTRPFIFRDYQEIADHAAAALEGVRDITLASHLIGDMSGSTIDDPLSDTYKKLGCSITPLEKNSNDYEMIVKYLEKTYEPVKVGDIEYGVSVENIFSVESSACPSYEDIVKMPNKVLLWCGSRSSNLLRHLHKGFLPAICSLPVPGYMFGKAIVCSDAAAEAARYGFTAVDRPEGFLVLAIASLGNEITELKSPPEDTTSLEEKKVGVKGLGKKKTDESEHFVWKDDIKVPCGSIIASEHEDSPLEYNEYAVYDPKQVRISYLVGVKYEEKDAVIDTAE

SEQ ID NO: 750 - protein, 268 aa, Medicago truncatula
MATSLSTTTLLSYRRNPQHMYIQPCSVKNEVSRTMHASVSIDSLSINEESDKCSSLLVNRRAILASGVSLLGFPGVSLAVVKQGLLAGRIPGLSEPDEQGWRTYRRPDEKSGGHGVGWSPIIPYTFKVPQEWEEVPVSIADLGGTELDLRFSSSKEGRLFVIVAPVLRFSDIIGDDATIEKIGPPDKVISAFGPEMIGENVEGKVLSSNVAEHEGRTYYQFELEPPHIFITATAAGNRLYLFGVTGNGLQWKRHYNDLKKISDSFRVV

SEQ ID NO: 751 - protein, 276 aa, Medicago truncatula
MLRFITSSSVPKFFPTKPFHIISPFSSRLSVRSMADSAAPFSKIQIQRDDNTTFDAYVIGKHDAPGIVVLQEWWGVDFEIKNHAAMISQLGRGFKALIPDLYRGKVGLDVAEAQHLFDGLDWPGAVKDIHASVDWLKANGSKKAGVTGFCMGGALAIASSVLVPHVDAVVAFYGVPSSELADPAQAKAPVQAHFGELDNFVGFSDVTAAKALEEKLKASGIPHEVHIYPGNSHAFMNRSTEGINRRKNMGLPDEDEASVQLAWSRFQSWMTQYLSS

SEQ ID NO: 752 - protein, 384 aa, Medicago truncatula
MLGTTLQFGGVGGDDRFYIPVKTRKNQNQRKQAQRDKNVEEESITVASVEESVSNIDRFLDSTKLLVPAQYFSKTTMRGWKTCDVEYQSYFALNDLWESFKEWSAYGAGVPLLLDQRESVVQYYVPYLSAIQLYGQPTEKSSAKPRYISEDSDGDYYRDSCSEGSSDCESGKRTECFTAQRSSKHLTSGVSSQMSTLSIHDKHNTVQEGFSSSDDSETGNPQELLFQYLEQGHPYGREPLADKILDLARDYPALMSLRSCDLLPNSWMSVAWYPIYRIPTGPTLKDLDACFLTYHTLHTPLTGSGPTPGPVLVYPSEMDGVPNISIPTFAMAAYKLKGSIWMKKEVSENQVMNSLVQAADKWLRLVQVNHPDHQFFKSHGTYYK

SEQ ID NO: 753 - protein, 512 aa, Medicago truncatula
MAPANTSAAALSETEYEMVKNIIDIEVLEELSLADCSIYKVPHNLRKVKQEAYTPQLISIGPIHLGNEELQPMQQHKKRYFHFFYERLSQFNQQSMIKNYKLYLENKEQEIRKCYAEKFPDISKEKFVETILLDAVFIMELLLRNSSWKSDTSKHEHEYKQSKSFRWKHSDDYILTQAWLSKSITRDLILLENQIPFFVLKHLYDTVVPNDDKKPNHEDFLDLALEYFAFYDTQKSSSLETKFVLDKNQTKKYYYVSGVIGDVGSGNSVSKKKHSDKSMSSNHGFQGPKHFTDLIRFFYLPADLGKSGCSHIFPRTVTKLMDSGVSFEKVVGRRLLDITFEKKPFLSNFLCLGCLPSFSCLNHFKARLRIPQLKVDHTTECVLRNLIALEQCQYQEQPYICNYVSLVDSLIHTQVDVDLLVEKEVIVHEMGSDKEVAMLVNGLCKHVVVNSTCYYEIINELNKHYQNIWNRTMAALWLVYFRDAWRASSTLVGIAFLVYTAFNFVRLAKILF

SEQ ID NO: 754 - protein, 350 aa, Medicago truncatula
MSARQIIEVPQTPLLRSHHEGNGGGRRTSLAQLLGRATGRRGPSVLVRETAARELEERRADWGYSKPVVALDMSWNMAFVVVSAVMLAFTVDERPNMPIRVWIVGYALQCFVHVVLVWIEYHRRNRRDSRRRQRDSDAEFSSDGNDSDDSDGDVNSTQSRFTKRCESINTGVSFLWWMVGFYWVVSGDDILLQDAPRLYWLAVVFLAFDVFFAIFCVVLACLIGIALCCCLPCIIAILYAVAGQEGASEADLSILPKYRFRLSNNEEKDSGGAGSMVPIETTSAYLATERILLPEDAECCICLCPYEDGVELHTLPCNHHFHSSCIVKWLKMNATCPLCKYNILKGNEQV

SEQ ID NO: 755 - protein, 292 aa, Medicago truncatula
MEKAASSVLKQMNISSRLVLPGSCCCSSFQSSSSSSLHFPFSISVPFKFRSRRSTNSVFDAAFPVPLIKVVATDLSLAVKKKAADVSPELKGSSIFLIGMKSSLKTNLGKQLADVLRYYYFDSDNLVEEAIGGASAAKSFKESDETGFYESETEVLKQLSSMGRLVVCAGNGAVQNSTNLALLRHGITFWIDLPLEIVAMDVTENQTQFPSFEISTSGSYPKVMDELGALYNKYKDGYATADAIISLQKVASRLGYESLDDITTEDMALEVLGEIEKLTRVKKMMAEAARPF

SEQ ID NO: 756 - protein, 597 aa, Medicago truncatula
MFGLAAASSTTRVLCATLYSPSSSSSSFTTTHHFSSHHLPSTLVSLSSLRFRCIPIKAMSETDAPKSASSSHGNKQALISLSDKKDLAFVGNGLQELGFTIVSTGGTASALESAGVAVTKVEQLTHFPEMLDGRVKTLHPNIHGGILARRDQKHHMEALNTHGIGTFDVVIVNLYPFYDKVTSAGGIEFKDGIENIDIGGPAMIRAAAKNHKDVLVVVDSEDYPALLEFLKGNQDEKFRLKLAWKAFQHVASYDSAVAEWFWKQTGGDKFPPSLTVPLSLKSSLRYGENLHQNAAIYFDRRLAEVNAGGIATAIQHHGKEMSYNNNLDADAAWNCVCEFRNPTCVVVKHTNPCGVASRDDILEAYRRAVKADPVSAFGGIVAFNVEVDEVLAKEIREFRTPTDGETRMFYEIVVAPSYTEKGLEILRGKSKTLRILEAKKNEPGKLSLRQVGGGWLAQDSDDLTPSDIKFNVVSEKTPQDGELRNAEFAWLCVKHVKSNAIVIAKDNCMLGMGSGQPNRVESLRIAMRKAGAAIKGAALASDAFFPFAWKDAVEEACESGIGVIAEPGGSIRDQDAVDCCNKYGVSLLFTDVRHFRH

SEQ ID NO: 757 - protein, 308 aa, Sorghum bicolor
MECLTTSFARNVGKEHSFVCSSKLVSENQWVPRRICCYVSSSTNSSQWCKFTNMAYPMSPIIRKRSHWRSFAASLNLEDGPAPSDSTSSSSEQTTADADGTTNGDASEDLLSRKLSSDELKALLADSERSKLLRRLSEANQYNRFLKRQLQIKDDAVVKFKGELAVLELELQALVGLAEEIANFDVPLGSRRINGKYIQSHLLSRLEAVHDKIVEHIKDVDSLKTKEISVYWVGMAENVQIMGSFDGWSQGEAMSMEYSGDYGRFSATLKLRPGRYEIKFLVDGEWRLSPEYPTAGDGMTQNNILIVE

SEQ ID NO: 758 - protein, 591 aa, Sorghum bicolor
MGRGGGSRAAPAAAAPPWHVLPDEVWEHAFSFLPADSDRGAAAAACRSWLRAERRSRRRLAVANCYAASPQDAVDRFPAVRAVEVKGKPHFADFGLVPPAWGAAAAPWVAAAADGWPLLEEISFKRMVVTDDCLEMIAASFRNFQVLRLVSCEGFSTAGLAAIAAGCRNLRELDLQENEIEDCSIHWLSLFPESFTSLVTLNFSCLEGDVNITVLERLVTRCCNLKTLKLNNAIPLDKLANLLRKAPQIVELGTGRFSADYHPDLFSKLEAAFAGCKSLRRLSGAWDAVPEYLPAFYCVCEGLTSLNLSYATVRGPELIKFISRCKNLQLLWVMDLIEDHGLAVVASSCNKLQELRVFPSAPFDAAEQVSLTERGLVDVSASCPMLESVLYFCRRMTNEALITIAKNRPNFTCFRLCIIEPHTPDYTTHQPLDAGFSAIVESCKGLRRLSVSGLLTDSLFKSIGAHADRLEMLSIAFAGNSDLGLHYILSGCKSLKKLEIRDCPFGDKPLLANAAKLETMRSLWMSTCSLTLGACRQLARKMPRLSVEVMNDPRRGCPLDSLTDESPVETLYVYRTIAGPRSDTPACVQIV

SEQ ID NO: 759 - protein, 411 aa, Glycine max
MVTMEESPRSPEAKLGLRVEDLWDIQEPQLSPDEKFNACFESIPVSAFPPPPSNQEIEIKSDATLAEAVKILAEHNILSAPVVDVDAPNDASWIDRYIGIVEFAGIVVWILHQSEPTSPRSPSGGAANTAAVNGITSEALGLESASTTSGNFFEDLTSSQLYKNTKVRDISGSFRWAPFLALERSNSFLTMLLLLSKYKMKSIPVVDLGAGRIDNIITQSSVIHMLAECAGLQWFESWGTKKLSEVGLPMVTPNHIIKVYEDEPVLQAFKLMRKKRIGGLPVMDRGSSTAIGNISLKDVQFLLTAPEIYHDYRSITAKDFLTAIRSYLEKHEGAFPMSGDLITCNKDCTIKELIQLLDHEKIHRVYVADNDGNLEGLITLRDIISRLVHEPRGYFGDFFDGVLPMPPNSRV

SEQ ID NO: 760 - protein, 195 aa, Glycine max
MAFTVAIGSGVAIIPCGNTTTAIPYTRGGGHRTRRKLHLHVARAKKPLNGDGVSIYTELLKTEVSVFENKPLGDNDAALKFVEKIDRQFQYPDFWEGSQWDWLGIFVKFSPIIGVAVAACLAIYGCFTFHEPPKEMREAAERLYSVQSGVESSAESGLESSADSSVESGKVIEEPDAYDSDVFDSNPTEVAPSLE

SEQ ID NO: 761 - protein, 196 aa, Glycine max
MAFTVASGSGVAIIPCGNTGTAALFPHRTRRNLHVARAKKPLNGDDVSVYAELLKAEVSVLENNKPLDDNDAALKFLEKIDRQFQQPDLWEGPQWDWLGIFIKFSPIIGIAVAASLTIYGCFTFHEPPKNVREAAERLYSVQSGVESNAESDDVESSAETDVESSAESSSEVFKEPDAYDSDVFDSNPTEVAPSLE

SEQ ID NO: 762 - protein, 507 aa, Glycine max
MMELFLSCMVLFVLTLATLGAHWIWVVSSSRAGSKLPPGPFPLPIIGNLLALGKKPHQSLAKLAETHGPIMTLKFGQVTTIVVSSADMAKEVLLTHDHSLSSNRVIPQAVQVHNHHNHSITFLPVSPLWRDLRKICIANLFSNKTLDASQDLRRSKLHQLLHDIHRSSLAGEAVDVGKAVFNTSMNLLSNTFFSLDLVHSSSSAAAVDFKDLVLKIMEESGKPNLADFFPVLKFMDPQGIKTRTTVYAGKIIDTFRALIHQRLKLRENNHGHDTNNDMLNTLLNCQEMDQTKIEHLALTLFVAGTDTITSTVEWAMAELLQNEKAMSKAKQELEETIGRGKAVEESDIGRLPYLQAVIKETFRLHPAVPFLIPRKANADVEISGGYTIPKDAQVFVNVWAIGRNSSIWKNNANVFSPERFLMDSEDIDVKGHSFELTPFGAGRRICLGLPLAMRMLYLVLGSLINCFNWKLVEDDDVMNMEDSFGITLAKAQPVILIPEKVHGVIVS

SEQ ID NO: 763 - protein, 375 aa, Glycine max
MSKTSEIITCKAAICWGIGKPVTVEEIQVDPPKATEVRVKMLCASICSTDISSTKGFPHTNFPIALGHEGVGIIESVGDQVTNLKEGDVVIPTYIGECQECENCVSEKTNLCMTYPVRWTGLMPDNTSRMSIRGERIYHIFSCATWSEYMVSDANYVLKVDPTIDRAHASFISCGFSTGFGAAWKEAKVESGSTVAVFGLGAVGLGAVIGSKMQGASRIIGIDTNENKRAKGEAFGITDFINPGDSNKSASELVKELSGGMGVDYSFECTGVSTLLSESLEATKIGTGKAIVIGVGIEITLPLGLFAILLGRTLKGSVFGGLRAISDLSILADKGHKKEFPLQELFTHEVTLADINKAFELLKQPNCVKVVINMP

SEQ ID NO: 764 - protein, 459 aa, Glycine max
MVTIHCSHLVVPSEPTPSSTLSLSLCDQIKLPNHGSQLYLYSNTSITHHHLIHTLSASLSKALTHYYPFAGRLRRIPGGRFQLLCNASGAVLIEATCSSQFSFKYFRDFAPVHAVPKINYDDVPIEDVPLLVAQVTRFPNGFITLGLSLCRALLDGNSATSFVNSWAKLAKGENLDSSLIPLLDRTKLDSFKLNKPPRFEHPEFLPPPLLTQQHTQMEEQLGSTILELTKGQVEKLKKKASDFGSGYGINNGNGSVRPYTSFEVITGHLWRCVCKVRYAGGDLGQPTRLTTLVNCRNRLRPSLPTAYFGNATFPTVTPTCSFDEIMHKPLSYAVGKVREAIGKMSDEYVRSALDYIASVEDFDLFRDTFYGSGDGKGKFKGDPNLYMVGWTNFKYFETDFGWGKPVSLIPGNINSNGKAFLLDNASGDGFIVAVCLLESHVDALRKLFYEDMEDASSKL

SEQ ID NO: 765 - protein, 424 aa, Glycine max
MHLKLSPLKPQILKDITGLTETERMKRNSVYPSALNCDDILHEILLRIPPPTISKLIIVSKIWLRVICSPSFRQCYLRQWGQSFRLLGFFVCNFLYLGRPRDGYRRPRWEPALPILSTCKDGDDLKLSGILKHLGYFIDSSKGIILSGFHPKTYYVYNTVTKQKYELPEPQQFYKVLCMALIVEEYLDSDICYKVIRARCECKLKERNTVSIETYSSKTRQWKQSTLMCSTTFALCPRTAAMVVGGVVHWFAMWGKLAIYDPRLGDRYIALIKLPTGVLTHEHEESVLGESSDGLLQYGQSNNLGLEIWILEKESGANSSIYCNCTHLKYKWILRWRLNFKVLWKQMPSLSTHSKETQILSFLPQNSTSIFIRSGWNILLCDLETKTVEIVNYQGRGGTISWESSKVVPYFLPAWPHTSSVSVS

SEQ ID NO: 766 - protein, 710 aa, Solanum lycopersicum
MGKLGKKARKFAKKNLPSVLRDRRKKKALFKKRYSSKNVQSNVEDQAKVIDHSNERNTEVEAFEDLPLEAPFMENDCDGVVDSSDSDGYLSEDISYENGTESEPEKLLEGDKCTSELMMQNIKIQENLAVQKRKLERLKRKDPSFSKFLEKHKDIEAMQNGVVFSDEDEMSNHGRDSATEDNQGKDEGRVLTVSAISSWCRLIKEEHKEEVFVCLLNAYRAACHYGAESIGLRFQNAETFCSLVMSVLSEADNILRGLLGLSSFSYKKEAVLELKDTPQWVNVKPLIKSYLRSTLSLLDQVTDSEILAFALTRLRDSLPFFDAFPYLLQRLIKTTIHLWATGGGMLSSSSFSILLDVASLFTTDWFDNCLAKAFVAYLAQSRATDIVNNKHLQFLRNSLVDLCSLDVQKSLSKATVSVRQLAKVLQWGLRTKKKEALQRICSWEYANCINLWVGFIARNVRDYDLQAFFFTMVQLINGVVRLFPGPRYFPLRLNCIQWLNDLSNSTGVFIPIASFVLDVLEYKTVGERGKPGPALFFQSVLKLPKSCLKSQTFQDECITSAIEQLSSHFLQWSYHISFPDLATVPLIRLKKFNESKTKESQCRVVKHLIEQVEKNVDSVQKKRNEVAFSPNDHQSVETFLQFEKSSLSSPFTQYCRSVLDKADLRGSHKNEKISLPTRDKSKRKRDDSSINVFGHKDVDTVNGSKKRVKR

SEQ ID NO: 767 - protein, 941 aa, Solanum lycopersicum
MSGKSRNFRRRGGDDGDDDETATKSTNGTAAKPTTTASASAAKPKKKSLLSFADDEESDDTPFVRPSSKPSSASSRITKPSSSSSAHKLTSGKDRITPKPTSFTSNVQPQAGTYTKEALLELQKNTRTLVGSRSSQPKPEPRPGPVEPVIVLKGLVKPPFSVSAQTQQNGKESEDDEMDVDQFGGTVNRLGSMALEKDSRKKDDVGSVIPDKMTIDAIRAKRERLRQARPAAQDFIALDEGGNHGEAEGLSDEEPEFQQRIGFYGEKIGSGRKGVFEDFDDKALQKDGGFRSDDDEEDEEDKMWEEEQVRKGLGKRLDDGSNRGVMSSVVSSAAAVQNAQKANFGSSAVGASVYSSVQSIDVSDGPTIRGGVVGGLPSLDALSISKKAEVAKKALYESMGRLKESHGRTVTSLHKTEENLSASLSKVTTLENSLSAAGEKYMFMQKLRDFVSVICALLQDKGPYIEELEDQMQKLYEERAAAILERRAADNDDEMKELEAAVSAARQVLSRGGSNAATIEAATAAAQTSTAAMRKGGDLPVELDEFGRDKNLQKRMDTTRRAEARKRRRMKNDVKRMSAIKCDSSYQKIEGESSTDESDSESTAYQSNRDQLLQVSEQIFGDAHEEYSQLSVVVEKFDRWKKDYASSYRDAYMSLSIPVIFSPYVRLELLKWDPLHENTDFMDMNWHNSLFSYGISPEGETEISADDTDVNLIPQLVEKLAIPILHNQLANCWDMLSTSETVCAVSAMRLVLRYGPFSGSALSNLIAVLRDRLADAVANLKVPTWDTLVMRAVPDAARVAAYRFGMSIRLIRNICLFHEIFAMPVLEELVLDQLLSGKIVPHLRSIQSNIHDAVTRTERVVTSLHGVWAGPKATGDCSPKLRPLVDYLLSLARVLEKKHSSSSGEIETSKFARRLKKMLVELNQYDYARDISRTFNIKEAL

SEQ ID NO: 768 - protein, 583 aa, Solanum lycopersicum
MEDKSIPFESSHSVSNNDNNHGWQKVTYVKKQKKKQQKISDSGKVIANGSAISGADNVYKSLEKHSDERRKRIAAQTAAMYGVGDAPVRSAMKHRSDDEDEDNYAEGGAENGAVGEKKKEKVKKPKKPKVTVAEAAAKIDAADLDAFLADITVSYESQQEIQLMRFADYFGRSFAAVAGSQFPWLKLFRESAISKIADVPVSHLPEPVYKTSVDWINQRSFEALGSFVLWGLDSILVDLTAQLAGSKGSKKGGQQTSSKSQVAMFLVLAMVLRRKPDVLITVLPTLRESPKYQGQDKLIVIAWMIVQACQGDLCVGLYLWAHHTLPLVGGKSGSNPQTRDLILQVVERILSAPKARTILVNGAVRKGERLMSPSSLDLLLRVTFPAPSARVKATERFEAVYPTLKEVALAGSPGSKAMKQVSQQILLLAVKAVGGGNPELSREATNIFNWCLTQSADCYKQWDKIYLDNIEASAAVLRKLNEEWKELSRRQSSTEALKETLKSFREKNEKSLTGGADAHQSHFRDADKYCKMLLARLSRGHGCVKGFVVVLLAMAVGGAIVSQNLEDWDWNKFSALLDIPQTS

SEQ ID NO: 769 - protein, 422 aa, Brassica juncea
MFGRGPSKKSDNTKFYEILGVPKSASPEDLKKAYKKAAIKNHPDKGGDPEKFKELAQAYEVLSDPEKREIYDQYGEDALKEGMGGGGGGGHDPFDIFSSFFGGSPFGGGGSSRGRRQRRGEDVVHPLKVSLEDLYLGTTKKLSLSRNALCSKCNGKGSKSGASLKCGGCQGTGMKVTMRQLGPGMIQQMQHACNECKGTGETINDRDRCPQCKGDKVIPEKKVLEVNVEKGMQHSQKITFEGQADEAPDTVTGDIVFVIQQKEHPKFKRKGEDLFVEHTLSLTEALCGFSFVLTHLDGRNLLIKSNPGEVVKPDSYKAISDEGMPIYQRPFMKGKLYIHFTVEFPDSLSPDQTKALEAVLPKPSTTQLSDMEIDECEETTLHDVNIEDEMRRKAQAQREAYDDEDDDDDHPGGAQRVQCAQQ

SEQ ID NO: 770 - protein, 365 aa, Brassica juncea
MRRWICCGGHRSGDSDISNDEKHLKTQWQQPDANNKQPRPQAVAKTEAPKEALPIEVPLLSVEEVEEKTDNFGSKSLIGEGSYGRVYYATLSDGKAVALKKLDVAPEAETNTEFLSQVSMVSRLKHENFIQLAGYCVDENLRVLAYEFATMGSLHDVLHGRKGVQGAQPGPTLDWITRVKIAVEAARGLEYLHEKVQPPVIHRDVRSSNVLLFEDYHAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKPPAPAPVPES

SEQ ID NO: 771 - protein, 106 aa, Gossypium hirsutum
MAKLVAAFFLALIAISMLQVMVLASHGHGGHHYDQKHYGPGSLKSYQCPSQCSRRCSKTQYHKPCMFFCQKCCNKCLCVPPGYYGNKAVCPCYNNWKTKEGGPKCP

SEQ ID NO: 772 - protein, 314 aa, Medicago truncatula
MATLIAPINHSPVADAEALHGAFKGWGTDEKSVITILGHRNVYQRQQIRKSYQEIYQEDILKRLESELSGDFERAVYRWMLEPADRDAVLANVAIKDGSKSYHVIIEIVSVLSPEEVLAMRRAYHNRYKHSLEEDLAAHTTGHLRQLLVGLMTSFRYGGAEINPKLAKTEADILHESIKEKKGNHEEAIRILTTRSKTQLLATFNRYRDDHGISITKKLLDNASDDFHKALHTTIRCINDHKKYYEKILRGALKRVGTDEDGLTRVVVTRAEKDLKDIKELYYKRNSVHLEDAVAKEISGDYKKFILTLLGKQD

SEQ ID NO: 773 - protein, 289 aa, Glycine max
MGEKDDEFGLSLSLSLGGVNQQQQPPSLNHMHQPQQQQPVPMNHNKTLFGDLFQLPDRSSDMVRGIDVNSAAEYDGVSSPNSAVSSVSGGGKQSERDDDNAAAVAGERTSCSRGSDDDDGGGSDSARKKLRLTKEQSMVLEETFKEHNTLNPKRKQALAEELNLKPRQVEVWFQNRRARTKLKQTEVDCEYLKKCCENLTEENRRLHKEVQELRALKLSPQMYMHMNPPTTLTMCPSCERTHSSASSSPATIHSTVAAATSSNCKLLGANIRRPVPVNTWPFEGPIPRP

SEQ ID NO: 774 - protein, 118 aa, Glycine max
MGLKNNMVVLKVCLVLLFLVGGTTSANLRLSKLGLLMKSDHHQHSNDDESSKPCCDQCACTKSNPPQCRCSDMRLNSCHSACKSCICALSYPAQCFCVDITDFCYEPCKPSQDDKENY

SEQ ID NO: 775 - DNA, 3712 bp, Arabidopsis lyrata
atggtttcttctgtccctaaactccatgctttgtttgtcgccaagtctctaccagtagttatccgagccgccaaaattaccaatgaagaaggttctgcgtcgaccaaatcaaaactcgccaggtccttggcgcgtgccgtgaactctaacccgtggtcggacgaactcgagtcttcactctcatctcttcacccgtctgaacctctctccagaaccaccgttctccaaaccctgcgtctcatcaaggtccctgccgatggtctccggttcttcgactgggtttacaacaagggtttctctcacaaagagcagtctttcttcctcatgttagagttcctaggtcgagctcgcaatctcaatgcggctcgcaatttcttgttctccatcgagaaaaggtctaacggctgcgtcaagctccaggatcgctacttcaacagcttgattaggagctacggcaacgctgggctcttccaggagtcagtgaacctgttccagaccatgaagaagatgggcatctcgccttccgtgcttaccttcaacagtcttctctcgattttgcttaagcgtggccgaactggaatggcccatgacatgttcgacgaaatgcgccgtacctacggggttaccccagattcctatactttcaatacattgataagtgggttttgcaagaactccatggtcgaccaagcctttacgatttttaaagaaatggagctttatagttgcaatcctgacgttgttacatataacacgatcatcgatgggttatgcagagctggcaaggtcaagattgcacacaatcttttgaatggaatgttgaagaaagcaacggctgtgcatcccaacattgttagttacactactctgctgcgaggctattgtatgaagcaggaaattgatgaagcactgcttgtgtttcatgaaatgctgaccagagggctaaaacccaatgctgtaacttacaatactctgatcaaggggctctcggaggctcatagatatgatgagatcaaaggatttttgattggaggggacgcatttaccactttctctccagatgcctgcacttttaatattttgatcaaagcccactgcgatgctggacatctggatgcagcaatgaaggtgttccaagaaatgctgaatatgaagttgcatcctgattcagcttcttatagtgttttgattcgtactctgtgcctgagaaatgaatttgataaagccgagacattattcaatgagttgtttgagaaggaagtattgttaggtaagaatgaatgcaagcctcttgctgcagcttataacctaatgttcgaatacttatgtgccaatgggaaagcaaaacaagcggagaaagtttttaggcagctgatgaaaagaggagcgcaagatccatcctcttacaggactttgatcacgggtctctgcagagaaggtaaattcaaggctgcttatgagctgttggttctaatgctgaggcgggaatttgttcctgatcctgaaacctacgaggtattgattgatgggctattgaagataggtgaagctcttcttgctcatgataccctacaaaggatgctaaggagctcttatcttccggttgcaaccactttccattctgtacttgcagaacttgtgaaaaggaaatttgctaacgactctttcggcttgctaacggtaatgttggaaaaacgaataagacagaacattgatctttcaacgcaggctgtcagattggtttttagtagtgcacagaaagaaaaggcatttctgattgttaggttgctttatgataacgggtatttgattaagatggaggaattacttgatttcctctgcgagaatcgaaaactgcttgatgcacacacacttgttctgttttgtctggaaaagagtcaaatggtagatatcgacacgtgtaacacgatcatagaaggactctgtaagcataagagacactctgaagcgtttagtttgtacaatgaattagtagaactaggaaatcaccaacagcttagctgccacgtggttttgacaaatgccttagaggctgctggaaagtgggaagaacttcagtttgtgtcaaagaggatggctacaatgagaaaatcagataattgcgctgtatcagaatgaaggttagaccgtgcatctggtttctggtctctatggacgttgcaactctctgttcataactttcaccttcatggtacctattaattaccaaagtagattaggcttgtattacttatcccgggaaaataggtttcatggtgttttttgcatttctaaccaacacaggccaaagaatcaccaaaccctaataaaataaccagttctctctttccatgaccctcactcatcagcaccaaactctccccaagaaaaccctcaacccttcctttataatcctttgcttttgctaatattctgcatccaccatctttcttcccaatatcttattgagttttttccttctgcgcttgaaaaaagatgtcgaattctagaatgaatggtgttgagaagctaagcagcatatccacaaggcgtgtcgcaaatcccggaaaggcaacactgcttgctcttggcaaagccttcccaagccaagtcgttcctcaggagaatctagtggaaggatttctacgagacaccaaatgtgaggacgcgtttatcaaagaaaagctggaacacttgtgcaaaaccacaaccgtgaagacgcgctacacggtattgtcacgagagatactggataaataccctgagctaacaacagagggttcaccaacaatcaagcaaagacttgaaattgcaaacgaggcggttgtggaaatggcattggaagccagtttaggctgcatcaaggaatggggaaggccagtggaagacatcactcacattgtctacgtttcctcaagcgagatacgattacccggtggtgacctttacctctcagcaaagctaggcctgaggaatgacgtgaacagagtgatgctgtattttctgggatgctacggaggtgtgactggcctccgtgtggccaaagacattgctgagaacaacccgggaagccgtgttctgctcacaacctctgaaaccaccattctcgggtttcgcccaccaaacaaagctcgtccgtacgacctagttggagctgctctgtttggagatggtgcagctgctgtgatcatcggagctgatccgagagagtgtgaagctcctttcatggagctgcactatgcggttcagcagttcttgccggggacacagaacgtgatcgacgggaggttgacggaggaaggcataaacttcaagcttggacgagacctcccgcagaagatagaggagaacatagaagagttctgcaagaagctgatgggaaaggctggtggtgatgagtcgatggagttcaatgacatgttctgggcagttcatccaggaggacctgcgattctgaaccgtctggagacaaaactaaagctggagaaagagaagctggagagcagcagaagggcgttggtggattacgggaacgtgagcagcaacacgatactgtatgtgatggagtatatgagagaggagctgaagaagaaaggcgatgaagcacaagagtggggacttggcttagctttcggacctggaatcaccttcgaaggccttctcatccgcagcctcacctctccctaattgtcataatttacatttgggttat

SEQ ID NO: 776 - DNA, 1387 bp, Eutrema halophilum
attctgcatccaccgcctttgttctcaacaatcaagtgagttttcttccatttgcacctgcaaaaagagatgtcgaatcctgggatgaaaggtgttgagaagcagagcagtattttcacacggcgtgtggcaaatcccgggaaggcaacggttcttgctcttgggaaagccttcccaagccaagtggttcctcaggagaatctcgtggagggatttctacgcgacaccaaatgtgatgacgcctttatcaaagagaagctggaacacttgtgcaaaaccacaaccgtgaagacgcgttacacggtgttgtcgcgagagatactggataaataccctgagctaacaacagaggggtcaccaacaatcaagcaaagacttgaaattgcaaacgaggcggttgtggaaatggcattggaagccagtttgggttgcatcaaggaatggggaaggccagcgggagacatcactcacattgtctatgtttcctcaagcgagatccgattacccggtggtgacctttacctctccgcaaagctagggctgaggaatgacgtgaacagagtgatgctgtattttctgggatgctacgggggcgtgacaggcctccgcgtggcgaaagacattgcggagaacaacccgggaagccgagttctgctgacaacctctgaaaccaccattctcgggttccggccaccaaacaaagctcgtccttacgacttggttggggctgctctgtttggagatggtgcagctgcagtgatcatcggagcagacccgagagagagcgaggctcctttcatggagctgcactatgctgttcagcagttcttgccggggacacagaacgtgattgacgggaggttgtcggaggaaggcataaacttcaagctaggacgagacctcccgcagaagatagaagagaacatagaagagttctgcaagaagctgatgggaaaggccggcgatgaatccatggagtttaacgacatgttctgggcagttcatccaggaggacctgcgattctgaaccgcctggagacaaaactgaagctggagggagagaagctggagagcagcagaagggcgttgagggactacgggaacgtgagcagcaacacaatactgtatgtgatggagtatgtgagagatgagctaaagaagaaaggcgagtccgcacaagagtggggacttggcttagctttcggacctggaatcaccttcgaaggccttctcatccgcagcctcacatccctctgatttcaatcaatttgtcacaagacaaaagtagaaaatatacaaaataatattatttataaacttatttcatgtaagcctttaacataaattcagttggttaatatattatatatagcatgaaatgagcatt

SEQ ID NO: 777 - DNA, 1389 bp, Eutrema parvulum
attctgcatccaccacctttcttctcaacaaatcaactgagtttgcttccatttgcacctgcaaaaagagatgtcgaataccgggatgaatggtgttgagaagcaaagaagcacaaggcgtgtagcaagtcccgggaaggcaacagtgcttgctctcggcaaggccttcccaagccaagtggttccccaggagaatgttgtggagggatttctacgcgacaccaaatgtgatgacgcctttatcaaagagaagctggaacacttgtgcaaaaccacaaccgtgaagacgcgctacacggtgttgtcacgagagatactggataaatacccggagctaacaacagagggctcgccaacaatcaagcaaaggcttgaaattgcaaacgaggcggttgtggaaatggcactggaagccagtttgggctgcatcaaggaatggggaaggccagtggaagacatcactcacgttgtatatgtttcctcaagcgagattcgattacccggtggtgacctttacctctctgcgaagctaggcctgagaaatgacgtgaacagagtgatgctgtattttctgggatgctatggaggtgtgacagggctccgcgtggccaaagacattgctgagaacaacccgggaagtcgtgttctgctcacaacctctgaaacaaccattctggggttcaggccaccaaacaaagctcgtccttacgacttggtcggggctgctctgtttggggatggtgcagctgcagtgatcgtaggagcagacccgagagagtgcgaagctcctttcatggagctgcaatacgctgttcagcagttcttgccggggacacagaacgtgatcgacgggaggttgtcggaggaaggcataaacttcaagctaggacgagacctcccgcagaagatagaagagaacatagaagagttctgcaagaagctgatgggaaaggctggtgatgattccatggagttcaatgacatgttctgggctgtgcatccaggaggacctgcgattctgaaccgcctggagacaaaactcaagctcgagagagagaagctagagagcagcagaagggcgttgatggattacgggaacgtgagcagcaacaccatactgtatgtgatggagtatgtgagagatgagctgaagaagaaaggtgacgccgcaccagagtggggacttggcctagctttcggacctggaatcaccttcgaaggccttctcatccgcagcctcacctctccttaattccaaatttgtcaccttcaaaaaaaaaacaagagagagagagagagatgaatatgctaaacaaagttattgtaagcccatataattcacagtttgttgaatttgattaatagcagcttgaaaatgagcattgttaa

SEQ ID NO: 778 - DNA, 1349 bp, Brassica rapa
attttattacctgaaagagagagagagatgtctagctctggtatgaatggtgttaagaagcaaatcagcacaaggcgtgtggcaaatccaggaaaggcaacagtgcttgctcttggcaaggccttcccaagccaagtggttcctcaggagcatctagtggagggctttctacgtgacaccaaatgtgatgacccctttatcaaagagaagctagaacacttgtgcaaaaccacaactgtgaagacccgctacacggtgttatcccgagagatactagataagtaccctgagctaacaacagaaggctcaccaacaatcaagcaaaggctagagatagcgaacgaggcggttgtggaaatggcacttgaagcaagcttgggctgcatcaaggaatggggaaggacagtggaagacatcactcacatcgtctacgtttcctcaagcgagatccgcttacctggcggcgacctttacctctcagccaagctaggcctaaagagcgacgtgaacagagtaatgctttattttctaggctgctacggaggcgtaacaggcctccgtgtggccaaagacatcgctgagaacaaccccggaagccgtgttctcctcacaacctctgaaaccaccatcctcgggttccgaccaccgaacaaagctcgcccttacgacctggtcggggcagctttgttcggggacggtgcagctgctgtgatcataggagcggaccctttaccctctgaagctcctttcatggagcttcactacgctgttcagcagtttgtgcctgggacacagaccgtgatcgacgggagattgacggaggaagggattaacttcaagctgggacgagatctccctcagaagatagaagagaacattgaggagttttgcaagaagctgatggggaaagctggtgatgattctatggagtttaatgacatgttttggaccgttcatccgggaggacctgcgattctgaaccgtcttgagacgaaactgaagctggggagagagaagctggagtgcagcagaagggcgttggtggattatgggaacgtgagtagtaacactatattgtatgtgatggagtatatgagagatgagttgaagaagaaaggtgatggtgcgcaagagtggggtcttggcttagcttttggacctggaatcacctttgaaggtcttctcctccgtagcctcgcatctacctgatttcgaatctacctccttgcagaaaataaaagaatatatattataaaatattgtaatcaaacttattataagaccatataatcaatccatagtttgttgaatttgatttaacagcagcatgaaatgagcattggtaagag

SEQ ID NO: 779 - DNA, 1359 bp, Brassica napus
ctcaacaatcaactgattttattacctgaaagagagatgtctagctctggaatgaatggtgttaagaagcaaatcaccacaaggcgtgtggcaaatccaggaaaggcaacagtgcttgctcttggcaaggccttcccaagccaagtggttcctcaggagcatctagtggaggggtttctacgtgacaccaaatgtgatgacccctttatcaaagagaagctagaacacttgtgcaaaaccacaacggtgaagacacgctacacggtgttatcccgagagatactagataagtaccctgagctaacaacagaaggctcaccaacaatcaagcaaaggctagagatcgccaacgaggcggtcgtggaaatggcacttgaagcaagtttgggttgcatcaaggaatggggaagaccagtggaagacatcactcacatcgtctacgtttcctcaagtgagatccgcttacccggcggtgacctttacctctccgccaagctaggcttaaagaacgacgtgaacagagtgatgctttattttctaggctgctacggaggcgtaacaggcctccgtgtcgccaaagacatagccgagaacaaccccggaagccgtgtgctcctcacaacctctgaaaccaccatcctcgggttccgaccaccgaacaaagctcgcccttacgacctggtcggggcagctttgttcggggacggtgcggctgcggtgatcataggagcagaccctttaccctccgaatctcctttcatggagcttcactacgctgttcagcagtttgtgcctgggacacagaccgtgatcgacgggagattgacggaggaagggattaacttcaagctgggacgagacctaccgcagaagattgaagagaacatagaagagttctgtaagaagctgatgggaaaagctggtgatgattctatggagtttaatgacatgttttggaccgttcatccgggagggcctgcgattctgaaccgtcttgagacgaaactgaagctggggagagagaagctggagtgcagcagaagggcattggtagattatgggaacgtgagtagtaatactatattgtatgtgatggagtatatgagagatgagttgaagaagaaaggtgatggtgcgcaagagtggggtcttggcttagcttttggacctggaatcacctttgaaggtcttctcctccgtagcctcgcatctccctaatttcgaatctacctccttgcagaaaataaaataatatatattataaaatattgtaatcaaatttattataagcccatataatcaatccatagtttgttgaatttgatttaacagcagcatgaaatgagaattggtaagaga

SEQ ID NO: 780 - DNA, 1467 bp, Brassica napus
ctggacgcctgctgcaccgggccggaattacgggtccacagacgcgtccgctcaacaatctcctgattttattacctgaaagagagatgtctagctctggaatgaatggtgttaagaagcaaatcaccacaaggcgtgtggcaaatccaggaaaggcaacagtgcttgctcttggcaaggccttcccaagccaagtggttcctcaggagcatctagtggaggggtttctacgtgacaccaaatgtgatgacccctttatcaaagagaagctagaacacttgtgcaaaaccacaacggtgaagacacgctacacggtgttatcccgagagatactagataagtaccctgagctaacaacagaaggctcaccaacaatcaagcaaaggctagagatcgccaacgaggcggtcgtggaaatggcacttgaagcaagtttgggttgcatcaaggaatggggaagaccagtggaagacatcactcacatcgtctacgtttcctcaagtgagatccgcttacccggcggtgacctttacctctccgccaagctaggcttaaagaacgacgtgaacagagtgatgctttattttctaggctgctacggaggcgtaacaggcctccgtgtcgccaaagacatagccgagaacaaccccggaagccgtgtgctcctcacaacctctgaaaccaccatcctcgggttccgaccaccgaacaaagctcgcccttacgacctggtcggggcagctttgttcggggacggtgcggctgcggtgatcataggagcagaccctttaccctccgaatctcctttcatggagcttcactacgctgttcagcagtttgtgcctgggacacagaccgtgatcgacgggagattgacggaggaagggattaacttcaagctgggacgagacctaccgcagaagattgaagagaacatagaagagttctgtaagaagctgatgggaaaagctggtgatgattctatggagtttaatgacatgttttggaccgttcatccgggagggcctgcgattctgaaccgtcttgagacgaaactgaagctggggagagagaagctggagtgcagcagaagggcattggtagattatgggaacgtgagtagtaatactatattgtatgtgatggagtatatgagagatgagttgaagaagaaaggtgatggtgcgcaagagtggggtcttggcttagcttttggacctggaatcacctttgaaggtcttctcctccgtagcctcgcatctccctaatttcgaatctacctccttgcagaaaataaaataatatatattataaaatattgtaatcaaatttattataagcccatataatcaatccatagtttgttgaatttgatttaacagcagcatgaaatgagaattggtaagagagaaaaaaaaaaaaaaaaaaaaaaactcgagactagttcctcgtccgaatcctcagccc

SEQ ID NO: 781 - DNA, 1325 bp, Brassica napus
ctcaacaatcaactgattttattacctgaaagagagagagatgtctagctctggtatgaatggtgttaagaagcaaatcagcacaaggcgtgtggcaaatccaggaaaggcaacagtgcttgctcttggcaaggccttcccaagccaagtggttcctcaggagcatctagtggagggctttctacgtgacaccaaatgtgatgacccctttatcaaagagaagctagaacacttgtgcaaaaccacaactgtgaagacccgctacacggtgttatcccgagagatactagataagtaccctgagctaacaacagaaggctcaccaacaatcaagcaaaggctagagatagcgaacgaggcggttgtggaaatggcacttgaagcaagcttgggctgcatcaaggaatggggaaggacagtggaagacatcactcacatcgtctacgtttcctcaagcgagatccgcttacccggcggcgacctttacctctcagccaagctaggcctaaagagcgacgtgaacagagtaatgctttactttctaggctgctacggaggcgtaacaggcctccgtgtggccaaagacatcgctgagaacaaccccggaagccgtgttctcctcacaacctctgaaaccaccatcctcgggttccgaccaccgaacaaagctcgcccttacgacctggtcggggcagctttgttcggggacggtgcagctgctgtgatcataggagcggaccctttaccctccgaagctcctttcatggagcttcactacgctgttcagcagtttgtgcctgggacacagaccgtgatcgacgggagattgacggaggaagggattaacttcaagctgggacgagatctccctcagaagatagaagagaacatagaagagttttgcaagaagctgatgggaaaagctggggatgattctattgagtttaatgacatgttttggaccgttcatccgggaggacctgcgattctgaaccgtcttgagacgaagctgaagctggggagagagaagctggagtgcagcagaagggcgttggtggattatgggaacgtgagtagtaacactatattgtatgtgatggagtatatgagagatgagttgaagaagaaaggtgatggtgcgcaagagtggggtcttggcttagcttttggacctggaatcacctttgaaggtcttctcctccgtagcctcgcatctccctaatttcgaatctacctccttgcagaaaataaaagaatatctattataaaatattgtaatcaaagttattataagaccatataatcaatccatagtttgttgaatt

SEQ ID NO: 782 - DNA, 1209 bp, Brassica napus
aacagtgcttgctcttggcaaggccttcccaagccaagtggttcctcaggagcatctagtggagggctttctacgtgacaccaaatgtgatgacccctttatcaaagagaagctagaacacttgtgcaaaaccacaactgtgaagacccgctacacggtgttatcccgagagatactagataagtaccctgagctaacaacagaaggctcaccaacaatcaagcaaaggctagagatagcgaacgaggcggttgtggaaatggcacttgaagcaagcttgggctgcatcaaggaatggggaaggacagtggaagacatcactcacatcgtctacgtttcctcaagcgagatccgcttacccggcggcgacctttacctctcagccaagctaggcctaaagagcgacgtgaacagagtaatgctttactttctaggctgctacggaggcgtaacaggcctccgtgtggccaaagacatcgctgagaacaaccccggaagccgtgttctcctcacaacctctgaaaccaccatcctcgggttccgaccaccgaacaaagctcgcccttacgacctggtcggggcagctttgttcggggacggtgcagctgctgtgatcataggagcggaccctttaccctccgaagctcctttcatggagcttcactacgctgttcagcagtttgtgcctgggacacagaccgtgatcgacgggagattgacggaggaagggattaacttcaagctgggacgagatctccctcagaagatagaagagaacatagaagagttttgcaagaagctgatgggaaaagctggggatgattctattgagtttaatgacatgttttggaccgttcatccgggaggacctgcgattctgaaccgtcttgagacgaagctgaagctggggagagagaagctggagtgcagcagaagggcgttggtggattatgggaacgtgagtagtaacactatattgtatgtgatggagtatatgagagatgagttgaagaagaaaggtgatggtgcgcaagagtggggtcttggcttagcttttggacctggaatcacctttgaaggtcttctcctccgtagcctcgcatctccctaatttcgaatctacctccttgcagaaaataaaagaatatctattataaaatattgtaatcaaagttattataagaccatataatcaatccatagtttgtt

SEQ ID NO: 783 - DNA, 1216 bp, Raphanus sativus
  misc_feature (1120)..(1120): n is a, c, g, or t
  misc_feature (1131)..(1131): n is a, c, g, or t
  misc_feature (1136)..(1136): n is a, c, g, or t
  misc_feature (1139)..(1139): n is a, c, g, or t
  misc_feature (1161)..(1161): n is a, c, g, or t
  misc_feature (1179)..(1179): n is a, c, g, or t
  misc_feature (1209)..(1209): n is a, c, g, or t
ggatccaccagctttcttctcaacaaaccacctgaaagagagagagatatgtctaactccggaatgaatggtgttaagaaccaaatcaacacaaggcgtgtagcaaatccaggaaaggcaacagtgcttgctcttggcaaagccttcccaagccaagtggttccccaggagcatctcgtggagggctttctacgcgataccaaatgtgatgacgcttttatcaaagagaagctagagcacttgtgcaaaaccacaaccgtgaagacacgctacacggtcttgtctcgagagatactcgataaataccccgagctaacaaccgaaggctcaccaacaatcaagcaaaggctagaaatagcaaacgaagccgttgtggaaatggcactggaagcaagtttgtgctgcatcaaggaatggggaaggcaagtggaagacatcactcacattgtctacgtttcctcaagcgagatccgcttaccaggcggcgacctttacctctccgcgaagctaggcttaaaaaacgacgtgaacagagtgatgctttacttccttggatgctacggaggcgtaacaggcctccgtgtggccaaagacatcgccgagaacaaccccggaagccgtgtcctcctcacgacctccgaaaccaccatcctcgggttccgaccaccgaacaaatctcgtccttacgacctggtcgggctgctctgttcgggacgtgcggctgccgtgatcgtgggagcagacccttacatccgagtctcccttcatggagctgcactacgctgttcagcagttcttgccagggacgcagaagtcatcgacgggaggttgacggaggaaggcataaacttcaagctgggacgagacctcccgcagaagatagaagagaacatagaggagttctgcaagaagctgatggttaaagctggtgacgattctatggagtttaatgacatgttctggaccgttcatcccggaggacctgcgattttgaaccgtctggagacgaagctgaagctggggagagagaagctggagtgtagcagaagggcgttggtggactatgggaacgtgagtagcaacactatattgtatgtgatggagtatatgagagatgagntgaagaagaanggtgntgntgcacaagagtggggacttggnttagcttttggacctggnatcactttcgaaggccttctcattcgcagnctcacat

SEQ ID NO: 784 - DNA, 1512 bp, Unknown
  Sequence found in Organisms: Citrus clementina, Citrus sinensis
cgaaaacatgtacatttaacatttccatcataactgaacattcttgtcttccggccccgacttcaagatgtcacaaattaacggcagtggcagcgacgggcaccattctgcttcagctaggcggactcccactcccggaaaggcaactgttcttgctattggcaaggccttccctagtcagctcattcctcaggaatgcttggttgagggctaccttcgggacactaaatgtgaagatgagtccatcaaggagaaacttgaacgcctgtgtaaaaccactactgtgaagacaagatacaccgtcatgtccaaggcgatcctggacaaatatcctgaactgacaaccgagggctcagcaaccatcaaacaaagacttgaaatagcaaacccagcagtggtagagatggccttggaagcaagccttgcttgcattaaggaatgggggaggcctgcggaagacatcactcacattgtctatgtttcatccagtgagattcgtctacccggtggcgatctctacctctccagcaagcttggccttaggagtgatgttggccgagtaatgctttactttctgggctgttatggcggtgtcactggcctccgtgttgctaaagacatagctgaaaacaaccctggaagccgcgttttgcttaccacttctgaaactaccatacttgggtttcgcccaccaaacaagtcccgcccttatgaccttgttggggcagctctctttggtgatggagctgctgctgtgatcgttggagctgacccattcctcgataaagagtcttctcctttcatggaacttaactatgcagtccaacaattcttaccagggacacagaatgtcatcgatgggcgtctttctgaagagggtataaacttcaagcttggcagggaccttcctcagaagattgaagaaaatattgaggagttttgcaagaagctcatggccaaagctggtttacaagatttcaatgatttgttctgggcagttcatcctggaggaccggcaattctgaaccgactggaaagcaatctcaagttgaataatcagaagcttgaatgcagcaggagggcattgatggattatgggaatgtgagcagcaacactatcttttatgttatggattatatgagggaggagttgaagaggaaaggagatgaggaatggggacttgctttagcttttggacctggcattacatttgaaggcatccttctccgtggcctgtgattgcttttcttgcatttaattttcaattttacagcttttcgagtttccacttaatttcaactgcttgtgctaaataatgtggaaatcgaaagatattagcatactcgacttactgcaccagatatctaaaagagttttattgtttttcgttaaagttaatgagaaaactccgtgagtaccgcataatacaaatgttaaaacctcgagtgtaaacaaggcattgggttcgatccaactcatatacttgaagagagaaatatgctgtcattgga

SEQ ID NO: 785 - DNA, 1469 bp, Citrus sinensis
gcttgtcttccggccccgacttcaagatgtcacaaattaacggcagtggcagcgacgggcaccattctgcttcagctaggcggactcccactcccggaaaggcaactgttcttgctattggcaaggccttccctagtcagctcattcctcaggaatgcttggttgagggctaccttcgggacactaaatgtgaagatgagtccatcaaggagaaacttgaacgcctgtgtaaaaccactactgtgaagacaagatacaccgtcatgtccaaggcgatcctggacaaatatcctgaactgacaaccgagggctcagcaaccatcaaacaaagacttgaaatagcaaacccagcagtggtagagatggccttggaagcaagccttgcttgcattaaggaatgggggaggcctgcggaagacatcactcacattgtctatgtttcatccagtgagattcgtctacccggtggcgatctctacctctccagcaagcttggccttaggagtgatgttggccgagtaatgctttactttctgggctgttatggcggtgtcactggcctccgtgttgctaaagacatagctgaaaacaaccctggaagccgcgttttgcttaccacttctgaaactaccatacttgggtttcgcccaccaaacaagtcccgcccttatgaccttgttggggcagctctctttggtgatggagctgctgctgtgatcgttggagctgacccattcctcgataaagagtcttctcctttcatggaacttaactatgcagtccaacaattcttaccagggacacagaatgtcatcgatgggcgtctttctgaagagggtataaacttcaagcttggcagggaccttcctcagaagattgaagaaaatattgaggagttttgcaagaagctcatggccaaagctggtttacaagatttcaatgatttgttctgggcagttcatcctggaggaccggcaattctgaaccgactggaaagcaatctcaagttgaataatcagaagcttgaatgcagcaggagggcattgatggattatgggaatgtgagcagcaacactatcttttatgttatggattatatgagggaggagttgaagaggaaaggagatgaggaatggggacttgctttagcttttggacctggcattacatttgaaggcatccttctccgtggcctgtgattgcttttcttgcatttaattttcaattttacagcttttcgagtttccacttaatttcaactgcttgtgctaaataatgtggaaatcgaaagatattagcatactcgacttactgcaccagatatctaaaagagttttattgtttttcgttaaagttaatgagaaaactccgtgagtaccgcataatacaaatgttaaaacctcgagtgtaaacaaggcattgggttcgatccaactcatatactgaagagagaaatatgctgtcatgga

SEQ ID NO: 786 - DNA, 715 bp, Arabidopsis lyrata
tctctcaacaacttacttgttaaagagtcccaccaccactaccacaatcccaatggcttcaccaactcaaactctcctcctcctcctcaccaccgtcttcttcttcatctccgcttccgcagatccggacatgcttcaagatctctgcgttgctgatcttccctctggaatcaagatcaatggcttcccttgtaaagacgcagctacagtcacatcagctgatttcttctcacaaggattagctaatccaggtcttaccaacaacacattcggtgccttggtcactggagctaacgttatgacaatcccaggactcaacacactcggtgtctctctctctcgtatcgactacgcaccaggaggcttaaacccacctcacacccaccctcgtgccactgaaatcgtctttgtcctcgaaggaacacttgacgttgggttcctcactacggccaataagctcatctctcaatctctcaagaaaggagatgtctttgctttccctaaaggacttgtccatttccagaagaacaatggtcatgttcctgcttctgttattgcagctttcaatagtcagcttcctggaactcaatctcttggtgctactttgtttggttctactcctcctgttcctgacaacatcttggctcaagcctttcagacctcttcaggaactgttaaacacatcaaatccaagttccaacccaagaaatgatct

SEQ ID NO: 787 - DNA, 1099 bp, Eutrema halophilum
ttcaatggcacagctctgatccatccgtttagtattagttgacctttgacatttcatagtttgacagaagagagagaaggagagataaaaggaagggcatgttccttgctttttctctctctcaacgagaaaagtcatcgccttcttcactttctctctcctttataaacaataattctcaactgttacagtcccaccattaacaaccaatcccatggcttcaccaactcgaacgctcttcctcctcctcagcttcgccgtcttcttcttcttcatcacagtctccgcagatcccgacatgctccaagacctctgcgtagctgatctctcctccggaatcaaagtcaatggctttccttgcaaagacgcggctaatgtcacatcattagatttcttctcacaaggattagcgaatccaggtcttaccaacaacacattcggggccttagtcacaggagcaaacgtgatgacgattccaggactcaacacgcttggtgtctccctctctcgcatcgactacgcaccaggtggtttaaacccacctcacacccacccgcgtgccactgaagtcgtcttcgtcctcgaaggaacactcgacgttgggtttctcacaaccgccaataagctcatctctcaatctctcaagaaaggagacgtctttgctttccctaaaggactcgtccacttccagaagaacagtggccatgttcctgcttctgttatcgctgctttcaatagtcagcttcctggaactcaatctcttggtgctactttgttcggttcttctcctcctgtacccgacaccatcttggctcaagcctttcagacatctccaggaaccgtcaaacacatcaaaaccaagttccaacccaagaaatgatcttctccagattcattatagttttccggttctgtttttctctcaaaggaaagatcttttatccttcttttttgaatttatcttgtgttataaacaataactcatctttgagtgtgcatttgagctccatagtctcatgtatgatcttctgtataatccaattttttttttttttggtttaaaagttgactagaaacaggtatgctgatgttgatcata

SEQ ID NO: 788 - DNA, 733 bp, Brassica napus
gatcaccattaacaatcaagaatcaaaaaatccatggcttcaccaactctattcctctccatcttgctcttcttcctcattacagtctccgcagatcctgacatgctccaagacctctgcgtcgctgatctctcctccggaatcaaagtcaacggcttcccttgcaaagacgcagctaacgtcacatccctcgacttcttctcacaagcactagcgaatccaggtctcaccaacaacacattcggtgccttagtcacaggagccaacgtaatgaacctcccaggtctcaacacgctcggtgtctccctctctcgcatcgactacgcgccaggtggcttaaacccgcctcacactcacccacgtgccaccgaagtcgtctacgtcctcgaaggaacactcgacgttgggtttctcaccaccgcgaacaagctcatctctcggtctctcaagaaaggtgacgtgtttgctttccccaaaggacttgttcatttccaaaagaacaacggtgatgttcctgcctctgtcatcgctgctttcaatagtcagcttcctggaactcagtctcttggtgctactttgttcggttctacgcctcctgttcctgatgagatcttggctcaagcctttcagacgtcttcgggaactgtcaaacatattaaaactaggttccaacccaagaagtaatcttactctcaaaattcattacatgttttttcttcttgttctgtttttt

SEQ ID NO: 789 - DNA, 737 bp, Brassica napus
gaaggccattcatgtttccttgcttttaaagcatcatctctctccgtctacaatctctctcatcaccatcaatcaagaatcaaaaaatccatggcttcaccaactctattcctctccatcttgctcttcttcctcattacagtctccgcagatcctgacatgctccaagacctctgcgtcgctgatctctcctccggaatcaaagtcaacggcttcccttgcaaagacgcagctaacgtcacatccctcgacttcttctcgcaagcactagcgaatccaggtctcaccaacaacacattcggtgccttagtcacaggagccaacgtaatgaacctcccaggtctcaacacgctcggtgtctccctctctcgcatcgactacgcgccaggtggcttaaacccgcctcacactcacccacgtgccaccgaagtcgtctacgtcctcgaaggaacactcgacgttgggtttctcaccaccgcgaacaagctcatctctcggtctctcaagaaaggtgacgtgtttgctttccccaaaggacttgttcatttccaaaagaacaacggtgatgttcctgcctctgtcatcgctgctttcaatagtcagcttcctggaactcagtctcttggtgctactttgttcggttctacgcctcctgttcctgatgagatcttggctcaagcctttcagacgtcttcgggaactgttaaacatattaaaactaggttccaacccaagaa

SEQ ID NO: 790 - DNA, 1155 bp, Eutrema parvulum
ttgaatagcacagccctaatccatccgtttagtatacgttgacctttgacatttcattttaacagaggagagagaggaagagaagagaaataaaagcagaaggcatgttccttgctttttctatcaactagaaaagtcgtctccttcttcaatctctctcctttataaacgataattctcaactgttacagtctcaccattaacagtcaacaatcaacaaatccatggcttcatcaattccatttctctccatctttctcggcctcgttgccttcttcttcattacagtctctgcagatcccgacatgctccaagatttctgcgtcgctgatctctcctccggaatcaaagtcaatggctacccttgcaaagacgcagctaaagtcacatcactcgatttcttctcacaaggattagcgaagccaggtcttactaacaacacattcggggccttggtcacaggagctaacgtgatgacggtgccaggactcaacacactcggtgtctccctctctcgcatcgactacgcaccaggtggcttaaacccacctcacacgcacccacgcgccactgaagtcgtcttcgtcctcgaaggaaccctcgacgttgggtttctcactacgaccaataagctcatctctcaatctctcaagaaaggagacgtctttgctttccccaaaggacttgtccatttccagaagaacagtggccgtggtcctgcttctgttatcgctgctttcaatagtcagcttcctggaactcaatctcttggtgctactttgttcggctcttcgcctcctgttcctgacaacatcttggctcaagcctttcagacatctccaggaactgtcaaacacatcaaaaccaggttccaacccaagaaatgatgatctcttgttacaggttttattggttctgttttctaaaggaataatcttttctccttactatttgtcttgtgtgataatatcaataaccgatcttctttgagtgtgcatttgagctccattctctcatgtattatcttctgtataatccaaattttttttttggtttcaagttgacttagaaacaggcaagtagattttgatcttatttaaaacttcataaattatgaaagcaggtaagctacttatatatgaccatgtaaataaa

SEQ ID NO: 791 - DNA, 837 bp, Raphanus sativus
ggatgttccttgcttttaaagcatcatctccttcttcaatctctctcttctgttacagtctcaccattaacaatcaagaatccatggcttcaccaacaactccattcctctccatcttcctcttcttcctcattacaatctccgcagatcccgacatgctccaagacctctgcgtcgctgatctctcctccggaatcaaagtcaacggcttcccttgcaaagacgcagctaacatcacatcactagacttcttctcacaaggactagcgaatccaggtctcaccaacaacactttcgggtccttagtcacaggagccaacgtgatgaacctccccggtctcaacacactcggcgtctccctctcacgcatcgactacgcgccaggtggcttaaacccacctcacactcacccacgtgccaccgaagtcgtctacgtcctcgaaggaacactcgacgttgggtttctcaccaccgccaacaagctcatctctcggtctctcaagagaggtgacgtatttgctttccccaaaggacttgttcatttccagaagaacaacggtgatgttcctgcttctgtcatcgctgctttcaatagtcagcttcctggaactcagtctcttggtgctactctgttcggctctactcctcccgttcctgataacatcttggctcaagcctttcagacatctccgggaacggttaaacacattaaaactaggttccaacccaagaaatgatcttatgctccaaactcattacatgtttttttttcttcccggttctgtttttcatttatcttgtgtaatgaaaaccaataaactgatctttgaatgtgca

SEQ ID NO: 792 - DNA, 844 bp, Raphanus sativus
ggagtcacaccatcaaacaacaacaatcaacatggctccatttctctccatctccctcgcccttgtcgccattttcttcattacagtctccgcagatcccgacatgctccaagacctctgtgtcgctgatctctcctccggaatcaaagtcaatggcttcccttgcaaagacgcagccaacgtcacaccactcgatttcttctcgcaaggaatagccaatccaggtctcaccaacaacacattcggctccttagtcacaggcgcgaacgtgatggccatcccgggactcaacaccctcggcgtctccctcgcacgcatcgactacgcgccgggaggcttaaacccgcctcacactcaccctcgcgccaccgaagtcgtctacgtcctcgaaggagccctcgacgtcgggttcctcaccacggccaacaagctcatctctcagtctctcaagaaaggcgacgtctttgctttccccaaggggcttgttcatttccagaagaacaacggtcgcgtccctgcttctgtcatcgctgctttcaacagccagcttcccgggactcagtctcttggtgctactttgttcggttctacgcctcctgttcctgatcagatcttggctcaagcgtttcagacgtctccggggactgttaaacacatcaaaaccaagttccaacccaagaagtagtgatatgatcttcttggttctgtttttctcctttatttgtcctttgtgtaataaaaccaaataactgatctttgagtgtgcatttgagctttcgttgtctcatgtattagttgatttttcttttttttttttttagtttcacgttaactatatttggga

SEQ ID NO: 793 - DNA, 836 bp, Raphanus sativus
acaccatcaaacaacaacaatcaacatggctccatttctctccatctccctcgcccttgtcgccattttcttcattacagtctccgcagatcccgacatgctccaagacctctgtgtcgctgatctctcctccggaatcaaagtcaatggcttcccttgcaaagacgcagccaacgtcacaccactcgatttcttctcccaaggaatagccaatccaggcctcaccaacaacacattcggctccttagtcacaggcgcaaacgtgatgaccatcccaggtctcaacacgctcggcgtctccctcgcacgaatcgactacgcgccaggcggcttaaacccgcctcacactcaccctcgcgccaccgaagtcgtctacgtcctcgaaggagccctcgacgtcgggttcctcaccacggccaacaagctcatctctcagtctctcaagaaaggcgacgtcttcgctttccccaaggggcttgtccatttccagaagaacaacggtcgtgtccctgcttctgtcatcgctgctttcaatagccagcttcctgggactcagtctcttggtgctactctgttcggttctacgcctcctgttcctaatgagatcttggctcaagcgtttcagacatctccgggaactgttaaacacatcaaaaccaagttccaacccaaggtgtaataatgatcttttggttctgttttttctaacggaatgatattttcctcctttatttgtcttgtgtaataaaacccataactgatgttttgagtgtgcatttgagctttcattgtctcatgtatcatcttctatataatacaagttgttttttttagga

SEQ ID NO: 794 - DNA, 989 bp, Brassica napus
ggagacagaggagagagagaaacagaattaaaaagcagcatgttccttgctttttctctcccacgaagaaaaagtcatctccttcttcaatctctctcccctttataaccactatcattctcaactgtttacagtcacgccatcaacaacaatcaacatggcttctcaaactccatttctctccatctccatctccctcgccctcgccgcctttctcttcttcattacagtctccgcagatcccgacatgctccaagacctctgtgtcgctgatctctcctccggaatcaaagtcaacggcttcccttgcaaagacgcagccaacgtcacatccctcgatttcttctcgcaaggaatagcgaatccaggcctcaccaacaacacgttcggtgccttggtcacaggcgcgaacgtgatgaccatccctggtctcaacacgctcggcgtctccctcgctcgcatcgactacgctccaggcggcttaaacccgcctcacactcacccgcgcgccaccgaagtcgtctacgtcctcgaaggaacactcgacgtcgggttcctcacgacggccaacaagctcatcgctcagtctctcaagaaaggtgacgtctttgctttccccaaaggacttgttcatttccagaagaacaatggtcgtgtccctgcttctgttgtagctgcttttaatagccagcttcctgggactcagtctcttggtgctactttgttcggttctacgcctcctgttcctgatagtgtcttggctcaagcgtttcagacgtctccggggactgttaaacacatcaagaccaagttccaacccaagaagtgatgatgatcttcttaattacaggctttgttttttctaaaaaaagaatatctttgtgaaataaaaccaattaactgatatttgagtgtgcatttgagctttcgttgtctcatgtattatcttctttgtctttttttatgagttccactgatgttttgatctt

SEQ ID NO: 795 - DNA, 966 bp, Brassica napus
agaattaaaaagcagcatgttccttgctttttctctcccacgaagaaaaagtcatctccttcttcaatctctctcccctttataaccactatcattctcaactgtttacagtcacgccatcaacaacaatcaacatggcttctcaaactccatttctctccatctccatctccctcgccctcgccgcctttctcttcttcattacagtctccgcagatcccgacatgctccaagacctctgtgtcgctgatctctcctccggaatcaaagtcaacggcttcccttgcaaagacgcagccaacgtcacatccctcgatttcttctcgcaaggaatagcgaatccaggcctcaccaacaacacgttcggtgccttggtcacaggcgcgaacgtgatgaccatccctggtctcaacacgctcggcgtctccctcgctcgcatcgactacgctccaggcggcttaaacccgcctcacactcacccgcgcgccaccgaagtcgtctacgtcctcgaaggaacactcgacgtcgggttcctcacgacggccaacaagctcatcgctcagtctctcaagaaaggtgacgtctttgctttccccaaaggacttgttcatttccagaagaacaatggtcgtgtccctgcttctgttgtagctgcttttaatagccagcttcctgggactcagtctcttggtgctactttgttcggttctacgcctcctgttcctgatagtgtcttggctcaagcgtttcagacgtctccggggactgttaaacacatcaagaccaagttccaacccaagaagtgatgatgatcttcttaattacaggctttgttttttctaaaaaaagaatatctttgtgaaataaaaccaattaactgatatttgagtgtgcatttgagctttcgttgtctcatgtattatcttctttgtctttttttatgagttccactgatgttttgatctt

SEQ ID NO: 796 - DNA, 789 bp, Raphanus sativus
  misc_feature (199)..(199): n is a, c, g, or t
  misc_feature (314)..(314): n is a, c, g, or t
  misc_feature (578)..(578): n is a, c, g, or t
atttctctccatctccctcgcccttgtcgccatttccttcttcattacagtctccgcagatcccgacatgctccaagacctctgtgtcgctgatctctcctccggaatcaaagtcaatggcttcccttgcaaagacgcagccaacgtcacaccactcgatttcttctcccaaggaatagccaatccaggtctcaccaanaacacattcggctccctggtcacaggcgcaaacgtgatgaccatcccaggtctcaacaccctcggcgtctccctcgcacgcatcgactacgcgccgggaggcttaaacccgcctnacactcaccctcgcgccaccgaagtcgtctacgtcctcgaaggagccctcgacgtcgggttcctcaccacggccaacaagctcatctctcagtctctcaagaaaggcgacgtcttcgctttccccagaggactcgtccatttccagaagaacaacggtcgtgtccctgcctctgtcatcgctgctttcaacagccagcttcctgggactcagtctcttggtgctactctgtttggttctacccctcctgttcctgatgagatcntggctcaagcgtttcagacgtctccggggactgttaaacacatcaaaacgaagttccaacccaagaagtagtgatatgatcttcttggttctgtttttctcctttatttgtccttgtgtaataaaaccaaataactgatctttgagtgtgtatttgagctttcattgtctcatgtattatcttctatataatacaaagttgatttttcttt

SEQ ID NO: 797 - DNA, 942 bp, Brassica oleracea
  misc_feature (34)..(36): n is a, c, g, or t
cccacgcgtccgcgtgaaaagtcattcctttctnnntttctctctcctttataaaccatcattctcaactgttccagtctcaccattaaccatcaacaatggcttcaccaacttcatttctctccatcttcctctgcctcgtcgccttcctcttcattacagtctccgcagatcccgacatgctccaagacctctgcgttgctgatctctcctctggaatcaaagtcaacggcttcccttgcaaagacgcagccaacgtctcctcactcgatttcttctcacaaggaatagcaaacccaggtctcaccaacaacacattcggagctttagtcacaggcgccaacgtgatgaccatcccaggactcaacacgctcggcgtctccctcgctcgcatcgactacgcgccaggcggcttaaacccgcctcacactcacccgcgcgccaccgaagtcgtctacgtcctcgaaggtaccctcgacgtcgggtttctcaccaccgccaataggctcatctctcagtctctcaagaaaggtgacgtcttcgctttccccagaggacttgttcatttccagaagaacaacggtcgtgtccctgctgccgttatcgctgctttcaatagtcagcttcctggaactcagtctcttggtgctactctgttcggttctacgcctcctgttcctgatgagatcttgtctcaagcgtttcagacaactccgagaattgttagaaacattaaaagcaggttccagcccaagaaatgatcatttccaaattttcattaccgggtttgtcaggttctgttttctaaaggaatgatttttactcatttttatttatcttgtgtaataaaagtgttaaccaataaattcatcattgagtgttcatttgagttccattgttttaatgtattatcttctgtataatcaagttttattttatttt

SEQ ID NO: 798 - DNA, 970 bp, Brassica rapa
cgcaacgtgaaaagtcattcctttcttcaatttctctctcctttataaaccatcattctcaactgttacagtctcacaattaacaatcaacaatggcttcaccaacttcattcctctccatcttcctctgcctcgtcgccttcctcttcattacagtctccgcagatcccgacatgctccaagacctctgcgtcgctgatctctcctctggaatcaaagtcaacggcttcccttgcaaagacgcagccaacgtctcatcactcgatttcttctcacaaggaatagcaaacccaggtctcaccaacaacacattcggagctttggtcacaggcgccaacgtcatgaccatcccaggtcttaacacgctcggcgtctccctcgctcgcatcgactacgcgccaggcggcttaaacccgcctcacactcacccccgcgccaccgaagtcgtctacgtcctcgaaggaacactcgacgtcgggtttctcacgactgccaacaggctcatctctcagtctctcaagaaaggtgacgtcttcgctttccccagaggacttgttcatttccagaagaacaacggtcgtgtccctgcggctgttatcgctgcttttaatagtcagcttcctggaactcaatctctcggtgctactctgttcggttctacgcctcctgttcctgatgagatcttgtctcaagcgtttcagacaactccgagaattgttagaaacattaaaagcaggttccagcccaagaaatgatcatttccaaattttcattaccgggtttgtctggttttgtcaggttctgttttctaaaagaatgatttttactcatttttatttatcttgtgtaataaaagtataaaaccaataaattcatcattgagtgttcatttgagttccattgttttaatgtattatcttcttctgtataatccagttttattttattatttgggttcaaagttgactat

SEQ ID NO: 799 - DNA, 883 bp, Brassica napus
caatggcttcaccaacttcattcctctccctccttagcctcatcgccttcttcctcattacagtctccgcagatcccgacatgctccaagacctctgcgtcgctgatctctcttctggaatcaaagtcaacggcttcccttgcaaagacgcagccaacgtctcatcactcgatttcttctcacaaggaatagcaaacccaggtctaaccaacaacacattcggcgccttagtcacaggagccaacgtgatgaccatcccaggactcaacacgctcggcgtctccctcgctcgcatcgactacgcgccaggcggcttaaacccgcctcacactcacccgcgcgccaccgaaatcgtctacgtcctcgaaggaacactcgacgtcgggttcctcacgaccgccaacaggctcatctctcagtctctcaagaaaggtgacgtcttcgctttccccagaggacttgttcatttccagaagaacaacggtcgtgtccctgcggctgttatcgctgcttttaatagtcagcttcctggaactcaatctctcggtgctactctgttcggttctacgcctcctgttcctgatgagatcttgtctcaagcgtttcagacaactccgagaattgttagaaacattaaaagcaggttccagcccaagaaatgatcatttccaaattttcattaccgggtttgtctggttttgtcaggttctgttttctaaaagaatgatttttactcatttttatttatcttgtgtaataaaagtataaaaccaataaattcatcattgagtgttcatttgagttccattgttttaatgtattatcttcttctgtaatccagttttattttattattgggttcaaagcgacactaacagtagcg

SEQ ID NO: 800 - DNA, 857 bp, Brassica napus
ttttgttcctttgtaaacgatcattctcaactgttacagtctcacaattaaccatcaacaatggcttcaccaacttcattcctctccctccttagcctcatcgccttcttcctcattacagtctccgcagatcccgacatgctccaagacctctgcgttgctgatctctcctctggaatcaaagtcaacggcttcccttgcaaagacgcagccaacgtctcatcactcgatttcttctcacaaggaatagcaaacccaggtctcaccaacaacacattcggagctttggtcacaggcgccaacgtgatgaccatcccaggtcttaacacgctcggcgtctccctcgctcgcatcgactacgcgccaggcggcttaaacccgcctcacactcacccgcgcgccaccgaaatcgtctacgtcctcgaaggaacactcgacgtcgggttcctcacgaccgccaacaggctcatctctcagtctctcaagaaaggtgacgtcttcgctttccccagaggacttgtccatttccagaagaacaacggtcgtgtccctgcggctgttatcgctgctttcaatagtcagcttcctggaactcaatctcttggtgctactttgttcggttctacgcctcctgttcctgatgagatcttgtctcaagcgtttcagacaacgccgaggattgttagaaacattaaaagcaggttccaacccaagaaatgatcatctctaaattttcattaccggttttgtctggttttgtcaggttctgttttctacaggaatgatctttcctcatttttatttatcttgtgtaataaaagtataaaaccaataaattcatcattgagtgttcattt

SEQ ID NO: 801 - DNA, 1024 bp, Brassica napus
gagacagaaataaaagcaagaggcatgttccttgcttctctatctctctgtctcaacgtgaaaagtcattcctttcttcaatttctctctcctttataaaccatcattctcatatgttacagtctcacaattaacaatcaacaatggcttcaccaacttcattcctctccctccttagcctcatcgccttcttcctcattacagtctccgcagatcccgacatgctccaagacctctgcgtcgctgatctctcttctggaatcaaagtcaacggcttcccttgcaaagacgcagccaacgtctcctcactcgatttcttctcacaaggaatagcaaacccaggtctaaccaacaacacattcggcgccttagtcacaggagccaacgtgatgaccatcccaggactcaacacgctcggcgtctccctcgctcgcatcgactacgcgccaggcggcttaaacccgcctcacactcacccgcgcgccaccgaaatcgtctacgtcctcgaaggaacactcgacgtcgggttcctcacgaccgccaacaggctcatctctcagtctctcaagaaaggtgacgtcttcgctttccccagaggacttgttcatttccagaagaacaacggtcgtgtccctgcggccgttatcgctgctttcaatagtcagcttcctggaactcagtctcttggtgctactctgttcggttctacgcctcctgttcctgatgagatcttgtctcaagcgtttcagacaactccgagaattgttagaaacattaaaagcaggttccagcccaagaaatgatcatttccaaattttcattaccgggtttgtctggttttgtcaggttctgttttctaaaggaatgatttttactcatttttatttatcttgtgtaataaaagtgtaaaaccaataaattcatcattgagtgttcatttgagttccattgttttaatgtattatcttcttctgtaatccagttttattttattattgggttcaaagcgacactaacagtagcg

SEQ ID NO: 802 - DNA, 825 bp, Brassica napus
ttcaccaacttcatttctctccatcttcctctgcctcgtcgccttcctcttcattacagtctccgcagatcccgacatgctccaagacctctgcgttgctgatctctcctctggaatcaaagtcaacggcttcccttgcaaagacgcagccaacgtctcctcactcgatttcttctcacaaggaatagcaaacccaggtctcaccaacaacacattcggagctttagtcacaggcgccaacgtgatgaccatcccaggactcaacacgctcggcgtctccctcgctcgcatcgactacgcgccaggcggcttaaacccgcctcacactcacccgcgcgccaccgaagtcgtctacgtcctcgaaggtaccctcgacgtcgggtttctcaccaccgccaataggctcatctctcagtctctcaagaaaggtgacgtcttcgctttccccagaggacttgttcatttccagaagaacaacggtcgtgtccctgctgccgttatcgctgctttcaatagtcagcttcctggaactcagtctcttggtgctactctgttcggttctacgcctcctgttcctgatgagatcttgtctcaagcgtttcagacaactccgagaattgttagaaacattaaaagcaggttccagcccaagaaatgatcatttccaaattttcattaccgggtttgtctggttttgtcaggttctgttttctaaaggaatgatttttactcatttttatttatcttgtgtaataaaagtgttaaccaataaattcatcattgagtgttcatttgagttccattgttttaatgtattatcttctg

SEQ ID NO: 803 - DNA, 608 bp, Brassica napus
tcttcctcattacagtctccgcagatcccgacatgctccaagacctctgcgtcgctgatctctcctccggaatcaaagtcaacggcttcccttgcaaagacgcagctaacgtcacgtccctcgacttcttctcacaagcactagcgaatccaggtctcaccaacaacacattcggtgccttagtcacaggagccaacgtaatgaacctgccaggactcaacacactcggtgtctccctctctcgcatcgactacgcgccaggtggttcaaacccgcctcacactcacccacgtgccaccgaagtcgtctacgtcctccaaggaacactcgacgttgggtttctcacgaccgcgaacaagctcatctctcagtctctcaagaaaggtgacgtatttgctttccccaaaggacttgttcacttccagaagaacaacggtgacgttcctgcctctgtcattgctgcttttaatagtcagcttcctggaactcagtctcttggttgtctactttgttcggctctacgcctcctgttcctgatgagatcttggctcaagcctttcagacgtcttcaggaactgttaaacacaattaaaactaggttccaaccc

SEQ ID NO: 804 - DNA, 1545 bp, Arabidopsis lyrata
gcgtcggtctctgatgagtgatcaactgccacggagcgaaccaattcgtaattgcaacgtcctgagaatgtcgacactctttcactctttctccaagttgcctccttttcgatttctcatattttatagactcactttctgcttcttcttgatcccgaggaagaagaagaaactcttgttcccatgatcatcgtcgatgttctttggaaactgtttcctctatactcgtttggatcagaaagagattctctctcagagtccattttgcagataattcccgagacaatggcttcttctaccactaaaatcctctgtgatgccggtgattcagacctctgtagagacgattcagctgcatttctactcaaatttgtagccattgcctccattctattagctggagctgctggtgtagccatacctctcattggcaggaaccgtcggttccttcaaaccgagggaaatctctttgtagctgctaaagcctttgcagctggtgtcatactcgccactggctttgtccatatgcttgcaggcggcacggaagctctgagtaatccgtgtttaccagattatccgtggtctcagtttccctttcccggtttctttgctatggtggctgctttagttactctgcttgtggattttatggggacacagtactatgagaggaagcaagagaggaatcaggctgctggtgaaaccgctgttgttgagcctggtcgtgaagagactgctgttgttcccgtggttggggaaagagtcaacgataataaagtatttggtgaagaagacggtggcgggattcacattgttggcattcgtgctcatgctgctcaccataggcatagtcactctaatagccatggtacatgtgatggacatgctcatggacattcacacggacatggacatggacatgtgcacgggaattcagatgttgaaaatggagctaggcatgttgttgtttctcagatattggagcttgggattgtgtcgcattcaatcattatcggtttatcccttggagtatcgcagtctccatgcacgatcaggcctctcattgcagctctgtcatttcaccagttctttgaaggatttgcgctcggaggctgcatctctcaggcacagttcaggaacaaatcagcaaccataatggcttgcttcttcgcgctaaccacaccgatagggatcggaattggaaccgcagtggcctcgtctttcaactcgcatagccctggagctttggtcaccgaggggatattggactcgctgtcagctgggattctggtgtacatggctctggtggacctcatcgcagctgattttctaagcaagaggatgagttgtaatgtgaggcttcaagttgtgtcttatataatgttgttccttggagctggacttatgtctgctctcgccgtttgggcttagcttttagattacatattatctcatgtagaatcgaataatatactgctcatgcaacttcatatttttgccttgattcatatgaatataataaatagaggaacatattagaaataa

SEQ ID NO: 805 - DNA, 1518 bp, Eutrema parvulum
aatgccacggagcgaggctcttcgctactccaacgtgctgacaatgtcgacactctttcgcaccttccttccttcttttcgatttctcctttgtaataaagccttcgctttatgcgtcttttgagatcccaaggaagacgaagacattcttgttcccatgatcatcgccgatgttctttggaaatcgtttcctctatacttgttcggcggatcaggaagagattctctctcagagtccattttgcagatgattcccgagacaatggcgtcttctaaaatcctctgtgatgctggcgaatctgacctctgccgagacgattcagctgcatttctactcaaatttattgccattgcctgcattctcctagccggagcagcgggtgtagccatacctctcgttggcaagaaccgtcggttccttcgaacagagggaaacctctttgtagctgctaaagcctttgcagctggtgtcatactcgcaactggctttgtccatatgcttgcaggcggcacggaagctctgaccaacccgtgcttaccggattttccctggtccaagttcccttttcccggattctttgcgatggtggctgctttgatcactctgcttgtggatttcatggggacgcagtactatgagaggaagcaagagaggaatgatgaggctgctggtgagtctcccgctgttgttgagcctggccgtgaagaggcatctgttgttcctgtcgttgtggaaagagtgaacgataataaagtgtttggtgaagaagacagcggcgggattcatattgttggcattcgtgctcatgccgctcaccatagacatagtcactctaatggccatggtacatgcgatggacttgctcatggacattcacacggacatgggcatgcgcacggatttcaggatgtcgaaagtggagctaggcatgttgttgtttctcagattttggagcttggcattgtatctcactctatcatcatcggtttatcactaggggtatcgcagtctccttgtacaatcaggcctctaattgcagctctatcatttcaccagttctttgaaggatttgcactcggaggctgcatctctcaagcacagtttagaaacaaatcagcgaccataatggcctgcttcttcgcactaaccacaccgatagggatcgggattggaaccgcagtggcctcgtctttcaactcgcgtagccctggagctgtggtcactgaagggatactagactccctctcggctgggattctggtatacatggctctggtggacctgatcgcagctgattttctaagcaagaggatgagctgtaacgtgaggcttcaagttgtgtcttatgtaatgttgtttcttggagctggacttatgtccgcactagccatttgggcctagcttttagatttacgtattatctgctgtagaaacaaataatatacgaactcgcaatttattctctatgttgtttcgattcatatgatataaaagatatagaggaacatggaaatcaa

SEQ ID NO: 806 - DNA, 1389 bp, Raphanus sativus
aaagaaccaagaaccaagaatatactctctctttgttccccatgatcatcgtcgatattctctggaaactgtttcctctatacttgttcggtggtggatcaggaagagaatctctctcagagtccattttgcagatgattccaccgacaatggcgtcttccaagatcctctgtgacgccggcgaatccgacctctgcagagacgactcagctgcgtttctactcaaattcgtcgccattgcgtccattctcctatctggagcagctggtgtggccatacctctcgttggcaagaaccgccgcttccttcaaaccgaagggaacctctttgtatctgctaaggcctttgcagctggtgtcatactcgccactggcttcgtccacatgcttgctggaggcactgaagctctcaccaacccttgtttgccggagtttccgtggtctaagtttccctttccggggttctttgcaatggttgctgctttgatcactctgcttgttgatttcatggggactcagtactatgagaggaggcaagagaggaggggtgatgagtctgctgctgctgctagtgaagcttctgctggtgttggtgttgagtctggtcgtgaagaggcgtctgttgttgttcctgtggttgttgagagagtgagtgattgtagtagtaaagtgtttggtgaagaggaaggtggtgggatgcatattgttggcattcgtgctcatgctgctcatcatagacatagccactctaatgggcttggtacgtgcgatggacatgcgcacggacatgggcacgcgcacggacatcaagatgtcggaaacggagctaggcatgttgttgtttctcagatattggagcttgggattgtatcgcactcaatcatcatcggtttatccctcggagtatctcagtctccatgcacgatcagacctctaatagcagctctatcgtttcaccagttctttgaagggtttgcgctcggaggctgcatctctcaagcagagtttaagaacaagtcagcgaccataatggcttgcttcttcgcgctaacaacacctgtagggatcgggattggaaccgcggtggcctcgtctttcaactcgcatagtcctggagctctgatcgccgaggggatactagactcgctctcggctgggatactggtgtacatggctctggtggacctgatcgcagctgattttctaagcaagaggatgagttgtaatgtgaggcttcaaattgtgtcttatgtaatgttgttccttggagctggacttatgtccgcgcttgccatttgggcgtagatctctttagattgcatgctattgatctcccgtagaaacaaataaatatacgccttctctcttttgcattgtctaggggaatata

SEQ ID NO: 807 - DNA, 1808 bp, Brassica napus
ggatttggatcgcgtcagtctctcatcagtgtagagctgacacggagcagcctgttcttgctgacaatgtcgacactctttctccaacattcttccttcttttcggttataataaaggtttagctttctgcgcattgatcccgagaaagaagaagaatatactctctctttgttccccatgatcatcgtcgatattctttggaaattgtttcctcaatacttgttcggtggtggatcaggaacagattctctctcagagtccattttgcagatgattccttcagcaatggcgtctcccaagatcctctgtgacgccggcgaatctgacctctgcagagacgactcagctgcgtttgtactcaaattcgtcgccattgcatccatcttcctatctggagcagcaggtgtagccatacctctcgttggcaagaaccgccgcttcctccaaacggaagggaacctctttgtatctgctaaggcctttgcagctggtgtcatactagcaactggctttgtccacatgcttgctggcggcactgaggctctgaccaatgcttgtttgccggagttcccttggtctaagtttccgtttcctgggttctttgctatggtggctgctttgatcactctacttgtggatttcatggggactcagtattatgagaggaggcaagagaggagtgatgatgctgctgctcctagtgaagcttctgctgttgttggtgttgagtctggtcgtgaagaggcgtctgttgttgttcctgtggttgttgaaagagtgagtgatggtaataataaagtttttggtgaagaggaaggtggtgggatgcatattgttggcattcgtgctcatgctgctcaccatagacatagtcactctaatggccttggtacatgcgatggacatgcacacggacatggacacgcgcacggacatcaagatgtcggaaatggagctaggcatgttgttgtttcacagatattggagcttgggattgtatcgcactcaatcatcatcggtctatccctcggagtatctcagtctccatgcacgatcaggcctctaatagcagctctatcgtttcaccagttctttgaagggtttgctctcggaggatgcatctctcaagcacagtttaagaacaaatcagcgaccgtaatggcttgcttcttcgcactaacgacacctgtagggatcgggatcggaaccgcggtggcctcgtctttcaactcgcatagccctggagctctgatcgccgaggggatactggactcgctctcggctgggatactggtgtacatggctctggtggacctgatcgcagctgattttctaagcaagaggatgagctgtaatatgaggcttcaagttgtgtcttatgtaatgttgttccttggagctggacttatgtccgcgcttgccatttgggcgtagctcttgtagattgcatgctattgatcttccgtagaaacaaataagttacgtcctcgcaagttcttctctgtgattcatataatataatgttttagacatgaacttaaataaaaaaaaaaaaaaaacaacaagtaggaagaacttaaactaaagaatagaagaataggcgacgtacggaacgaatacgtagacggacggttaccggttacgtaaggagacgagacggagaacaactacaagaagtaggaagagacgacgaacatatcttcctcgacgaccactccgccgaccacacactaaaactacgtacgaccgtaccgaccggaagggaaggaactctacgacctactacgacggactaccacgtcgagga

SEQ ID NO: 808 - DNA, 1489 bp, Brassica napus
ggatttggatcgcgtcagtctctcatcagtgtagagctgacacggagcagcctgttcttgctgacaatgtcgacactctttctccaacattcttccttcttttcggttataataaaggtttagctttctgcgcattgatcccgagaaagaagaagaatatactctctctttgttccccatgatcatcgtcgatattctttggaaatcgtttcctctgtacttgttcagtggatcaggaacagatcctctctcagagtccattttgcagatgatggcgtctcccaaaatcctctgtgacgccggcgaatctgacctctgcagagacgactcagctgcgtttgtactcaaattcgtcgccattgcatccatcttcctatctggagcagcaggtgtagccatacctctcgttggcaagaaccgccgcttcctccaaacggaagggaacctctttgtatctgctaaggcctttgcagctggtgtcatactagcaactggctttgtccacatgcttgctggcggcactgaggctctgaccaatgcttgtttgccggagttcccttggtctaagtttccgtttcctgggttctttgctatggtggctgctttgatcactctacttgtggatttcatggggactcagtactatgagaggaggcaagagaggagtgataatgctgctgctcctagtgaagcttctgctgttgttggtgttgagtctggtcgtgaagaggcgtctgttgttgttcctgtggttgttgaaagagtgagtgatggtaataataaagtttttggtgaagaggaaggtggtgggatgcatatggttggcattcgtgctcatgctgctcaccatagacatagtcactctaatggccttggtacatgcgatggacatgcacacggacatggacacgcgcacggacatcaagatgtcggaaatggagctaggcatgttgttgtttcacagatattggagcttgggattgtatcgcactcaatcatcatcggtctatccctcggagtatctcagtctccatgcacgatcaggcctctaatagcagctctatcgtttcaccagttctttgaagggtttgctctcggaggatgcatctctcaagcacagtttaagaacaaatcagcgaccgtaatggcttgcttcttcgcactaacgacacctgtagggatcgggatcggaaccgcggtggcctcgtctttcaactcgcatagccctggagctctgatggccgaggggatactggactcgctctcggctgggatactggtgtacatggctctggtggacctgatcgcagctgattttctaagcaagaggatgagctgtaatatgaggcttcaagttgtgtcttatgtaatgttgttccttggagctggacttatgtccgcgcttgccatttgggcgtagctcttgtagactgcatgctattgatcttccgtagaaacaaataaattacgtcctcgcaagttcttctct

SEQ ID NO: 809 - DNA, 2065 bp, Eutrema halophilum
gttctttggaaatcgtttcctttatacttgttcggatcaggaagagattctctctcagagtccattttgcagataattccagagacaatggcttcttctactccttctaaaatcctctgtgacgccggagaatcagacctatgtcgagacgattcagctgcgtttctactcaaattcatagcaattgcctcaattctcatagccggagctgcaggtgtagccatacctctcattggcaggaaccgccggttccttaaaaccgaaggaaatctctttgtagcagctaaagcctttgcagctggtgtcatactcgccactggatttgtccatatgcttgcaggcggcacagaagctttaaccaatccctgcttacctgattatccttggtccaagtttccttttcccggcttctttgcaatggtcgctgctttggtaactctgcttgtggatttcatggggacacagtactatgagaggaatcaagagaggaatgaggcagctagcgaaccaggcgttgttgagtctggccgtgaagggactgctgttgctcctgagagagtaaacgataataaggtgtttggtgaagaagatggtggcggtattcacattgttggcattcgtgctcatgctgctcaccatagacatagtcactctaatggccatggtacatgtgatggccatgctcatggacatggtcatgtgcacgggaattcagatgtcgaaaatggagctaggcatgttgttgtttctcagatattggagctagggattgtgtcgcactcaatcatcattggtttatccttgggggtatcgcagtctccatgcacaatcaggcctctaattgcagctctatcatttcaccagttctttgaaggatttgcgttgggagggtgcatctctcaagcacagttcaggaacaaatcagcgatcataatggcttgcttctttgcactaacaacaccgatagggatcgggatgggaacagcagtggcgtcgtctttcaacacgcacagccctggagctctagtcactgaagggatacttgactcgctctcggctgggatactggtgtacatggctctcgtggacctaatcgcagctgattttctaagcaagaggatgagttgtaatgtgaggcttcaagttgtgtcttatgtaatgttgttccttggcgctggacttatgtccgcactcgccatttgggcttagccttttcaatttacatatttctctgctctagaatcaaataatatacgtcctcgcaaattcttctctttttttttttgttgctttgattcatacgataatatagaggaacatgttaaaaggataacaaaatattgaaatttgtgatctttataaaagggtggtccaaattagcgaaagtaacaagagagagagatacattcagcttttcacatttcattgatgaagctttttaaagcaatgatcttaaacaatggcttcttctttgtgggtttcgatgacgacatcagaggttgggtaagccacgcaggtgagaacatacccgtcgttcatctggtcatcgtctaagaagctctggtcagactggtcaatggagccagagacgactttcccggcgcagctcgagcaagatccggcacggcatgagtacggcagatcgattccggcttcctcagcggcgtcgaggacgtagacgtcgtcttcgcactccacttcttgctctccctctggagtgatgaacttgaccttgtaggtagccatggcggtgacgcggccgccgcgtgcggtggaggatttgaggccgaagagggattgtgtgttggccgccgggagagatctgaggctgattggtgtctgttggcggcggaggaaagaggtgcttacgattgcgctggagagagctgtggaagccattgtagtaagaaagacttcttcgttttcttcttcttcttctgtttgtgagagtgtgtgtggctttgttgaaatggcgtacaaggagtgaggaatagaggattataaaggtggtgtgattttgaacgttatctgccacgtggcgtaagatatgtgggttattgtgtta

SEQ ID NO: 810 - DNA, 1561 bp, Brassica napus
atatttagctaagtatagacaaagtttgagagaggatttggatcgcgtcagtctctcatcagtgttgagctgccacggagcagcctgttcttgctgacaatgtcgacactctttctccaacattcttccttcttttcggtttctcacatataataaaggtttggctttctgcgcattgatcccgagaaagaagaagaatatactctctctttgttccccatgatcatcgtcgatattctttggaaatcgtttcctctgtacttgttcggtggtggatcaggaacagattctctctcagagtcaattttgcagatgatggcgtctcccaaaatcctctgtgacgccggcgaatctgacctctgcagagacgactcagctgcgtttgtactcaaattcgtagccattgcatccatcttcctatctggagcagctggtgtagccatacctctcgttggcaagaaccgccgcttccttcaaacggaagggaacctctttgtatctgctaaggcctttgcagctggtgtcatactagcaactggctttgtccacatgcttgctggtggcactgaagctctcaccaatgcttgtttgccggagttcccttggtctaagttaccatttcctgggttctttgctatggtggctgctttgatcactctacttgttgatttcatggggactcagtattatgagaggaggcaagagaggagtgatgatgctactgctgctagtgaagcttccgctgctgttggtgttgagtctggtcgtgaagaggcgtctgttgttcctgtggttgtggaaagagtgagtgatggtaataataaagtgtttggtgaagaggaaggtggcgggatgcacattgttggcatccgtgctcatgctgctcaccatagacatagtcactctaatggccttggtacatgcgatggacatgggcattcacacggacatggacatcaagatctcggaaatggagctaggcatgttgttgtttctcagatattggagcttgggattgtatctcactcaatcatcatcggtctatccctcggagtatcgcagtctccatgcacgatcagacccttaatagcagctctatcatttcaccagttctttgaagggtttgcgctcggaggctgcatctctcaagcacagtttaagaacaaatcagcgaccgtaatggcttgcttcttcgcgctgacaacgcctgtagggatcgggatcggaaccgcggtggcctcgtctttcaactcgcatagccctggagctctggtggccgagggtatactggactcgctctcggctgggatactggtgtacatggctctggtggacctgatcgcagctgatttctaagcaagaggatgagctgtaatgtgaggcttcaagttgtgtcttatgtaatgttgttccttggagctggacttatgtccgctcttgccatttgggcgtagctcttgtagattgcatgctattgatcttccgtagaaacaaataaatatacgtcctcgcaagttcttctctattttgcatcgattcatataatataaagttttagacg

SEQ ID NO: 811 - DNA, 1419 bp, Eutrema halophilum
atgatcccgacgaaatcttatacccctcaatgttcctcatcgatgttctttggaaattgcttcctctttacttcttcggatcagatagagattctctctcagcaacagagtccattttgcagatagttcctgagacaatggctgcttcgtcttcatctagcatcctttgcaacgcaggagaatcagacctttgtcgagacgattctgctgcgtttctactaaaactagtagccattgcttcaattctcatggccggagctgcaggtgtagctataccactcattggcaggaaccgccggtttcttcaaaccgatggtagtctctttgtggctgctaaagcctttgcagctggtgtgatcctatccactggatttgttcacatgctggctggtggcacagaagcgttgaccaacccttgcttacctgatttcccttggtctaagtttccttttccggggttctttgccatggttgctgctttgatcactctacttgttgatttcatggggactcagtactatgagaggaagcaagagagggaagctactgataagtctgatgaacagcctggttatgaacagtcaccgagtattgtcgttcctgtggttgctgaaggagcgaacgatgagaaagtgtttggagaagaagacaatggcgggattcacattgttggtattcatgctcatgctgctcatcatagacataatcatcctcaaggtcataattcatgtgagggacaccgtaaaatcgacattggtcatggacatggacatggtcacggtcacggacatggacacggacacgggggtttggatgtcggaagtggagcaaggcatgttgttgtttctcaggttttggagcttggaatcgtatcacactcgatcatcattggtatatctcttggagtatcacaatctccttgcacaatcagacctttaatcgcagcactatcgttccaccaattctttgaaggattcgcgctcggtggatgcatctcccaagcacagttcaggaacaaatcagcgaccataatggcttgtttcttcgccctcacgacaccgatagggatcggtattggaactgcagtggcgtcttctttcaactctcacagtgttggagcattggtcacggaaggtatcttggattcgctctcggcagggattcttgtgtacatggctcttgtggatctcatagctgctgatttcttgagtaagagaatgagctgtaactttaggcttcaaattgtttcttatttgatgttgttcctcggagctggactcatgtcttctcttgctatttgggcttagattgttaaagactccatagtttctgttatagctagctatagctttacgagacaacatgtgtatagttctagaattatcaattcaacaatttctcgcgattaaggaatgcatt

SEQ ID NO: 812 - DNA, 1420 bp, Brassica napus
ggagtttacgaggatacttctttttacgctaacttttttcatgatcccgacgagatcttcttagtcactcaatgttcttcatcgatgttctttggagtttgtttcctctatactttttcagatcagaaagagattctctctcagaaacagagtccatcttgcaggtagttcctgagacaatggttgcttcttcatccaccattctttgcaatgccagcgagtcagatctttgtcgtgacgattccgctgcgtttctgcttaaattagtagccattgcatccattctcttagctggtgctgctggtgtagctataccactcattgggagaaaccgccggttccttcgaacagacagtagtctctttgtgactgctaaagcctttgcagccggtgtgatcctcgccactgggtttgttcacatgttggctggtggcactgaggctttgaacaacccgtgcttaccggagtttccttggtctaagtttcctttcccggggttctttgcgatggttgctgctttgatcactctgcttgttgatttcatggggactcagtactatgagaggaagcaagagagggaaggtgctgatcagtctgatgaacagcttggtcttgaacagtctcctggtatcgttgttcccgtggttgtggaaggaggggacgatgatgataaagtgtttggagaagaagacaatggcgggattcacattgttggcattcacgctcatgctgctcaccatacacatagtcaccctcaaggtcacggttcttgtgatgggcaccagaaaattgacattggtcatggtcatggtcatggacacggacatggacacgcgcacggaggtttggagctcggaagtggagcaaggcatgtagttgtttctcaggttttggagctcggaatcgtgtcacactccattatcatcggcatatcacttggagtatctcaatctccatgcacaatccggcctctaatcgcagcactatcgttccaccaattctttgaagggtttgcgctcggtggatgcatctcccaagcgcagttcaggaacaagtcagcgaccattatggcttgctttttcgccctcacaacaccgatagggatcggtattggaactgcagtggcgtcgtcttttaactctcacagcgttggagcgttggtcacagaaggtatcttggattctctgtctgcagggatacttgtgtacatggctttagtggatctcatagctgctgatttcttgagtaagaggatgagttgtaactttaggcttcagattgtttcttatatgatgttgttcctaggagctggactcatgtcttctcttgctatttgggcttagattgttgagattatttcttccgttatagctgctagcctcagataatatgtatatttctagaataattaatcttgaat

SEQ ID NO: 813 - DNA, 1532 bp, Arabidopsis thaliana
cttgtatctttctccaacttgcttttgtctgatttcatcatcagatggatctgtctgattctcatatttaattcccattcgtgttttttcggattgcgagaatcctacgttatttcttcacttttcatgatcccgaggacatcttagaccccaaatgttcttcgtcgatgttctttggaaactggttcctctatacttgttcggatcagaaacaaagtctctctcagcaacagagtccattttgcagatagttcctgaggcaatggctgctacttcatctaacgtcctttgcaatgctagcgagtcagatctttgtcgtgatgattccgctgcatttctacttaaatttgtagccattgcttcgattctcttagctggagctgctggtgtaactataccactcattggcaggaaccgtcgtttccttcaaactgatggtaatctctttgtgactgctaaagcttttgcagctggtgtgattctcgccacgggttttgttcatatgttggcgggtggcacggaagctttgaagaacccgtgcttaccggatttcccttggtctaagtttcctttcccgggattctttgcgatgattgctgctttgatcactctgtttgtggatttcatggggactcagtactatgaacggaagcaagagagggaagctagtgagtctgttgaaccgtttggccgtgaacaatcaccgggtattgttgttcccatgattggagaaggaacgaatgatgggaaagtgtttggtgaagaagacagtggtgggattcacattgttggcattcatgctcatgctgctcatcatagacatagtcatcctcctggtcatgattcatgtgaaggacacagtaaaatcgacattggtcatgctcatgctcatgggcacgggcatggacacggacatggacacgtacacgggggtttggatgctgttaatggagctaggcatatcgttgtttctcaggttctggagcttggaattgtgtcacattccataatcatcggtctatcccttggagtatctcagtctccttgcacaatccggcctctaatcgcagcactatccttccatcaattctttgaaggatttgcgctcggtggatgcatctcccaagcgcaattcaggaacaaatcagcgaccataatggcttgttttttcgccctcacaaccccgatagggatcgggattggaaccgcagtggcgtcgtctttcaattctcacagtgtcggagcattggtcactgaaggtatcttggactcgctctcagccggaattcttgtgtacatggctttagtggatctcatagctgctgatttcttgagtacaaaaatgaggtgtaactttaggcttcaaattgtatcttatgtaatgttgttcctaggagctggactcatgtcttctcttgccatttgggcttaattagagtataagattccatagtttcttctatagctacaaataacatgtatagttctttctagagaatttatcaatctaagatttcacaattgctcgcaaa

SEQ ID NO: 814 - DNA, 1569 bp, Arabidopsis lyrata
ttctctctcttttcctctgatgtccccaaagggtcttcttcttcttcttcgtctctgctcttcactttcaattgtaacctcttcgtcttcttcgccgtctctggtaacaactccggcgagtcttttttttttttttttttactttgatgtgaatttgcgagatttactgtttaattcatgataacaattttagatttttgatcggatgtgaaattcagagtttttcataacaaacgagaaacaaaacaaaaatctatttttctttcttctattgtttcggaatctatgggtgaagcaagcagacaacaaagggcatggaacagagaaatgacggttacgacaaatctttctttagacatagacaaatacccgagagatctgttacgaggtttcatgtctgaaaacggcggtggaagagcctttcacggcggagaattaggctgcgatgatgagagtgccattgagctgaatcttgggttgtctttaggaggtcgattcggagtagacaagactccgaggaagctgaaacgatcttcttctgttttggacactgtaccattcaacgattcaacggtggctgagcctgagaattacacggtgggtttagagagaacgacgtcgttaccggcggagatggaagaggaatggaggaaaaggaaagagatgcaatctcttagagaatggaagctaagagaaggagatgtgagaaacagagtttcagagttgggaattctgatgaccaaacggtgtcgtttgagaatgagagatgggttactgcgagtaaaagtggcttcttgcagagacatttggtttcttctaatagacaagtgtgtggtgttgattccgatggaggaggtggaacaggaggaggtagctcatcgagcttgtcggaactagacaacaagaatcagcaaggatcatctaacagctgcaatgatgaaagaagcccgaagatcgtggcaggatgttcttcgaacagcggaagccagggaacagagaaaccgagtgtgactagagccgacaaagtgaatgagaatgagaaaggagtgagaaaagaggactcggtggataggaaaggaaaagggatggctacgtctactggtttggttgacatgccttgtgtgtttacgaaaggggatgggccaaacggaagacgggttgacgggattttgtacaagtatggaaaaggagaggaagtgaggataatgtgcatttgccacggtagtttcttgacaccagctgagtttgttaaacacggtggcggaggagatgtggatcgtcctctacggcatatcgttgtcaacacttcttcttcgaccttttaaatagaagaatcggtaaagaaaccagaggtcttttgttctttgtttcatttttcttgttgttttatcttttaaatctctagtttttggctataaaaatgaatgccaaatctcaatcttgatgaagatcaagattctcttgttttaggtctattacttgtgagttgtgaacatgaaagtatcatcatcaaatgattctttctcaagctctcgcgtgtaatttaaggcctctctgcaaagtgcgtat

SEQ ID NO: 815 - DNA, 1622 bp, Eutrema halophilum
ccggccacgtgtcgttcaggcagctctctcggcggccacttgcctcctctcagtcaaggagctgtctctctttcttcttctttttctcttttatctctctaatgtctaaaaagggttttcttcttcttctccgtctctactcttcaactgtcgattttacctcttcgtcttcttcgccatctctggtaactccggcgagttctgttccataattattttctccgtatgtaattgttccattatatgtttatttcatgattttgtgagattttctgtggaattctgattttgacctgatgtgacattcagaattttcatttcttctttaagtaaggagaacaaaaaaaaaaatctcgtttctctttccgtttctgttgttccggaatctatgggggaagaagcaagcagacaacaaagggcatggaacagagaaatgacggtgtcgacaaatctttctctggacatagataaatacccgagagatctgttacgaggttttatgtctgaaaacggcggtggaagatcgtttcatggtggagaaacagactgcgatgatgagagtgcgattgagctgaatctgggtttgtctttaggaggtcgattcggagtagacaagactccaaggaagctcaaacgatcttcctctgttatcggaactgtgccgtttgatgactcgacgacgtttgtgtccgagacggaggtcgagccggagaattacacggtgggtttagctagaacgacgtcgttaccggcggagatggaagaggaatggaggaaaaggaaagagatgcagtcgctgaggagaatggaagctaagaggaggagatgtgagaaacagagtttcagagttgaccaaacgccgtcgtttgagtccgagagatgggccactgcgagtaaaagcgggtttttgcagagacatttggtttcttctaatggacaagtgtcttttgattccgatggaggaagaggaggaggaggcagctcttcatgcttgtcagagctggacaacaagaatcaacaaggttcatcaaacagttgcggtgacgaaagaagcccgaagatcatgacaagatgttcttctactagcggaagccaaggaacggagaaaccaagagcgaatgagaaggagaatgagaaaggagtgagaagagaagatgaatctgtggataggaaaggcaaaggcacggctacgtctactggtttgttcgacatgccttgtgtgtttaccaaaggagacggtcctaacggaagacgtgttgatgggattctgtacaagtacgggaaaggagaggaagttcggataatgtgcatttgccatggcagtttcttgacacccgctgagtttgttaaacatggtggaggaggagatgtggatcgtcctcttcggcatatcgttgtcaatacttcttcgtcaacgttttgaaacaaagaaagaaccggatgtgtatttctcttcttgtttcatttcttgttgtttttatctttcggatttctgcttagtttggctttgagaatgaaaatgccaaatctcaatcttggtgttgaggattaggatgaagatcaagattctcttgtattttaagtgtaatacatgagaacatcaaaagaaccatcaaatgagt

SEQ ID NO: 816 - DNA, 1419 bp, Eutrema parvulum
tttataatatgttcctattttgtgaaattatgagattttttgggtgaaattcatgataaaaatctttcattttgactggatgtgatatcagattatttcatttcttcatcatcagagtaacaagaaaaaagtcttttttttttttaattttctgttgtttcgtaatctatgggggaagaagcaagtagacaagaaagggcatgtaacagagaaatgactgtaacgacaaatctttctctggacataaacaaatacccgagagatcttttacgaggttttacgtctgaaaacggcggtggaagagcgattcacggaggtgatgaaacattggactgcgaagatgagactgcaattgagctgaatctgggtttgtctttaggaggtcgattcggagtagacaagactccgagaaagcttaaacgatcttcttctgttttgggcactgtgccgtatgatagttcgattgtggctgagagggaggctgagccggagaattacgcggtgggtttagcgagaacgacgtcgttgccggcggagatggaagaggaatggaggaaaaggaaagagatgcagtcgcttaggagaatggaagctaagaggaggagatgtgagaaacagagcttcagagttgggaattctgatgaccaaacgtcgtcgtttgagactgagagatgggtcactgcgagtaaaagtgggtttctgcagagacatttggtttcttctaatagacaagtgtgcgttgattccgatggcgcaagaggaggaggtagctcttcaagcttgtcggagctggacaacaagaatcaacaaggttcatcaaacagttgtggtgaggaacgaagcccgagaatcatgacaagatgttcatctaacagcgaaagccacggaacagagaaaccgagagcgaacaaaggggatgagaaaggagtgagaagagaggatgagtctgtggataggaaaggcaaagggacggctgcagctactggtttgtttgacatgccgtgtgtcttcaccaaaggagacggaccaaacggaagacgagttgacgggatactatacaagtacgggaaaggagaggaagtccggattatgtgcatttgccatgggagtttcttgacacccgccgagtttgttaaacacggtggtggaggagatgtggatcgtccgcttcggcatatcgttgtcaatacttctccttccaccttttgaatcgaagaatcggtaaaaactggaacttgtctcttcttctagttgtttttcttttctttttttaaatcttttttggatttcttctgcttcgtttggctataagaatgaagtgccaaatctcaatcttgatgaagatcaagattctcatgttttttaggtgtattacttgagaacatcaaagaatcatcaaatgatttaatgattcttgct

SEQ ID NO: 817 - DNA, 920 bp, Arabidopsis lyrata
tttgacctgaagggatttggaaaaaccctctctcactctcaggctcaagcgccggcgttctctagccaaattcgatttcgtttctaagttgcgatcgagaaatgcagagatcatctttgcggctactagctaaacctctcttggagagcaagcgagggttttgcacgagctccgataagatcgtagcttcggtgcttttcgagagattgcgcgttgtcatacccaaaccggatcctgctgtttacgctttccaggagttcaaattcaattggcaacagcagtttcgtcgtagatatccagatgagttcttggacattgctaagaacagagccaagggtgaatatcaaatggactatgtacctgctcctagaattacagaggctgacaagaataacgataggaagtcattatatagagctctagacaaaaagttgtatcttctcatcttcggcaagccatttggagctactagtgacaaacctgtctggcatttcccagagaaagtctacgattctgagccaactcttcgcaagtgcgcggaatctgctttgaagtcagtcttaggagacctcactcacacatactttgttggaaatgctccaatggctcacatggccatacaacctacagaagaaatgcctgatttgccatcttacaagaggttcttcttcaaatgcagtgtagtagcagcatcgaaatacaacataagcaactgcgaggattttgtgtgggtaaccaaagacgagcttttggaattcttcccggagcaagcagaattcttcaacaagatgatcattggctgagtcactcgcaccacaaaaactgctattttgaatcccttctccatcactgtgatctttctggtattaaatggtgtgtgaaggtcagtgtaataaccagacaaaaccatgtctctggtt

SEQ ID NO: 818 - DNA, 1105 bp, Eutrema halophilum
tctctagcaaaagtcgattcctttttttttgttctactggtttctgcgttgagattgagaaatgcgatcatctttgcggcttctagctgggtctctcttagagagcagacgagggttttgtacgagctccgataagctcgtagcttcggtgctttttgagagattgcgcgttgtgatacccaaaccggatcctgctgtttacacttttcaggagttcaaattcaattggcaacagcagtttcgtcgtagatacccggatgagttcctggacatagctaagaacagagccaagggtgaataccagatggactatgtacctgctcctagaattacagaggctgacaagaaaaacgataggaagtcattatatagagctcttgacaaaaagctgtatcttctcatcttcggcaagccatttggagcaactagcgacaaacccgtctggcatttcccagaaaaagtctacgattctgagccaactcttcgcaagtgcgcggaatctgctttggagtcagtcttaggagacctcactcacacatacttcgtcggaaatgctccaatggctcacatggttatacaacctacagaagaaacaccagatttgccatctttcaagaggttcttcttcaagtgcagtgtagttgcagcatcgaaatacaacataagtaactgcgaggattttgtgtgggtaactaaagatgagcttttggaaattttccctgagcaagctgagttcttcaacaagatgatcattagctgagtcacactcacaccacaaaactcctatttgaatctcttcttcatcatcactctaataaccagaccaaaccatgtctctggatttttgtgaaggatttttttgttgttgttgacagttgatcagaagtagttcaatgtagtttggcttttttatacatctctcggatgcacatcacaagaaagagtggatcttgagaagaaatcacatttatttacgctacatcagtttcaatctcatttttgttacaaatcaaattacaattagtcaacaaaagaaagaaatcaattgtagttcctagcccactgggccaagattgaagatgttagattattattattttttttt

SEQ ID NO: 819 - DNA, 774 bp, Eutrema parvulum
tctctagcaaaagtcgattcctttatttttgtttggtttattgcgttaagattgagaaatgcgaccatctttgcggtttctagctgggcctctcttggagtgcaggcgaggtttttgcacgagctccgataagatcgtagcttcggtgctttttgagagattgcgcgttgtgatacccaaaccagatcctgctgtttacgcttttcaggagttcaaatttaactggcaacagcagtttcgtcgtagatacccagatgagttcttggacatagcaaagaatagagccaagggtgaataccaaatggactatgtacctgctcctagaatcacagaggctgacaagaaaaacgataggaagtcattatacagagctcttgacaaaaaattgtatcttctcatcttcggcaagccatttggagctactagcgagaaacccgtctggcatttcccagaaaaagtttacgattctgagccaactcttcgcaagtgcgcggaatctgctttgaagtcagtattaggagacctcacttacacatactttgttggaaatgctccaatggctcacatggttatacaacctacagaagaaacgcctgatttgccagcttacaagaggttcttcttcaaatgcagtgtagtagcagcatcgaaatacaacataaataattgcgaggattttgtgtgggtaaccaaagatgagcttttggaattcttccctgagcaagctgaattcttcaacaagatgatcattagctgagtcacactcacaccact

SEQ ID NO: 820 - DNA, 811 bp, Brassica napus
gaagaagggagaagaaaaaccctcaagccggcgttctcttctctctttctttttttttctttttggtcatttgagattagagggagatgcagagattgagatcttctcagttactaagaaggcctctgttggagagcaggaggcttggaggagggtattgcacgagctcctcctccgaaaagatcgtagcttcggtgcttttcgagagattacgcgttgtgattcccaaaccagatcctgctgtctacgcctttcaggagttcaaattcaattggcaacagcagtttcgccgtagatacccagatgagttcttggacattgctaagaacagagccaaaggtgaatatcaaatggactatgtacctgctcccagaatcactgaggctgacaagaataacgacaggaagtcattatacagagctcttgacaaaaagttgtatcttctcatcttcggaaagccatttggagctactagtgacaaacctgtctggcatttccctgagaaagtgtatgattctgagccaactcttcgcaagtgcgctgaatctgctttgaagtcagtgttaggagacctgactcacacatactttgttggaaatgctccaatggctcacatggctattcaacctactgaagaaacacctgatttgccgtcttacaagaggttcttcttcaaatgcagtgtagtagcagcgtccaagtacaacataagtaactgcgaggattttgtgtgggttaccaaagatgagcttttggagttcttccctgagcaagctgagttcttcaacaagatgatcattagctgagacta

SEQ ID NO: 821 - DNA, 1007 bp, Eutrema parvulum
cctcagtcgccggcgttctgtctctgttcgatcttatcgacttccgttgcaaagtcgactcctttttcattagagattgagaaatgcagagactgagacctcggttactgcttgggcctctcttgaagagcaggcgagggtattgcacgagctctgataagctcgtagcttcggtgctttttgagagattgcgcgttgtgatacccaaaccggatcctgctgtttacgcttttcaggagttcaaattcaattggcaacagcagtttcgccgtagatacccagatgagttcttggacatagctaagaacagagccaagggtgaataccaaatggactatgtgcctgctccgaggattacagaggctgacaaggaaaacgataggaagtcattatatagagctcttgacagaaaattgtatcttctcgtcttcggcaagccatttggagctactagtgacaatcctgtctggcatttccctgaaaaagtttacgattctgagccaactcttcgcaagtgcgctgaatctgctttgaagtcagtcttaggagacctcactcatacatactttgtgggaaatgctccaatggctcacctggctatacaacctacagaagaaacacctgatttgccatcttacaagaggttcttcttcaaatgcagtgtagtagcagcatcgaaatacaacataagtaactgcgaggattttgtgtgggtaaccaaagatgagcttttggaattcttccctgagcaagctgaattcttcaacaagatgatcattagctgagtcactcacaccaacaaaaattcctttttttccttttctcttcccttctggttctcttgaggaagatggaaaaaaaacataaactttaagacatacacatggtgtatgaaggtcactgtaataaccagaccaaaccatgtctctggtgttttagtcatacacgtgtgaggttacgtgaaggaattctttttgttgacattcagtggcagttgatcggaagta

SEQ ID NO: 822 - DNA, 988 bp, Brassica napus
cctcaagccggcgttctcttctctctttctttttttttctttttggtcatttgagattagagggagatgcagagattgagatcttctcagttactaagaaggcctctgttggagagcaggaggcttggaggagggtattgcacgagctcctcctccgaaaagatcgtagcttcggtgcttttcgagagattacgcgttgtgattcccaaaccagatcctgctgtctacgcctttcaggagttcaaattcaattggcaacagcagtttcgccgtagatacccagatgagttcttggacattgctaagaacagagccaaaggtgaatatcaaatggactatgtacctgctcccagaatcactgaggctgacaagactaacgacaggaagtcattatacagagctcttgacaaaaagttgtatcttcttatcttcggcaagccctttggagctactagtgacaaacctgtctggcatttccctgagaaagtgtatgattctgagccaactcttcgcaagtgcgctgaatctgctttgaagtcagtgttaggagacctgactcacacatactttgttggaaatgctccaatggctcacatggctattcaacctactgaagaaacacctgatttgccatcttacaagaggttcttcttcaaatgcagtgtagtagcagcgtccaagtacaacataagtaactgcgaggattttgtgtgggttaccaaagatgagcttttggagttcttccctgagcaagctgagttcttcaacaagatgatcattagctgagactagtcactcactcaccaccaccaaataaactccttttttatttctcttttgccttctagttctcctgaggaagatagaaaaactttttaagacattagtatggtgtgtgaagaaggtctttgtaataattagaccaaacgatgtctcttgttttgtagtcacgcacatgtggtgtgtgcggtcacatgaaggttttttt

SEQ ID NO: 823 - DNA, 1107 bp, Brassica napus
ggagaagaaaaaccctcaagccggcgttctcttctctctttctttttttttctttttggtcatttgagattagagggagatgcagagattgagatcttctcagttactaagaaggcctctgttggagagcaggaggcttggaggagggtattgcacgagctcctcctccgaaaagatcgtagcttcggtgcttttcgagagattacgcgttgtgattcccaaaccagatcctgctgtctacgcctttcaggagttcaaattcaattggcaacagcagtttcgccgtagatacccagatgagttcttggacattgctaagaacagagccaaaggtgaatatcaaatggactatgtacctgctcccagaatcactgaggctgacaagaataacgataggaagtcattatacagagctcttgacaaaaagttgtatcttctcatcttcggaaagccatttggagctactagtgacaaacctgtctggcatttccctgagaaagtgtatgattctgagccaactcttcgcaagtgtgctgaatctgctttgaagtcagtcttgggagatctgactcacacatactttgttggaaatgctccaatggctcacatggctattcaacctactgaagaaacacctgatttgccgtcttacaagaggttcttcttcaaatgcagtgtagtagcagcgtccaagtacaacatacgtaactgcgaggattttgtgtgggttaccaaagatgagcttttggagttcttccctgagcaagctgagttcttcaacaagatgatcattagctgagactagtcactcactcaccaccaccaaataaaactcctttttattttctcttttccttctagatagttctcctgaggaagatagaaaaactttttaagacattaatatggtgagtgaaggtctttgtaataattagaccaaacgatgtctcttgtttttgtagtcacgcacatgtggtgtgtgagcctgtgaggtcacaaaagggtttttttatgttgacttttggcagttgattggaactcaggaagtacgtagttgaatgtagttggcttctcaacatatttatacttaaaattcatctcggatac

SEQ ID NO: 824 - DNA, 1116 bp, Brassica rapa
gaaaccaagaagggagaagaaaaaccctcaagccggcgttctcttctctctttctttttttttctttttggtcatttgagattagagggagatgcagagattgagatcttctcagttactaagaaggcctctgttggagagcaggaggcttggaggagggtattgcacgagctcctcctccgaaaagatcgtagcttcggtgcttttcgagagattacgcgttgtgattcccaaaccagatcctgctgtctacgcctttcaggagttcaaattcaattggcaacagcagtttcgccgtagatacccagatgagttcttggacattgctaagaacagagccaaaggtgaatatcaaatggactatgtacctgctcccagaatcactgaggctgacaagaataacgataggaagtcattatacagagctcttgacaaaaagttgtatcttctcatcttcggaaagccatttggagctactagtgacaaacctgtctggcatttccctgagaaagtgtatgattctgagccaactcttcgcaagtgtgctgaatctgctttgaagtcagtcttgggagatctgactcacacatactttgttggaaatgctccaatggctcacatggctattcaacctactgaagaaacacctgatttgccgtcttacaagaggttcttcttcaaatgcagtgtagtagcagcgtccaagtacaacatacgtaactgcgaggattttgtgtgggttaccaaagatgagcttttggagttcttccctgagcaagctgagttcttcaacaagatgatcattagctgagactagtcactcactcaccaccaccaaaataaaactccttttttattttctcttttccttctagatagttctcctgaggaagatagaaaaactttttaagacattaatatggtgagtgaaggtctttgtaataattagaccaaacgatgtctcttgtttttgtagtcacgcacatgtggtgtgtgagcctgtgaggtcacaaagggttttttttttatgttgacttttggcagttgattggaactcaggaagtacgtagttgaatgtagttggcttctcaacatatttatacttaaaattcatct

SEQ ID NO: 825 - DNA, 737 bp, Brassica napus
attatagagaaatgcagagattgagatctcagctactggctaggcctctcttagagagcaggcttcgagggtattgcacgagctcctcatcagaaaagatcgtagcttcggtgcttttcgagagactgcgagttgtgataccaaaaccagatcctactgtatacgcatttcaggagttcaagttcaattggcaacagcagtttcgccgtagatacccagatgagttcttggacattgctaagaacagagccaagggagaatatcaaatggactatgtgcctgctcccagagttacagaggctgacaagaataacgacaaaaagtcattatatagagctctggacaagaagttgtatcttcttgtcttcggcaagccatttggagcaactagcgacaaacctgtctggcatttccctgaaaaggtctacgattctgagcctactcttcgcaagtgtgcggaatctgctttgaagtcagtgttaggagacctaacgcacacatactttgttggaaatgctccaatggctcacatggctattcaacctactgaagaaacacctgatttgccatcttacaagaggttcttcttcaaatgcagtgtagtggcagcgtctaagtacaacataagtaactgcgaggattttgtgtgggtaaccaaagatgaacttctggaattcttccctgagcaagctgagttcttcaacaagatgatcattagctaagactatgcacttttt

SEQ ID NO: 826 - DNA, 820 bp, Brassica napus
attatagagaaatgcagagattgagatctcagctactggctaggcctctcttagagagcaggcttcgagggtattgcacgagctcctcatcagaaaagatcgtagcttcggtgcttttcgagagactgcgagttgtgataccaaaaccagatcctactgtatacgcatttcaggagttcaagttcaattggcaacagcagtttcgccgtagatacccagatgagttcttggacattgctaagaacagagccaagggagaatatcaaatggactatgtgcctgctcccagagttacagaggctgacaagaataacgacaaaaagtcattatatagagctctggacaagaagttgtatcttcttgtcttcggcaagccatttggagcaactagcgacaaacctgtctggcatttccctgaaaaggtctacgattctgagcctactcttcgcaagtgtgcggaatctgctttgaagtcagtgttaggagacctaacgcacacatactttgttggaaatgctccaatggctcacatggctattcaacctactgaagaaacacctgatttgccatcttacaagaggttcttcttcaaatgcagtgtagtggcagcgtctaagtacaacataagtaactgcgaggattttgtgtgggtaaccaaagatgaacttctggaattcttccctgagcaagctgagttcttcaacaagatgatcattagctaagactatgcactttttttcctttgttatttccttctggttctcttcagtgagatagaaaacaataaaaatgaacttttaagacatacacatggtgtgtg

SEQ ID NO: 827 - DNA, 1027 bp, Brassica napus
aagaagggagaagaaaaaccctcaagccggcgttctcttctctctttcttttgtttggtcatttgagattagagagaaatgcagagattgagatctcagcagttactaagaaggcctctctgggagagcaggaggcttggaggagggtattgcacgagctcctcctccgaaaagatcgtagcttcggtgcttttcgagagattacgcgttgtgattcccaaaccagatcctgctgtctacgcctttcaggagttcaaattcaattggcaacagcagtttcgccgtagatacccagatgagttcttggacattgctaagaacagagccaagggtgaatatcaaatggactatgtacctgctcccagaatcactgaggctgacaagaataacgataggaagtcattatacagagctcttgacaaaaagttgtatcttctcatcttcggcaagccttttggagctactagtgacgaacctgtctggcatttccctgagaaagtgtatgattctgagccaactcttcgcaagtgtgctgaatctgctttgaagtcagtgttaggagacctgactcacacatactttgttggaaatgctccaatggctcacatggctattcaacctactgaagaaacacctgatttgccatcttacaagaggttcttcttcaaatgcagtgtagtagcagcgtccaagtacaacataagtaactgcgaggattttgtgtgggttaccaaagatgagcttttggagttcctccctgagcaagctgagttcttcaacaagatgataattagctgagaagagtcactgagtcacagcacaaaataaactcctttttcttttctcttttccttctagttctcctgaggaagatagaaaaactttttaagacattatatatcgtgtgtgaaggtctttgttataactaagaccaaacgatgtttcttgttttgtagtcacgcacatgtggtgtgtgaggtcacattaggtttttttttatgttgacttagggctgggacaaaaaacc

SEQ ID NO: 828 - DNA, 926 bp, Brassica napus
gcacgagggtcaggatactcggttctcacccgagagacccgggtacgagatccggcaacggagcaaacgtttttaaatatttttttttgttattatatagcaaaccggattgtgtttcagtaaaccaagaagggagaagaaaaaccctcaagccggcgttctcttctctctttcttttgtttggtcatttgagattagagagaaatgcagagattgagatctcagcagttactaagaaggcctctctgggagagcaggaggcttggaggagggtattgcacgagctcctcctccgaaaagatcgtagcttcggtgcttttcgagagattacgcgttgtgattcccaaaccagatcctgctgtctacgcctttcaggagttcaaattcaattggcaacagcagtttcgccgtagatacccagatgagttcttggacattgctaagaacagagccaagggtgaatatcaaatggactatgtacctgctcccagaatcactgaggctgacaagaataacgataggaagtcattatacagagctcttgacaaaaagttgtatcttctcatcttcggcaagccttttggagctactagtgacgaacctgtctggcatttccctgagaaagtgtatgattctgagccaactcttcgcaagtgtgctgaatctgctttgaagtcagtgttaggagacctgactcacacatactttgttggaaatgctccaatggctcacatggctattcaacctactgaagaaacacctgatttgccatcttacaagaggttcttcttcaaatgcagtgtagtagcagcgtccaagtacaacataagtaactgcgaggattttgtgtgggttaccaaagatgagcttttggagttcctccctgagccagctgagttcttcaacaagatgataattagctgaga

SEQ ID NO: 829 - DNA, 740 bp, Brassica rapa
  misc_feature (37)..(37): n is a, c, g, or t
  misc_feature (60)..(61): n is a, c, g, or t
  misc_feature (73)..(73): n is a, c, g, or t
  misc_feature (82)..(82): n is a, c, g, or t
  misc_feature (514)..(514): n is a, c, g, or t
cttttttgtgcatttgagagatagagaagaaatgcanagattgagatctcagctactggnnaggcctctcttngagaggagnctgcgagggtattgcacgagctcctcatccgaaaagatcatagcttcggtgcttttcgagagactgcgagttgtgataccaaaaccagatcctactgtatacgcatttcaggagttcaagttcaattggcaacagcagtttcgccgtagatacccagatgagttcttggacattgctaagaacagagccaagggagaatatcaaatggactatgtgcctgctcccagagttacagaggctgacaagaataacgacaaaaagtcattatatagagctctggacaagaagttgtatcttcttgtcttcggcaagccatttggagcaactagcgacaaacctgtctggcatttccctgaaaaggtctacgattctgagcctactcttcgcaagtgtgcggaatctgctttgaagtcagtgttaggagacctaacncacacatactttgttggaaatgctccaatggctcacatggctattcaacctactgaagaaacacctgatttgccatcttacaagaggttcttcttcaaatgcagtgtagtggcagcgtctaagtacaacataagtaactgcgaggactttgtgtgggtaaccaaagatgaacttctggaattcttccctgagcaagctgagttcttcaacaagatgatcattagct

SEQ ID NO: 830 - DNA, 889 bp, Brassica napus
gaatcttatcgactacttccgttttcaaagtctgctcctttttggtgcattttgagattatagagaaatgcagagattgagatctcagctactggctaggcctctcttggaggagagcaggctgcgagggtattgcacgagctcctcatccgaaaagatggtagcttcggtgctttttgagagactgcgcgttgtgataccaaaaccagatcctactgtttacgcctttcaggagttcaagttcaattggcaacagcagtttcgccgtagatacccagatgagttcttggacattgctaagaacagagccaagggagaatatcaaatggactatgtgcctgctcccagagttacagaggctgacaagaataacgataaaaagtcattatatagagctctggacaagaagttgtatcttctcatcttcggcaagccatttggagctactagtgacaaacctgtctggcatttccctgagaaagtctatgattctgagcctactcttcgtaagtgtgcggaatctgctttgaagtcagtgttaggagacctaactcacacatactttgttggaaatgctccaatggctcacctggctatacaacctactgaagaaacacctgatttgccttcttacaagaggttcttcttcaaatgcagtgtagtggcagcgtctaagtacaacataagtaactgcgaggattttctgtgggtaaccaaagatgagcttctggagttcttccctgagcaagctgacttcttcaacaagatgatcattagctgaggctactctcttttttcctcttttttcctttgttatttccttccggctctcttcatggagatagaaaacaataaaacatgaacttttaagacatacacaaggtgtgtg

SEQ ID NO: 831 - DNA, 925 bp, Brassica napus
agattatagagaaatgcagagattgagatctcagctactggctaggcctctcttggaggagagcaggctgcgagggtattgcacgagctcctcatccgaaaagatggtagcttcggtgctttttgagagactgcgcgttgtgataccaaaaccagatcctactgtttacgcctttcaggagttcaagttcaattggcaacagcagtttcgccgtagatacccagatgagttcttggacattgctaagaacagagccaagggagaatatcaaatggactatgtgcctgctcccagagttacagaggctgacaagaataacgataaaaagtcattatatagagctctggacaagaagttgtatcttctcatcttcggcaagccatttggagctactagtgacaaacctgtctggcatttccctgagaaagtctatgattctgagcctactcttcgtaagtgtgcggaatctgctttgaagtcagtgttaggagacctaactcacacatactttgttggaaatgctccaatggctcacctggctatacaacctactgaagaaacacctgatttgccttcttacaagaggttcttcttcaaatgcagtgtagtggcagcgtctaagtacaacataagtaactgcgaggattttctgtgggtaaccaaagatgagcttctggagttcttccctgagcaagctgacttcttcaacaagatgatcattagctgaggctactctcttttttcctcttttttcctttgttatttccttctggctctcttcatggagatagaaaacaataaaacatgaacttttaagacattcacaaggtgtgtgaaggtcactgtaataccccataccaaacccatgtctctgttttttttagtcgcacacacgtgtgaagttaggtgacggacattaggtggc

SEQ ID NO: 832 - DNA, 875 bp, Raphanus sativus
  misc_feature (203)..(203): n is a, c, g, or t
  misc_feature (416)..(416): n is a, c, g, or t
  misc_feature (743)..(743): n is a, c, g, or t
tgtcaaagtctgctccttttttttttggttgtcattttggggagagagagagagaaatgcagagactgagatctcagctactggctaggcctctcttggaggagagcagcaggctgcgagggtattgcacgagctcctcctcatccgaaaagatcgtagcttcggtgcttttcgagagactgcgagttgtgataccaaaaccngatcctaacgtttacgcttttcaggagttcaaattcaattggcagcagcagtttcgccgtagataccctgatgagttcttggacattgctaaaaacagagccaagggtgaatatcaaatggactatgtccctgctcccagagttacagaggctgacaagaataacgataggaagtcattatatagagctctggacaagaagttgtatcttctngtcttcggcaagccatttggagctactagtgacaaacctgtctggcatttccctgaaaaactctacgattctgagcctactcttcgcaagtgtgctgaatctgctttgaagtcagtcttgggagacctcactcacacctactttgttggaaatgctccaatggctcacatggctatacaacctactgaacaaacacctgatttgccatctttcaagagattcttcttcaaatgcagtgtagtagcagcatcgaagtacaacataagtaactgcgaagactttgtgtgggtaaccaaagatgagcttttggagttcttccctgaccangctgagttcttcaacaagatgatcattagctgagagactagtcaacccacaccaacaaaaactcctctctctttttttttccttgtggttctcttttagtatgatagaaaacaataatacatgaactttacc

SEQ ID NO: 833 - DNA, 988 bp, Raphanus sativus
  misc_feature (51)..(51): n is a, c, g, or t
  misc_feature (62)..(62): n is a, c, g, or t
ggaagccggcgttttgtctctgtttctgtcaaagtcgactccttttttttngagattagagngagagaaaatgcagagaatgagatcttgtcggtcactggtgaagcctctcttggaggagagcagcaggcttcgagggtattattgcacgagctcctcagaaaagatcgtagcttcggtgcttttcgagagattacgcgttgtgattcccaaaccagatcctgccgtctacgcctttcaggagttcaaattcaattggcaacagcagtttcgtcgtagatacccagatgagttcttggacattgctaagaacagagccaagggtgaatatcaaatggactatgtgcctgctcccagaatcacagaggctgacaagaataacgataggaagtcattatatagagctcttgacaagaaattgtatctactcatcttcggcaagccatttggagctactagtgacgaacctgtctggcatttccctgaaaaagtctacgattctgagcctactcttcgcaagtgcgctgaatctgctttgaagggagtcttgggagacctaactcacacttactttgttgggaatgctccaatggctcacatggctattcaacctacagaagaaacacctgatttgccatcttacaagaggttcttcttcaaatgcagtgtagtagcagcatcgaagtacaacataagtaactgcgaggattttgtgtgggtaaccaaagatgagcttttggagttcttccctgagcaagctgatttcttcaacaagatgatcattagctgagagactagtcactttcactacaaaataaaactttttttctcctcttttccttctagttctaccgaggaagatagaaaaactttttaagacattacatatggtgtatgaaggtctttgtaataacttagatcaaaccatgtccttgttttgtagtcacacacatgtggtgtgaggtttacgttatgcgaaccctaaaca

SEQ ID NO: 834 - DNA, 767 bp, Arabidopsis lyrata
ctcaaaaatggtggaggtgccgtgccgtcaattgatgtcacgtgtcctgacaatgcattctcaatacaaacaaatactctctacctaaaaaaaacaataaacaaacagaacacatctttggagcgtcggtgaggttggaggagaagggtttgtgaaatggagtcgagtgaggatgtggagaatctgagtagagctatcgagaagcttcttattgagaagaggaagagagaagcttctggtgacgctttcattgaagacgacgatgatcagcttttgctctctaggcttatctctcagttggaatcaccaaagtccaaggaaaaagcaggtgtgataaccaaagaagaagaagaatctgcaccatccaaaggaaaacgcgagggccagagacaattggaagagagtatagaagaattagctaaggacatcaagaaggtgaagaagcagaacacaataacccatgtacttctctcggctgtgatcatcctgacattgacttggcagctctctgagtactcgatgattttcatgttgaaagatagaataagccacccagtcagatccatcggaggtatgcttaacgggatgttcaaaggtaagttacgtccaatcaagaaccaacttgcggggacttccaactccaatgaccaaaacaaccatgggaatggaacacaaattggacctcaacttcaagtaccagagttgttgcgagaattcggtttcgacgacgatgaataatgatactttcctttgtgactcaataatac

SEQ ID NO: 835 - DNA, 2361 bp, Arabidopsis lyrata
aacggaaaatgtttaagaaaattgtgttgatttgagatttctcgaagtgccggtgagccattagggttccggtgtactctgaatctgtcgcgtcgttcgtcggagaataaatttcgttgtagagagattttagactgaagctaagcagaaattgcagtttacagtttccttttgtcgattgttgaacttgataggatcttagagtgtttctctgcgatatggcgaatcttccgatccttcaatttgaagagaagatcgtggaaacagtggagaagaactcagtagtagttataattggagaaaccggttctgggaagagtactcagctctctcagatacttcatcgacatggttacacaaagtccggcgtcatcgccatcactcagccccgacgtgtggctgccgtttccgttgccaggcgagtcgcacaggagcttgatgtaccccttggagaagatgttggttatgctatacgtttcgaggacagaacttcgaccaaaacacggattaagtacctcacagatggagttctacttcgtgagagtctgtccaatccaatgcttgatgattattctgtaatcatattggatgaggctcacgagaggagtttaaacacggatattctgttgggtctagtgaaacggttggttagaatccgtgcatccaactttaaagttcttataacctctgcaacacttgacggtgaaaaggtttctgaattcttttcgggatgccctgtgctgaatgtacctggaaaattataccctgtggaaatattatacagcaaagagcgtcctgtcagttatattgagtcatctctgaaagtagcaattgatatacatgttcgtgagccaggaggtgatatcttaatcttcatgactggacaggatgatatagaaaaattagtatcaaagctagaggaaaaagtacgaagcttagcagaaggatcatgtatggatgctattatctatcctcttcacggttctttgccacctgaaatgcaggttcgtgtatttagtcctcctcctccaaactgccggagatttattgttgctacaaatattgctgaaacttcccttactgtggacggggttgtgtatgtaattgattccgggtatgtgaagcaaagacaatataacccatcaagtggaatgtattctcttgatgttattcaaattagcaaagtgcaagctaaccaacgtgctggacgtgctggcagaacaagacctgggaaatgttatcgtttatacccattggcagtctaccgagatgacttccttgatgcaactattcctgaaatacaacgaacttctcttgccgggagtgttctatacttgaaatcgttggatcttcctgatattgacattctcaagttcgattttcttgatgctccttcatctgagtcattagaagatgcgttgaagcaattgtatttcattgatgcaattgatgagaatggagcaataacaaggattggacggacaatgtctgagcttccactagaaccatcattgtcaagaacattgatagaagcgaatgaaaacggttgcttatctcaagctctaacagtcgttgctatgctgtcagcagagactactcttcttcctgctaggagtaaacccagtgaaaagaagaggaagcatgatgatgattctaatcttcctaatggatccggatttggtgatcacattcaactgctacagattttcgaatcttgggaccgtactaattatgatcctgcatggtgcaaagagaacggcatgcaggtgcgagggatggtgtttgtcaaagatgttagaagacagttatgtcagattatgcagaaaatatccaaagatcgattggaagttggggcacatggtaggaagagttcaagccgagacgactacaggaagttgaggaaagctctatgcgttggtaatgcaaaccaaattgctgagagaatgcttcgtcacaatggataccggactcttagtttccagtcccagctagtccaggtgcatccatcatctgtgttgagtgccgacaacgacggaatgttgccaaattacgtagtgtaccatgagctgatttccaccacacgtccgttcatgcggaacgtttgtgcagtagacatgtcatgggtggctcccatcaaaagaaagatcgagaaattaaatgtcagaaaactgagcggtggaccggctccctctttcaagaaacctgaagagaagatggagttgtctaagaacgatgcagaaacacctgcagtttctgaaaatgtcgatagtcggattgaagcagccagagaacggtttcttgctcgtaaaggacagaaataaatttgatgtctcaaacataaatacaaaattcaactagccc

SEQ ID NO: 836 - DNA, 2487 bp, Eutrema halophilum
gtttatgaaacttgtgttgatttgaatttgttgaagtgccggagtgcgatttgggtctactgtgaaactatcgtcgttcgtcggagaatgaatttcgttgtagatgagattttagagtgaagctaaggcagaaatcaacagttacagcttcgtttcttcgagtgcttttctgtgatatggcgaatcttccgatccttcaattcgaagagaagatcgttgaaacagtggagaagaacccagtggtagttataatcggagaaaccggctctggaaagagtactcagctctctcagatacttcatcgacgtggctacacaaagtccggcgtaatcgccgtcactcagccccgacgcgtcgccgccgtttccgtcgccagacgcgtcgcgcaggagcttgatgtgaatctcggagaagatgttggttatgcaatacgtttcgaggacagaacttcgagcaaaactcgcattaaataccttacagatggagttttacttcgtgagagtctgtctaatccaatgcttgatgattattctgtaatcatattggatgaagctcacgagagaagtttaaacacggatattctgttgggtctaatgaaacgtttggttagaatccgttcgtctaacttcaaagttcttataacctctgcaacacttgatggagagaaggtttctgaattcttttcgggctgccctgtgctgaatgtacctggaaaattgtaccccgtggaaatattatacagcaaagagcgccctggcagttatattgagtcatctctgaaagtagcaattgatatacatgttcgtgagccagaaggtgatatcttaatcttcatgactggacaggatgatatagaaaaattagtatcaaagctggaggaaaaagtacgaagcttagcagaaggatcctgtatggatgctattatttatcctcttcacggatctctgccacctgaaatgcaggttcgtgtatttagtccacctcctccaaactgccggaggtttattgttgctacaaatatcgctgaaacttcccttactgtggacggggttgtgtatgtaattgattcagggtatgtgaagcaaagacaatataacccttcgagtggaatgtattctcttgatgttattcaaattagcaaagtgcaagctaaccaacgagctggacgtgctggtagaactagacctgggaaatgttatcgattatatcccttcgcagtgttccgggatgacttccttgatgcaacagttcctgaaatacaacgaacttctcttgctgggagtgttctttacttgaaatcgttggatcttcctgatattgacattctgaagttcgattttcttgacgctccatcatctgagtcattagaagatgcgttgaagcaactgtatctcattgatgcaattgatgggaatggagctataacaagtattgggcggacaatgtctgagcttccactagaaccatcattgtcaagaacattgatagaagcaaatgaaaatggttgcttatctcaagctctaacagtagttgccatgttgtcagcagagagtaatctacttcctgttaggagcaaaccaaatgaaaagaagaggaagcatgatgaatctaatctccctgatggatccggatttggtgatcacattcaattgctacagatttttgaatgttgggaccgtaataactatgatacggaatggtgcaaacaaaatggaatgcaggtgcgagggatggtgtttgtcaaagatgttagaagacagttatgtcagattatgcaaaaaatatccaaagatcgattggaagttggggcacgtggaaggaatagttcaagccgagacgactacaggaagttgaggaaagctctatgcgttggtaatgcaaaccaagttgctgagagaatgcttcgtcataatggataccggactcttagcttcaagccccagctaatgcaggtgcatccatcatctgtgttgagtacagacaacgagggaatgttacctaattacgtagtgtaccatgagctgatttccaccacacggccgttcatgcgtaatgtttgtgtaatagaaatgtcatgggtggctcccatcaaaagaaagatcgagaaactaaatgtcagaaaattgagcggtggaccggctaactctttcaaggaacctgaggagaagacggagctgtctaagaacaacaacaatgcagaaacaacgccacctgcagtttctgagaatgttgagagtaggattgaagcggccagggaacggtttcttgctcgtaaaggacagaaataagttgatggaaaaatgtctcgagtctcaaatagggggatggagaattcaagagcttgaactagccccggtttcttttcccaaaaagaattagaaaaagaaaagttttcttgcttttttcgtatgttagcatttgtttctaactcggactagatattaggaagcctcaaacaaaaacagaatagtgctaattcacttattc

SEQ ID NO: 837 - DNA, 2327 bp, Brassica napus
gtgctgaatcgagatttctcgaggcgccggagtgcgattagggttccggtctaagcataaccagcagcttcagcttcgttttatccgattcctgaacttgattagcttccgtgagcgtttctctgcgatatggcgaatctcccgatccttcaattcgaagagaagatcgtggaaacagttgagaacaacccagtcgttgtcatcatcggagaaaccggttccggaaagagcactcagctctctcagatcctccgtcgacacggctacactaagtccggcgtcatcgccgtcactcagccccgtcgtgtcgccgcagtctccgtcgccaggcgagtcgcgcaggagcttgatgtacccctaggagaagacgttggttacgctatacgtttcgaagacagaacatcgagcaaaacacgcattaagtacctcacagatggagttttactccgtgagagcctctccaatccaatgcttgatgattactctgtgattatattagatgaagctcacgagaggagtttaaacacggatattctgttgggtctaatgaagcgtttggttagaatccgttcgtctaacttcaaagttcttataacctctgcaacgcttgacggagaaaaggtttctcgattcttttcggggtgccctgtgttgaatgtacctgggaagttgtaccctgtggagatattgtacagcaaagagcgtcccggcagttatattgagtcgtctctcaaagtggctattgatatacatgttcgtgagccagaaggtgatatcttgatctttatgactggacaggatgatattgaaaaattagtatcaaagctggaggaaaaagtgagaagcttagcagagggatcatgtatggatgctattatttatcctcttcatggatctctgccacctgagatgcaggttcgtgtgtttagtccacctcctccaaactgccggaggtttattgttgctacaaatattgctgaaacttcccttactgtggacggagttgtgtatgttattgattcggggtatgtgaagcaaagacaatataacccatcaagtggaatgtattctcttgatgttactcaaattagcaaagttcaagctaaccaacgtgctggccgtgctggtagaactagacctgggaaatgttaccgattataccccttggcagtctacagagatgatctccttgatgcaacgattcctgaaatacaacgaacttcccttgctggaagtgttctttacttgaaatcgttggatcttcctgatattgacattctcaagttcgattttcttgacgctccatcatctgagtcattagaagatgcattgaagcagttgtatctcattgatgcaattgatgagaatggagcaataacaaatattggaaggacgatgtcagagcttccactagagccatcattgtcaaggacattgatagaagcaaatgaaagtggttgcttatctcaagctctaacagtcgttgctatgttgtcagcagagactactctacttcctggtaggagtaaaccaaatgaaaataagagaaagcgtgatgaagaatctaatcttcctgatggatccggatttggtgaccacattcaactactacagatttttgaatgttgggacagtaagaattatgatattcgatggtgcaaagaaaatgacctgcaggtgcgagggatggtgtttgtcagagatgttagacgacaattatgtcagattatgcagaaaatatccaaagatcgattggaagttggagcacgtgggaggaagagctcaagccgagaggagtacaggaagttgaggaaagctctgtgtgtggggaatgcaaaccaagttgctgagagaatgcttcgtcataatggattccgaactcttaccttcaagccccagctagtccaggtgcatccagcatctgtgctgagtactgaccaggatggaatgttgccaaattatgtagtgtaccacgaactgatatccaccacacgaccattcatgcgcaatgtttgttcagttgaaatgtcatgggtagctcccatcaaaagaaagattgagaaattaaatgtcagaaaactgagtggtggacctgataactctttcaaggaacctgaagagaagaagagcacggagtcgtctacgaacaccaacaatgcagaaacacctacagtttctgaaaatgtggagagtagaattgaagcagccagagaacggtttcttgctcgtaaaggacagaaataaatagttactgtaaacagaacctcaaacagaatttaaaatcttaacttggctcaaatttttattttaagaaagaataagagttt

SEQ ID NO: 838 - DNA, 2390 bp, Eutrema parvulum
aatggaaaaggttttaggaaaattttgtcgattctgagattcttcaaagcgccggactacgattagggtttcggtctactgcgaacatatcaccgggtcgttcgttggagaatgagtgtcgttgtagattagatttttagactgaagaccaagaaggaatagaaattacagcttctctttgtcgattgctgaacttgataggttttctgtgatatggcgaatcttccgatccttcaattcgaagagaagatcgtggaaacagtggagaagaacccagttgtagttataatcggagaaaccggttctgggaagagtactcagctctctcagatacttgatcgacgtggctacacaaagtccggcgtcatcgccgtcactcagccccgacgtgtcgccgctgtttccgtggctaggcgggtcgcgcaggagcttgatgtgaatctcggagaagatgttggttatgcaatacgtttcgaggacagaacttcgagcaaaacacgcattaaataccttacagatggagttttacttcgtgagagtctctctaatccaatgctcgatgattattctgtaatcatattggatgaagcgcacgagagaagtttgaacacggatattctgttgggtctaatgaaacggttggttaagttccgttcgtctaactttaaggttcttataacctctgcaacacttgacggcgaaaaggtttctgaattcttttcgggatgccctgtgctgaacgtacctggtaaattataccccgtggaaatattgtacagcaaagagcgtcctggcagttatatagagtcatctctgaaagtagcaattgatatacatgttcgtgagccagaaggtgatatcttaatcttcatgactggacaggatgatatagaaaaattagtgtcaaagctggaggaaaaagtacgaagcttagcagaaggatcctgcatggatgctattatatatcctcttcatggatctctgccacctgaaatgcaggttcgtgtatttagtccacctcctccaaactgccggaggtttattgttgctacaaatattgctgaaacttcccttactgtagacggggttgtgtatgttattgattcggggtatgtgaagcaaagacaatataacccagcaagtggaatgtattctcttgatgttattcaaattagcaaagtgcaagctaaccaacgtgctggacgtgctggtagaactagacctgggaaatgttatcgtttataccccttggcagtctaccgggatgatttccttgatgcaacaattcctgaaattcaaagaacttcccttgctgggagtgttctttacttgaaatcgttggatcttcctgatattgacattctcaagttcgattttcttgacgctccatcttctgagtcattagaagatgcattgaagcaattgtatctcattgatgcaattgatgagaatggagcgataacaagtattggaaggacgatgtctgaccttccgctagagccatcattgtcgagaacattgatagaagcatatgaaaatggttgcttatctcaagctctaacagtcgttgcgatgttgtcagcagagactactctacttcctgtgaggagtaaacccaatgaaaagaagagaaagcatgatgaatctactcttcctgatggatccggatttggtgaccacattcaactactacaaatttttgaatgttgggaccgtaataattataatactgaatggtgcaaagaaaatggcatgcagatgcgagggatggtgtttgtcagagatgttagaaaacaactttgtcaaattatgcagaaaatatccaaagatcgattggaagttggggcacgtggaaggaagagttcaaaccgagatgactacagaaagttgaggaaggctctatgtgtgggtaatgcaaaccaagtggctgagagaatgcttcgtcataatggatttcgaactcttagcttcaagccacagctagtccaggtgcatccatcatctgtgctgagtaccgacaacgaaggaatgttgccaaattatgtagtctaccacgagctgatttctaccacacgaccgttcatgcgcaatgtttgttcaattgaaatgtcatgggtggctcccatcaaaagaaagatccagaaattaaatgtcagaaaactgagcggtggactggataactctttcagcgaacttgaggagaagaagactgacttgtctaggaatatcaacaacgtagaaacacctgcagttgcagaaaatgtcgagagtaggattgaagcagctagagaacgctttcttgctcgtaaaggacataaataaagtgatgtaaacagtctctcaaacagagaagcggaattcaagatcttgacttagctcaattgtcttct

SEQ ID NO: 839 - DNA, 2453 bp, Arabidopsis lyrata
gagagaggcgcttctctgctgcaaattgtttctctcttccctttataaaaccgcttccgtcgtcaatggcgtgaacctaaactaaaaaaaccattcttctctcttttcatttttttcattctctctctctcttctccatcgttttcacacttttctcgccgccctttatccttatccgataaacccatcaaaacccatagataaaaacagactctttgttctttaaacagagatcgaaaatccagagccgccggaatatacaaccgccggttactctcagggttagttgatttcgttcgattaaaatatcaaagaagatgaagtacgtgcttgtaacaggaggtgttgtgagtgggttagggaaaggagttacagcaagtagtattggtgttcttcttaaagcttgtggtcttcgagttacttctatcaaaatcgatccttatctaaacactgatgctggaaccatgtctccatttgaacacggtgaagtttttgtcttggacgatggtggtgaggtggatcttgatcttggaaattacgaaaggtttctggatatcaaattaaccagagacaataacatcactactgggaaaatttaccagcatgttattgctaaagagaggaaaggagattatttgggaaagactgttcaggttgttcctcatgtcactgatgcaattcaagattggattgagagagttgcggttattcctgttgatggagaggagggtcctgctgatgtttgtgttattgaattaggtggaactataggtgatattgaatccgcgccttttattgaggcgcttggccaattctcttaccgtgttggcccagggaatttctgtctggtccatgtcagcctcgtgcctgtgcttaatgttgttggtgaacagaaaactaagccgacacagcatagtgtcaaggggctacgaggcttgggcttgacgccggatatcttagcttgcaggagcacaaaggcacttgaagataatgtgaaagaaaaactagctcaattttgccatgtcccgcttgagtatattttcactctctatgatgttcccaacatttggcatattcctttgttgctaaaggatcagaaagctcatctggtaatctcaaaagtgctcaatcttgctagtattcttaatgagccttctcttggggaatggacttccagagctgaactatgtgacaatttacatgtgccggtgagaattgctgttgtagggaaatataccggcctctctgatgcttatctatctgtcctaaaggctctcttacatgcttctgtggcttgtcgcaaaaagctcgtagttgattgggttccagcttgtgatctcgaaaaagaaactgagaaagagaatccagatgcgtataaagctgcttggaagttgctaaagggtgtagatggagttcttgtccctggaggttttggtgataggggagtggaagggaagattcttgctgcaaaatatgcccgtgaaaacaaaatccctttccttggtatctgtctcgggatgcagattgctgtcatcgagtttgcacgatcagttctctgcttgcatgatgcaaacagcacagaatttaaacccgaaaccaaacatccgtgcatcattttcatgcccgagggttcgagaactcatatgggaggcactatgcgcttaggatccagaaaatccttcttcaatgtcaaagacagcaaatcctcaaaactatacggaaacaaaagctttgtcgatgagaggcatcgtcacagatatgaggtgaatcctgatatggttgaacgccttgagaaggccggtctttctttcgctgcgaaagatgaaactggcaaacgcatggagatcattgaactaccaaaccatcctttctttatcggtgctcaattccaccccgagttcaaatccagacccgggaaagcgtctcctctgtttttaggactcattgcagcgtcgtgtggcgagctagacacagtcctgaatccagcatctgctcatcaacatctgattagcaacggtccaaaaaacgtttacgtcaatggaactcccaagaaatcttccaatggcttggctgatgtaagatataataacggctactgcaatggcctctacactagatagctgcatttgctgaattctccctctttccctctcctttaaaattattgctttgttttcgatttagtttggattttggtttgctttcttcttaataatcttaggatttttcctctgtacatatgatccaagcttttgttcagtttttttagactcttttaacagacttatgttctgaaaagactctagaaacgtctgaaaatggcggtttgattcccctgctttgtttttttttacatcaaaagggatttcatatgatcatatgtaccggtggaacattttgtatctcgatttggtctgaaggtgaacgaagcatttgataaataaaacttttaa

SEQ ID NO: 840 - DNA, 2214 bp, Eutrema halophilum
ggttgttgattactgtgcaggagactcgattaaaaaaaaaaagaaatcagaaggaagaagatgaagtacgtgcttgtgacaggaggtgttgtgagtggattaggcaaaggagtaacagcaagtagtatcggtgttcttcttaaagcttgtggtcttcgagttacttcaatcaaaatcgatccttatctaaacacggatgctggaaccatgtctccgtttgagcacggtgaagtgtttgtcttggacgatggtggtgaggtggatcttgatcttggaaactacgagaggtttttagatattaaattaaccagagacaataacatcaccaccggaaaaatttaccagcatgtaattgctaaagaaaggaaaggagattatttgggaaagactgttcaggttgttcctcatgttactgatgcaattcaagagtggatagagagagttgcagttattcctgttgatggagaagagggccctgctgatgtttgcgttatcgaattaggaggaactataggtgacattgaatctgcgccatttattgaggcgcttggccaattctcctaccgtgtaggcccagggaatttctgtctggtccacgtcagcctcgtgcctgtgcttaatgttgttggtgaacagaaaacaaagccaacacagcatagtgtccgggggctacgaggcttgggcttgataccggatatcttagcttgtcggagcacaaaggtacttgaagagaatgtgaaagaaaagctagctcaattttgccatgtcccgcttgagtatatcttcactctctatgacgttcccaacatttggcacattcctctgctgcttaaggaacagaaggctcacttggcaatctctaaagtgctcaatcttgctagtcttgttaaagaaccttctctagacgaatggatttccagagccgaattgtgtgacaacttacatgtgccggttagaatcgctgttgtggggaaatatacaggcctctctgatgcctatctctctgtcttgaaggctctcttacatgcttctgttgcttgtcggaaaaagctcgtagttgattgggttccagcctgtgatctcgaaaaggaaactgagaaagagaatccagatgcatataaagctgcttggaagttgctgaagggcgtagatgggatccttgtacctggaggttttggtgatagaggagtggaaggaaagattcttgctgcaaaatatgcacgtgaaaacaagatccctttcctcggtatttgtcttgggatgcaggtcgctgtcatcgagtatgcacgatcagttctctgcttgcacgacgcaaacagcacagaattcaaacctgacactaaacatccatgcatcgtatttatgcctgagggttcaagaactcatatgggaggcactatgcgcctaggatcaagaaaatccatcttcaatgtcaaagacagcaaatcctcaaaactatatgggaacaaaaactttgtcgatgagaggcatcgccatagatacgaggtgaatcctgatatggttgaacggctagagaaggccggtctctcatttgctgcaaaagacgaaactggcaaacgcatggagattgttgaacttccaagccatcctttcttcatcggtgctcaattccaccctgagtacaaatccagacccgggaaagcttctcctctgttcttaggactcatcgcagcatcgtctggtgagctggacacagtcctgaatccagcctctgctcatcaacatctgactagtaacggtccaaaaaacgttttcgccaatggaacctccaagaaatctcccaatggcttggctgatgtaagatataataacggatactgcaatggcttatactctagatagcttcggttgcagactctccccttttctctccattagaattgcttcattttcgatttagtttgggatttgatttgcctttttttttggtttttaatgataaacttaggatctttcctctgtgcatatgattcaagcttttgtcaggtttttaggctcttttaaacagaatctatgttctgttaagactctagaaacatctgataattgcggttgattacccgtcttttgttttttccatgaaacgggatgtcatatgatcatatgtaccgttggaacattttgtatctcgatttggtctgcatgtgaaagaagcatctgataaataaaagttaaaaaaaagactttgttctt

SEQ ID NO: 841 - DNA, 2263 bp, Eutrema parvulum
caggattagttattttttgacgagattaaaaatcagaaatcagaagggaagaagatgaagtacgtgcttgtaacaggaggtgttgttagtggattaggcaaaggagtaacagcaagtagtatcggtgttcttcttaaagcttgtggtcttcgagttacttcaatcaaaatcgatccttatctaaacaccgatgctggaaccatgtctccatttgagcacggtgaagtgtttgtcttggacgatggtggtgaggtggatcttgatcttggaaactacgagaggttcttagatatcaaattaaccagagacaataacatcactaccgggaaaatttaccagcacgtaattgctaaagaaaggaaaggagattatttgggaaagactgttcaggttgttcctcatatcactgatgcaattcaagaatggatagagagagttgctgctattcctgttgatggagaggagggtcctgctgatgtttgcgttatcgaattaggaggaactataggtgatattgaatccgcaccttttatcgaggcgcttggccaattctcttaccgtgtaggcccagggaatttctgtctggtccacgtcagcctcgtgcctgtgcttaatgttgttggtgaacagaaaactaaaccgacacagcatagtgtccgggggctacgaggcttgggcttgatacctgatatccttgcttgtcggagcacaaaggcacttgaagagaatgtgaaagaaaaactagctcaattttgccatgtctcgcttaagaatatcttcactctctatgatgttcccaacatttggcacattcctctgttgcttaaggatcagaaggctcacctggcaatctcgaaagtgctcaatcttgctagtattgttaaagaaccttctctagaggaatggacttccagagctgaattatgcgacaacttacatgtgccggtgagaatcgctgttgtggggaaatacacaggcctctctgatgcctatctctctgtcttgaaggctctcttacatgcttctgtgacctgtcgcaaaaagctagtagttgattgggttccagcttgtgatctcgaaaaggaaacggagaaagagaatccaaatgcgtataaagttgcttggaagttactgaagggtgtagatggagttcttgtacctggaggttttggtgacaggggagtggaaggaaagatccttgctgcaaaatatgcccgtgaatacagaatccctttcctcggtatttgtctcgggatgcaagtcgctgtcatcgagtttgcacgatcagttctctgcttgagtgacgcaaacagcactgaattcaaacctgaaactacaaatccatgcatagtattcatgcctgagggttcaagaactcatatgggaggcactatgcgcctaggatcaagaaaatcaatcttcaatgtcaaagacagcaaatccgcgaaactctacgggatcaaaacctttgttgatgagaggcatcgccatagatacgaggtgaatcctgatatggttgaacggctagagaaggcaggtctctcttttgctgcaaaagatgaaactggcaaacgcatggagattgttgagcttccaaaccatcctttcttcatcggtgctcaattccatccagagtacaaatccagacccgggaaagcttctcctctgttcttaggactcattgcagcagcgtgtggtgagctagacacagtcatgaatccagcctctgttcatcaacatctgattagtaacggtccgaaaaacgttttcgtcaatggcacctccaagaaagctccaaatggcttggctgatgtaagatacaataacggatactgcaacggcctctacacaagatagctgcagttgcagacactcccttttcattctccattagaatttgcttcattttcgatttagtttggattttggtttgtttcattttataaacttaggatcttcctctgtacatatgattcaagcttttgtcaggtttttagactctttaacagaaactatgttctggaaagactctagaaacatctgaaaatcgcggttgattaccctggtttgtctttttttcgatcacaagggatgtcatatgatcatatgtaccgttggaacgttttgtatctctatttgctcttgagtgtgaaagaagcatctgataaataaaactctaaacaaagacttaagtttttgtttgctttcttatctaaactgaactttgaagggttaagaatttttttgttattactatcttcaa

SEQ ID NO: 842 - DNA, 1841 bp, Brassica napus
gaggtgttgtgagtggattaggcaaaggagtaaccgcaagtagtatcggtgttctccttaaagcttgtggtctccgtgttacttctatcaaaatcgatccttatctaaacactgatgctggaaccatgtctccttttgagcacggtgaagtctttgttttggacgatggtggtgaggtggatcttgatcttggaaactacgagaggtttttagatatcaaattaaccagagacaataacatcactactgggaaaatttaccagcatgtgattgctaaagaaaggaaaggagattacttgggaaagactgttcaggtagttcctcatatcactgatgcaattcaagagtggatagagagagttgctgctatccccgttgatggagaggagggtcctgctgatatttgcgttatcgaattaggaggaactataggtgatattgaatccgcaccttttatcgaggcacttggccaattctcttaccgtgtaggcacagggaatttctgtctggtccacgtcagcctcgtgcctgtgcttaatgttgttggtgaacagaaaactaaaccgacacaacatagtgtccgggggctacgaggcttgggcttgatacctgatatcttagcttgtcggagcacaaaggcacttgaggagaatgtgaaagaaaagctagctcagttttgccatgtcccgcttgagtctatcttcactctctatgatgttcccaacatttggcacattcctctgttgcttaaggatcagaaggctcacttggcaatctcgaaagtgctcaatcttgctggtattgttaaagaaccatctctagaggaatggacttcaagagccgagttatgtgacaacttacatgtaccggtgagaatcgctgttgtggggaagtatacaggcctctctgatgcctatctctccatcttgaaggctctcttacatgcttctgtcgcttgtcgcaaaaagctcgtagttgactgggttccagcttgtgatctcgaaaaagaaactgagaaagagaatccaaatgcgtataaagctgcttggaagttgctgaagggtgtagatggagttcttgtacctggaggttttggtgacaggggagtggaaggaaagattcttgctgcaaaatacgctcgtgaaaacaaaatccctttcctcggtatctgcctagggatgcaggtcgctgtcatcgagtttgcacgatcagttctctccttgctcgacgcaaacagcacagagttcaaacctgacactaaacatccgtgcatcgtattcatgcctgagggctcaagaactcatatgggaggcactatgcgcttaggatcaagaaaatccatcttcacagtcaaagacagcaaatctgctaaactctacgggaacaaaagctttgtcgatgagaggcatcgccatagatacgaggtgaatcctgatatggttgagcggctagagaaggcaggtctctcttttgctgccaaagatgaaactggcaaacgcatggagattgttgaacttccaaaccatcctttcttcattggtgctcagttccacccagagtacaaatccagacccggcaaagcttctcctctcttcttaggactcattgcagcatcgtgtggtgagctagacacagtcatgaatccagcttctgttcatcaacatctgattagtaactgtccgaaaagcgttttcgtcaatggaacctccaagaaagctcccaatggcatggctgatgtaagatacaataacggatactgcaacggcctccactctagatagctgcagactctccctttttttctatctgcattagaattgcttcattttggtattttggtt

SEQ ID NO: 843 - DNA, 2246 bp, Brassica napus
acccagagcacaaaacaacattttattattttcagagatcgaaaaatccagagctgccggaacacgcaaccgccggttaaaagcaggattagctgattagaaacaaggagatgaagtacgtgcttgtaacaggaggtgttgtgagtggactaggcaaaggagtcacagcaagtagtatcggtgttcttcttaaagcttgtggtcttcgtgttacttctatcaaaatcgatccttatctaaacaccgatgctggaaccatgtctccctttgaacacggtgaagtgtttgtcttggacgatggtggtgaggtggatcttgatctgggaaactacgagaggttcttagacatcaaattaaccagagacaataacatcactactgggaaaatttaccagcatgtaattgctaaagaaaggaaaggagattacttgggaaagactgttcaggttgttcctcatattactgatgcaattcaagaatggatagagagagttgctgctattcctgttgatggagaggatggtcctgctgatgtctgtgttatcgaattaggaggaactataggtgatattgaatctgcaccttttattgaggcacttggccaattctcttaccgtgtaggacaagggaatttctgtcttgtccacgtcagccttgtgcctgtgcttaatgttgttggtgaacagaaaactaagccgacacagcatagtgtccggggcctacgaggcttgggcttgatacctgatatcttagcttgtcggagcacaaaggcacttgaagagaatgtgaaagaaaagctagctcagttttgccatgtccctcttgagaatatcttcactctatatgatgttcccaacatttggcacattcctcgtttgcttaaggatcagaaggctcacttggttatctccaaagtgctgaatcttgctagtatgttaaagaaccttctctggaggaatggacttccagagccgaactatgtgccaacttacatgtgccggtgagaatcgctgttgtggggaaatataccagcctctctgatgcctatctctctgtcttgaaggctctcttacacgctgctgtggcttgccgcaaaaagctcgtagttgattgggttcctgcttgcgatcttgaaaaggaaactgagaaagagaatccaaatgcgtataaagctgcttggaagttgctgaagggtgtagatggagttcttgtacctggaggatttggtgataggggagtggaaggaaagatccttgctgcaaagtatgctcgagaaagcaaaatccctttcctcggtatatgtcttgggatgcaggtcgctgtcatcgagtttgcacgatcagttctctgcttgcacgacgcagacagcacagaattcaaacctcaactaagcatccatgcattatattcatgcctgagggttcagaactcatatggtggcactatgcgcttaggatcagaaaatccatcttcagtgtcaaagacagcaaatccgccaaactctatgggaacaaaacctttgttgatgagaggcatcgccatagatacgaggtgaatcctgatatggttgagcgactagagaaggctggtctctcttttgctgcaaaagatgaaactggcaaacgcatggagattgttgaacttccaagtcatcctttcttcattggtgctcagttccatccagagtacaaatccagacccgggaaagcttctcctctcttcttaggactcattgcagcatcttgtggtgagctagactcagtcatgaatccatcctctgctcatcaacatctgattagtaactgtccaaaaacgttttcgtcaatggaaactcaaagaaagcttccaatggcttggctgatgtaagacacaacaacggatactgcaacggcctctacactagatagctgcagctgcagagattcccctttctctatccattagaattgcttcattttcgattttggtttgcttttttatttttctactaaacttaggatctttcctgtgtacatatgattcaagcttttgtcaggtttttagactccttttaacagaatttatgttctggaaagagtctagaaacgtctgaaaatcgcggttgattatccctggtttgttttttatcaatcaaaaggggatgatatgatcatatgtacctttgcaacattttgtatttttatttgcttttgagtgtcgaagaagcattggataaataaaactcagaacaaagacttaagtttttt

SEQ ID NO: 844 - DNA, 1619 bp, Brassica napus
gctaaacgcaggattagttgattagattgaaaagcagaaggaagaagatgaaatacgtgctagtaacaggaggtgttgtgagtggattaggcaaaggagtaaccgcaagtagtatcggtgttctccttaaagcttgtggtctccgtgttacttctatcaaaatcgatccttatctaaacactgatgctggaaccatgtctccttttgagcacggtgaagtctttgttttggacgatggtggtgaggtggatcttgatcttggaaactacgagaggttcttagatatcaaactaaccagagataataacatcactactgggaaaatttaccagcatgtgattgctaaagaaaggaaaggagattatttgggaaagactgttcaggtagttcctcatatcactgatgcaattcaagagtggatagagagagttgctgccatccctgttgatggagaggagggtcctgctgatatttgcgttatcgaattaggaggaactataggtgatattgaatccgcaccttttatcgaggcacttggccaattctcttaccgtgtaggcacagggaatttgtgtctggtccacgtcagcctcgtgcctgtgcttaatgttgttggtgaacagaaaactaaaccgacacaacatagtgtccgggggctacgaggcttgggcttgatacctgatatcttagcttgtcggagcacaaaggcacttgaggagaatgtgaaagaaaagctatctcagttttgccatgtcccgcttgagtctatcttcactctctatgatgttcccaacatttggcacattcctctgttgcttaaggatcagaaggctcacttggcaatctcgaaagtgctcaatcttgctggtattgttaaagaaccatctctagaggaatggacatcaagagccgagttatgtgacaacttacatgtaccggtgagaatcgctgttgtggggaagtatacaggcctctctgatgcctatctctccatcttgaaggctctcttacatgcttctgtcgcttgccgcaaaaagctcgtagttgactgggttccagcttgtgatctcgaaaaagaaactgagaaagagaatccaaatgcgtataaagctgcttggaagttgctgaagggcgtagatggagttcttgtacctggaggttttggtgacaggggagtggaaggaaagattcttgctgcaaaatacgctcgtgaaaacaaaatccctttcctcggtatctgcctagggatgcaggtcgctgtcatcgagtttgcacgatcagttctctccttgctcgacgcaaacagcacagagttcaaacctgacactaaacatccgtgcatcgtattcatgcctgagggctcaagaactcatatgggaggcactatgcgcttaggatcaagaaaatccatcttcacggtcaaagacagcaaatctgctaaactctacgggaaaaaaagctttgtcgatgagaggcatcgccatagatacgaggtgaatcctgatatggttgagcggctagagaaggcaggtctctcttttgctgccaaagatgaaactggcaaacgcatggagattgttgaacttccaaaccatcctttcttcattggtgctcagttc

SEQ ID NO: 845 - DNA, 2496 bp, Citrus clementina
atatttttttaatttttgtaatggggtcgattaagggtgacaatttgtatataaaaggccgccaacactcaccaaaaccagaaacaatttcatcactctcttctctgcattgcattcttctctctctttctcttcttgcagcactcgtttgagctagctagtgatagtttcttggtttctttgttaaatattatttacccaaaaagggagggaaaagaaaaaaaagttggtttcgcttagttcatgctctttgcacttccttatccaagagaaaaatagagcagataacgttactactattataagttgcttttgtttggttagttcaactccaagttgacacacggagcagttcaattagtaaactatccaagaaaaggggcattgaagaagatgaagtatgttttggtgactggtggagtagtaagtggacttggaaagggagtcacagccagcagtattggtgttcttcttaaggcttgtggacttcgtgttacttgcattaaaatcgatccttacttgaacactgatgctggaacaatgtctccttttgagcacggggaagtattcgtcttggacgatggcggcgaggtggaccttgacctcggaaactatgagcggttcatggatatcaagttgacccgtgacaataatatcactactgggaagatttaccagtctgttattgataaggagagaaagggtgattacttgggaaaaactgttcaggttgttcctcacattactgatgaaattcaagattggattgagcgtgttgcaatgatacctgtggatggaaaggaaggtccagcagatgtttgtgtcatagaattgggaggaaccataggagacatcgaatccatgccatttattgaggctttggggcagttctcatatcgtgtgggtcctggcaacttttgcttgattcatgtcagcctagtgcctgtacttaatgttgttggtgaacagaaaacaaagccaacccagcacagtgttcggggacttagaggccagggcttgacaccaaatatcttagcctgtcgcagcacagtggcacttgatgataatgtaaagggaaagctttctcagttttgccatgttccggagcaaaacatcatcactctctatgatgttcccaacatatggcatattcccttgcttttaagagatcagaaggctcatgaagcaatctttaaagtgctgaaccttcaaggtactacaaaggagcctttactaaaggaatggacttcaagggctgaaatctgtgacgggttacatgagccagtcagaattgccatggttggaaagtacacaggcctttccgatgcctatctctcgatattgaaggctcttttacatgcttctgttgatttacgcaagaaacttgtcatcgattggattccagcttgcgatcttgaagatgcaactgaaaaagaaaatccagatgcttataaggctgcatggaagttgttgaagggtgccgatggtattcttgttccaggaggctttggcaacagaggagtgcaagggaaaattctcgcagctaagtatgcaagggagcacagaattccttaccttggcatttgtcttggaatgcaagttgctgtcatcgagtttgcgcgatctgttcttaatctgagagatgctaacagcacagaatttgatcctaacaccaaaaatccttgtgttatatttatgccggagggctcaaaaactcatatgggaggcactatgcgtcttgggtcaagaaggacatacttccaagtcaaggactgcaaatctgcaaaattatatggaaatagaactttcattgatgagagacatcgtcatagatacgaggtgaatcctgatatgatagcacgcttggaaaatgccggtctctctttcactggcaaggatgaaactagccaacgcatggagattgttgagctgcctaaccatccctacttcattggtgttcaattccatcccgaatacaaatctaggcctggaaaaccatctcctttgttcttagggcttatagcagcagcatgtgggcagttagatactctcatacaaggatctgggagccaaggaaatctctctgctaagcttggcaacggcattgcaatggagaaggtatacccaaagggaactacgaaacctgcgaaagtgttatcagatggtttatacagctattgcaatggtgtgcaagtttgaaggcattttctgccattggttttaggatctattagttatcaagcagtactgattctgccaaagagttttagtagcaatcttaggatttctctgtacagccatttgagtatggataggtgtttcagcttgctttcaaaagggactgcagacagaccaaacagagctgaatcccgatcttttaaatgggatagcctgttgtgtttcatagttgtaatgtaacctttcttggccttatggctgagggcaagtgtattagcagctttaaactgcaatgtgaaagttgagtttcacttcttt

SEQ ID NO: 846 - DNA, 1789 bp, Arabidopsis lyrata
ctctacaaaaaaaaaaaacaagcaaaaacagaagttgtaactctctactctaacacaaaatctaaatggcttctccatcatcaccaatatctctcaaaaacccaagattcttctcttcttctcctcacaagatctttaaaacccaaccccaaaccctaattttgacaacaaagttcaagacttgctccatcatttgcgcatcttcatgcacaagcataagctcttcaacgactcaacagaagcagccaaagaaacaaacccatgtgtcagacaacaaacgagaagaagataaggaagaggaagaagaaaaagaagttagtcttcgagaaatttggagagaagtacaaggttgcaataattgggaaggactactagatccaatgaacaatcatcttcgaagagagatcatacgttatggcgaattcgctcaagcttgctatgactcattcgacttcgatcctcactctaaatattgtggctcttgcaaataccatccttctgatttcttctcaaaccttgacctacatctccacaaaggctacaccataacacgttacctctacgctacatccaacatcaacctcccaaacttcttccagaaatcaaaactcagctccatttggagccaacacgccaactggatgggttatgttgctgtagctacggacgaagaagaggtgggtcggctcgggagacgtgacatagtcattgcttggagaggcacagtcacttatctcgaatggatctatgacttaaaagacattctttgttcagctaactttggtgacgacccatcgatcaagattgaattagggtttcatgacttgtacaccaagaaagaagactcttgcaaattctcttccttttcggctcgggaacaggttttggccgaagtcaaacggcttcttgagtactatggtaccggagaagaaggtcatgagataagcatcaccgtgactgggcacagccttggcgcatctcttgctttggtcagtgcttatgatattgcggagctaaacttgaatcacgtaccggagaacaactataaagttccaattactgttttctccttctcgggacctcgagtaggtaacttgaggttcaaggaacgatgcgacgaactaggggttaaagttctgagagtcgttaatgtacacgacaaggtaccttctgttccagggatattcgcaaacgaaaagtttcagtttcagaagtatgtagaagaaaaaacatcattcccatggagctacgcgcacgtcggcgtggagcttgccttggaccacaagaaaagcccatttctgaaacagactaaggatttgggttgtgcacataacctagaagctttgcttcatttagtagatggatatcatggaaaagacgaagaagcacagaagagattctgtttggtgacaaagagagacatagctttagtgaataagagttgtgatttcttgagaagtgagtaccatgtgccgccttgttggagacaagacgagaacaaagggatggtcaagagcagtgatggacggtgggttctgccggaccgaccacagctcgaacctcaccgacaggaggatatcgctcaccatcttcaacaagttcttgggaaggttaacgatgataattttaaacccacaacgacttaagtcgaaaattaaatataaatagttactaaaaaaaaatattagtaatgtgtgggtcacgtttaataaattgagtatgttagttagtgtttgattaatgatgcaattgcacttctataattatggaggccatcaccatcccccat

SEQ ID NO: 847 - DNA, 1687 bp, Eutrema halophilum
ctctacacaaagaagaaaaccagaagttgtaattcactaaccaccaaataaaatggcttctccatcatcaccaataactctcaagaacccaatattcttcacttctttccctcacaacatcttcaaaaccaaacctaaaaccctaatcttgacaacaaagatcaagacttgttccatcatttgctcaacgtcatgcacaagcgtaaactcttcaacaactcaacagaatctgaaacagaatcaaacccttgtttcagacaacaaacgagaagaagagaaggcatcgaagtagaagaagaagtgaatcttcgagagatttggagagaagtacaaggttgtaataactgggaaggactactagatccaatgaacaatcatcttcgaagagagatcatacgttacggagaatttgctcaagcttgttacgactcattcgacttcgatcctcactctaaatactgtggctcttgcaaataccatccttccgatttcttcccaaaccttgacttaaatctccacaaaggctacaccataacacgttacctctacgcaacgtccaacatcaacctcccaaacttcttccaaagatcaaaactcagctcgatttggagccaacacgcgaactggatgggttacgttgcagtagctacgaacgaagaagaagtggctcggctcgggagacgtgacatagtcatcgcttggagaggcacagtcacttatctcgaatggatctatgacttgaaagatattctttgttcagctaactttggagacgaccctttgatcaagattgaattagggtttcatgatttgtataccaagaaagaagattcttgcaaattctcttccttttcggctcgagaacaggttttagccgaagtcaaacggcttcttgagtactacggtaccggagaagaaggtcacgagataagcatcacggtgacaggtcatagtctcggcgcagctcttgctttggtcagtgcttatgatatcgcagagctaaacttaaatcacataccggaaaagaactacaaagttcccataagcgtgttctccttctcgggacctcgagtaggtaaccttaggttcaaggaaagatgcgaagaactagggcttaaagtcctgagagtggtaaacgtgcacgacaaggtaccttccgttccagggatatttacaaacgaaaagtttcagtttcaaaagtatatcgaagaaacaacatcattcccatggagctacgcgcatgtaggtgtcgagcttgcattggaccacaagaaaagcccgtttctgaaacagactaaggatttgggatgcgcacacaacctagaagctttgcttcatttggtagatggatatcatgggaaagaagaaggaggagagaagaagttttgtttggtgacaaagagagacatagctttagtgaacaagagttgtgatttcttgagaagcgactatcacgtgccgccttgttggagacaagacgagaacaaagggatggtcaagaacgaagatggacggtggattttgccggatcgaccacggctcgagcctcatcaacctgaggatattacacatcatcttcaaaaagttattgggaaatttaacgacggtgatcctaaacccaccatcacagtcaaacgccttggtcaaaattaattttttttaaataattaaatcatatgataaggat

SEQ ID NO: 848 - DNA, 1849 bp, Eutrema halophilum
acaaagaagaaaaccagaagttgtaattcactaaccaccaaataaaatggcttctccatcatcaccaataactctcaagaacccaatattcttcacttctttccctcacaacatcttcaaaaccaaacctaaaaccctaatcttgacaacaaagatcaagacttgttccatcatttgctcaacgtcatgcacaagcgtaaactcttcaacaactcaacagaatctgaaacagaatcaaacccttgtttcagacaacaaacgagaagaagagaaggcactagtcaaagaagaaggaaaagcagcactcgaagtagaagaagaagtgaatcttcgagagatttggagagaagtacaaggttgtaataactgggaaggactactagatccaatgaacaatcatcttcgaagagagatcatacgttacggagaatttgctcaagcttgttacgactcattcgacttcgatcctcactctaaatactgtggctcttgcaaataccatccttccgatttcttcccaaaccttgacttaaatctccacaaaggctacaccataacacgttacctctacgcaacgtccaacatcaacctcccaaacttcttccaaagatcaaaactcagctcgatttggagccaacacgcgaactggatgggttacgttgcagtagctacgaacgaagaagaagtggctcggctcgggagacgtgacatagtcatcgcttggagaggcacagtcacttatctcgaatggatctatgacttgaaagatattctttgttcagctaactttggagacgaccctttgatcaagattgaattagggtttcatgatttgtataccaagaaagaagattcttgcaaattctcttccttttcggctcgagaacaggttttagccgaagtcaaacggcttcttgagtactacggtaccggagaagaaggtcacgagataagcatcacggtgacaggtcatagtctcggcgcagctcttgctttggtcagtgcttatgatatcgcagagctaaacttaaatcacataccggaaaagaactacaaagttcccataagcgtgttctccttctcgggacctcgagtaggtaaccttaggttcaaggaaagatgcgaagaactagggcttaaagtcctgagagtggtaaacgtgcacgacaaggtaccttccgttccagggatatttacaaacgaaaagtttcagtttcaaaagtatatcgaagaaacaacatcattcccatggagctacgcgcatgtaggtgtcgagcttgcattggaccacaagaaaagcccgtttctgaaacagactaaggatttgggatgcgcacacaacctagaagctttgcttcatttggtagatggatatcatgggaaagaagaaggaggagagaagaagttttgtttggtgacaaagagagacatagctttagtgaacaagagttgtgatttcttgagaagcgactatcacgtgccgccttgttggagacaagacgagaacaaagggatggtcaagaacgaagatggacggtggattttgccggatcgaccacggctcgagcctcatcaacctgaggatattacacatcatcttcaaaaagttattgggaaatttaacgacggtgatcctaaacccaccatcacagtcaaacgccttggtcaaaattaattttttttaaataattaaatcatatgataaggatgctttgttttggaattttgtgaatgctcaaggatccaattgtgaatagactatccgaacctgtctgttttgtctgcatcacaacacaatttgaatgtgtgggtcgggtgtataagaaattgaatatgctagttaattacg

SEQ ID NO: 849 - DNA, 1817 bp, Eutrema parvulum
acaaagaagcaaaccagaagttgtaactctccaaccaccaattcaaatggcttctccattatcaccaatagctctcaagaacccaagattcttcacttcttctcctcacaatatcttcaataccaaaccaaaaaccctaatcttgacaacaacgatgaagagttgttgttccatcgtttactcatcttcttgcacaagcataaactcttcaacaactcaacagaagcagcccctcgtttcagacaacaaacgacaagatgatacactagtaaaagaagaagaagaaccagaactcgaagaagaagtgactcttcgagaaatatggagagaagtacaaggttgcaataactgggaaggactactagatccaatgaacgaacatcttcgtagagagatcatacgttacggcgaatttgctcaggcttgctacgactcattcgacttcgatcctcactcaaaatactgcggctcttgcaaataccatccgtccgatttcttctcaaaccttgacctaaatctccacaagggttacaccataacacgttacctctacgcaacttccaacatcaacctcccaaatttcttccaaagatcaaaactcagctcgatttggagccaacacgcgaactggatgggttacattgctgtagctacggacgaagaagaggtcgctcggcttgggaggcgtgacataatcatcgcttggagaggcacggtcacttatctcgaatggatctatgacttaaaagacattctttgttcagctaacttcggtaacgaccctttgatcaaaattgaattagggtttcatgatttgtacaccaagaaagaagactcttgcaaattctcttccgtttcggctcgagaaaaggttttggccgaagtcaaacgtcttcttgagtactacggtaccggagaagaaggtcacgagataagcatcaccgtgacaggtcacagcctcggtgcagctcttgctttggtcagtgcttatgatatcgcggaggtaaacttgaatcacatcccggagaacaactataaagtcccagttagtgtattctccttctcaggacctcgcgtaggtaacttgaggttcaaagaacgatgcgaagaactaggtgtcaaagtgttgagagtgataaacgtgcatgacaaggtaccttcagttccagggatattcgcaaacgagaagtctcagtttcagaagtatatcgaggacacaacatccttcccatggagctatgcgcacgtcggcgtagagcttgccttggaccataagaaaagcccgtttctgaaacaaactaaggatttgggctgtgcacataacctagaagctttacttcatttggtggatggatatcacggaaaaggagatgggaagaggttttgtttggtgtcaaagagagacatagctttagtgaacaagagttgtgatttcctgagaagtgattatcacgtgccgccttgttggagacaagacgagaacaaaggaatggtcaagaacagagatggacggtgggttttgccggatcgaccacggctcgagcctcaccgaccggaggatatcgcacatcatctacaaaaagttctcgggaagtttaacgacggtgatcctaaacccaccacaacgacttagtatagattaatataattaaatgaataatcatatcataaggattgcctttgttggaattttgtgaatgctcaaggatcctattgtaaatatagaacgtgaatttgtctgttttgtttgcatcacattcacaatttgaataaatgggccagatgtataataaattgaacatgttaatttaattacg

SEQ ID NO: 850 - DNA, 1117 bp, Arabidopsis lyrata
cagacacacaaacccactaaacattcaaaatgtctcgtcctcttgtcttcttcttcttcctctttcttgtcttggtcgtcccttgtctctcccatggaaccggaggagatcacgacgacgatgaggctccgcacgttgagagttccgatctcaaatctaaatccttaatctctgtcaagatcgcatgtcttgtcatcatctttgtcctcacgtttatcagcggcgtctctccttatttcttgaaatggagtcaagggttcttggttcttggaacacaattcgccggaggagtgtttcttgcaaccgccttgatgcatttcttgtctgatgctgatgagacgtttcgtgatttgttgacggcggaaggagagtcggaactatctccggcttacccatttgcttacatgttggcttgtgctggttttatgttaaccatgcttgctgattctgtcatcgctcatatctacttaaggacccaaaacgatttggagcttcaaggagaagacaaatcgaatcagacgtcagcaacaactgaaacatcgattggagatagcattctattgatcgtagctctctgttttcactctgtcttcgaaggcatagctattggtatctcagagactaaatcagatgcttggagagctctatggacaataacactccacaagatatttgcagcgattgcaatgggaattgctcttctccgtatgatccctgaccgtcctttgttctcatcaatcacttattctttcgcattcgccatctcgagcccaattggtgttgcgattggaatagtaatcgatgcaacgactcaaggatcgatcgcggattggattttcgcagtgtcgatgagcttggcctgtggggtatttgtgtatgtctcggtgaaccatttgttggcaaaagggtatcgaccaaacaagaaggttcatgtggatgagcctagttataagtttttggctgtgttgtttggagttgttgtcattgccattgttatgatatgggacacttgaaaacacacaaaaattgtcccaaaatacagattagatgtttctggtttgtaaagaaaggttgttgattttgaatgtttttagtatgtagcaatcctcgttttgta

SEQ ID NO: 851 - DNA, 2439 bp, Eutrema parvulum
ggtttttttccttttttctccgatcatttcaaaaccctacttcaaccctgcgattcccagggcttggagaaacgccgaaatcgaaaatggcttcgattgctcttcgatctcgccgtatgccaagattactaaagcttggatctcgtagaccaagaatattttctacggaagcatcttcttcgaatccatcatcgaaggttgcgggaatctcctctggccagtcgttcttttctgattttccaccgccaaatcagcctcctcctcctcctcctgaggcggccgcggaggcgctgggaaaggagcggaaaggccttaagtttcttagtaacggactcatctgggcacttacgggtgctaccgctgctgttggttacactagttatgcttacacattagatgaagtgaatgaaaaaactaaggcattccgagaatcagctatgaagacaccaccagctgttaattcttccggcattgataaatatcaagcgatgttgtactcttctgccatgaaagttcctgccagagccattgaaatgtatttggagcttagggaagctgcggaggaacatgtgaaaggctttacagaacctctctcggaaaagcttcttccagatttgcatccttcagaacagaatgccttcactctcgttcttgatttgaatgagacactgctttacacggactggaagcgagacagagggtggaggacattcaaaagaccaggtgtcgatgcattcttggagcaccttgcgaaattctatgagattgtcgtgtattctgaccagatggatatgtatgtacttccggtctgtgaaaagttggacccaaatggctacatacgttataggctaacaagaggcgctactaaatatgagaatggaaagcactatagggatctgtcaaagctgaacagagacccgaagaagattctgtatgttagcgggaatgcttttgatacaagccttcagccagagaattgtgtgccaatcaagccttacaaactcgaatctgatgacacagcgcttgttgacctaatacccttccttgaatatgttgcacgaaacagtccagctgatatcagaccggttttagcttcttatgagagaaaagatgttgccaaagagttccttgagaggtccctagagtatcaaaagcgaatgcaagaacaacgaggacaaagacaaggccgactctggaggcgttaaaggatctaaacatttatgtatagtgagagacgattattgatgcacaccataaaacaggaacaggagctactgttctggctgtgggtttagacacacaaaccactcaactcaagattcacatgtctcgtcctattctcttccttttcttcctctttctagtcttggtcgtcccttgtctctcccacggagccggaggagaccacgacgacgatgaggctccgcctgctaagagttccgatctcagatcaagatctttaatctctgtcaaaatcgcatgtcttgtcattatctttgtcctcacgttcatcagcggcgtatctccctatttcttgaaatggagccaagggtttttggttctcggaacacagttcgccggaggcgtgtttcttgcgaccgccttgatgcatttcttatccgatgctgacgagacgtttcgggatttgctgacggcggaaggagagtcggagccatctccggcttacccatttgcttatatgttggcttgtgctggttatatgttgaccatgttcgctgattctgtcatcgcccatgtctactccaagacccaatcttcatcatccaaagatgtggagcttcaaggagaaaacaaatcaaatcagggtttagccagcagggaaagttcggttggagatagcatactgttgatcgtagctctctgtttccactctgtcttcgaaggcatagccattgggatctcagagactaaatcagatgcttggagagctctatggacaataactctccacaagatattcgcagcgatagccatgggaattgctcttctccgtatgatccctgaccgtcctctattctcctccatcacatattctttctccttcgccatctcgagccctattggtgtcgcgatcggaatagtcatcgacgcaacgactcaagggtcggtcgcggattggatattcgcagtgtcgatgagcttggcttgtggggttttcatgtatgtgtctgtgaatcatttgttggcaaaagggtatcttccaaacaacaaggttcatgtggatgaacctcgttttaagtttttggctgttttgtttggagttgttgtcatcgccattgttatgatatgggacacttgaaagaaccaattgtctctcaaagtacatattatttagaatgatatattcgtctttttaaaacaatctgtacaaatgttgatcttggatgttttatttatggaaccatctcggtcttgtaa

SEQ ID NO: 852 - DNA, 1004 bp, Eutrema halophilum
gagagacacacaaacccactcaagattcacatgtctcgtccgcttctcttcttcttcttcctctatcttgtgttggtcgtcccttgtctctcccacggagccggaggagaccgcgacgacgatgaggctgcgcccgttaagagttccgatctcaaatcaagatctctaatctctgtcaaaatcggatgtcttgtcatcatctttgtcctcaccttcatcagcggcgtgtctccctatttcttgaaatggagccaagggtttttggttctcggcacacagttcgccggaggagtgtttcttgcgaccgccttgatgcatttcttgtccgatgccgacgagacgtttcgggatttgttgacggcggaaggagagtcgaagccatctccggcttacccatttgcttatatgttggcttgtgctggttatatgttgaccatgttcgctgattctgtcatctctcatgtctactccaagacccaatcttcttcatccaacgatctggaggtccaaaaatcgaatcagagttcggttggagacagcattctattgatcgttgctctgtgtttccactctgttttcgaaggcatagccattgggatctcagagactaaatcagatgcttggagagctctatggacaataactctccacaagatattcgcagcgattgccatgggaatcgctcttctccgtatgatacctgaccgtcctctattctcctcaatcacatattctttctcattcgccgtctcgagccccattggagttgcgatcggaatagtcatcgacgcaacaactcaagggtcggtcgcggattggatattcgcagtgtcgatgagcttggcgtgtggggttttcgtttatgtctctgtgaatcatttgctggcaaaagggtatctcccaaacaaaaaggttcacgtcgatgagcctcgttttaagtttttggccgttttgtttggagttgttgtcatcgccattgtcatgatatgggacacttgaatttt

SEQ ID NO: 853 - DNA, 1060 bp, Brassica oleracea
  misc_feature (756)..(756): n is a, c, g, or t
  misc_feature (933)..(933): n is a, c, g, or t
  misc_feature (976)..(976): n is a, c, g, or t
  misc_feature (985)..(985): n is a, c, g, or t
gatcacagacacacacaatcccactctcaagtttcacatgtctcgtcctcttgtcttcttcttcttcttcctctttcttgtcttggtcgtcccttgtctttcccatggaggcggaggagaccacgacgacgatgaagctccacccgccaagagttctgatctcaaatcaaaatcattaatcactgtcaaaatcgcgtgtcttgtcatcatcttcgtgctcacgttcatcagcggcgtgtctccctacttcttgaaatggagccaagggtttctggtcctgggaacacagttcgcaggaggagtgtttctcgcgacggccctgatgcatttcttgtcagatgcagacgagacgtttagggatttgctgacggcggaaggagagtcggagccgtctccggcttacccatttgcttatatgttggcttgtactggttatatgctgaccatgctcgccgattccgtcatcgctcatgtctactccaagaccccatccaaagacgtggagcttcaaggagaagagaaaccgaatcaaggttcagggataggagatagcattctactgatcgtagctctctgtttccactctgtttttgaaggcatagccatagggatctcagagacaaaggctgatgcgtggagagctctatggacaataacactccacaaggtattcgcagctatagccatgggaatagctcttctccgtatgatccctgaccgtcctctgctctcatccatcatgtattctttcgcgtncgccatctcgagcccaataggtgttgcgataggaatagtgatcgacgcaacgacgcaagggaccgtggcggattggatattcgcagtgtccatgagcttcgcgtgtggggtgttcgtgtacgtgtcggtgaatcatttgttggcaaaagggtatcttcccaaccaaaaggttaatgnggatgagcctaggtttaagtttttggctgttttgtctggagtngttgtcatngccattgttatgatatgggacacttgaattgttctcaaaagtactacagattttagaattataaaattgggtttt

SEQ ID NO: 854 - DNA, 1025 bp, Brassica napus
catggaggcggaggagaccacgacgacgatgaggctccacccgccaagacttctgatctcaaatcaaaatccttgatcactgtcaaaatcgcgtgtcttgtcatcatctttgtactcacgttcatcagcggcgtgtctccctacttcttgaaatggagccaagcgtttttggtcctgggaacacagttcgcgggaggagtgtttctcgcgacggccctgatgcatttcttgtcagatgcagacgagacgtttcgggatttgctgacggcggaaggagagtcggagccgtctccggcttacccattcgcttatatgttggcttgtgctggttatatgctgaccatgctcgctgattccgtcatcgctcatgtctactccaagaccccatccaaagacgtggagcttcaaggagcagagaaaccgaatcaaggttcagggataggagatagcattctgctgatcgtagctctctgtttccactctgttttcgaaggcatagccattgggatctcagagaccaaagcagatgcgtggagagctctatggacgataacactccacaaggttttcgcagcgattgccatgggaattgctcttctccgtatgatccctgaccgtcctctcttctcctccatcatgtattctttcgcattcgccatctcgagcccgataggtgttgcgatcggaatagtgatcgacgcaacgacgcaagggaaggtggcggattggatattcgcactgtctatgagcttggcgtgtggggtgttcgtgtacgtgtcagtgaatcatttgttggcgaaagggtatcttcccaacaaaaaggttaatgtggatgagcctaggtttaagtttttggctgttttgtctggagttgttgtcatcgccattgttatgatatgggacacttgaagtatactcaaaaatactacagattttagaattataaaattgggttttttaaaagtttagttgagaaaacaaaaggttaatttgataatatacagtacgttgattttggataagtt

SEQ ID NO: 855 - DNA, 1050 bp, Raphanus sativus
  misc_feature (315)..(315): n is a, c, g, or t
  misc_feature (828)..(828): n is a, c, g, or t
  misc_feature (903)..(903): n is a, c, g, or t
  misc_feature (933)..(933): n is a, c, g, or t
  misc_feature (975)..(975): n is a, c, g, or t
  misc_feature (1002)..(1002): n is a, c, g, or t
  misc_feature (1031)..(1031): n is a, c, g, or t
  misc_feature (1038)..(1038): n is a, c, g, or t
ggacagacacacaacccctacacaaaacagttccacatgtctcgtcgtcctcttgtcttcttcttcttcctctttcttgtcttggtcgtcccttgtctctcccatggaggtggaggagaccacgacgacgacgatgctccgcacgccaagagtaccgatctcaaatcaaaatccttaatcactgtcaaaatagcgtgtcttgtcatcatctttgtgctcacgttcgtcagcggcgtatctccttatttcctgaaatggagccaagggtttctggtcctgggaacacagttcgcaggaggagtgtttctcgcgacngccctgatgcatttcttgccagatgccgacgagacgtttcgggatttgctgaccaaggaaggagagtcggagccgtctccggcttacccattcgcgttcatgttggcctgtgctggttatatgctgaccatgctcgctgattccgtcatcgctcatgtctactccaagaccccatccaaagacgtcgaggagcttcaaggagaagagaaaccgaaccagggttcaggtataggagatagcattctactgatcgtagctctgtgtttccactctgtattcgaagggatagccatagggatctcagagagtaaagcagatgcgtggagagctctatggacaataacactccacaagatattcgcagcgatagcaatggggatagctcttctccgtatgatccctgaccgtcctctcttctccaccatcatctattctttcgcattcgccatctccagcccaataggtgttgggatcggaatagtgatagacgcgacgacgcaagggacggtggcngattggatattcgcagtgtctatgagcttggcgtgcggggtgttcgtttacgtgtcagtgaatcatttgttggcnaaagggtatattccgaacaaaaaggttaangtggatcagcctagctttaagtttttggctgttttgtctggngttgttgtcatcgccattgttatgatntgggacacttgaattgtctactcaaaaantactacngatttagaatca

SEQ ID NO: 856 - DNA, 1245 bp, Arabidopsis lyrata
atgtacgtgacaaggacattgtcgcagttcagaaaatatcagaagacgctctcggaggagtcaccggaaggtccgttttccggtgttctagttataacagatgaagaagccgaaacagaggacacgttctgtttcgggatgtgtacgaggacaaaaatcgagaagcttccgttacctcaagacaagatcttatcagttgttcacttagacagttctggtaacagagagacttcggttaagaaggtcttgttcataccggctctcgatcaaccattgtcttcaaatcggtactacgtcgttcacgctagaggcagatacaaagggaaagtttccgtgtgttctagggagatagagaaaggggtatgttgttttccagatatcttgcatgacaagaaacctaaacctttggatccaagaaacatatatcagacggttaagatcaaccggcatcacgaccggacgttctttgggaaatcagtggcaccagatggtacaccgccttcatttctcaagaagaaaggatgggagctgcgaacctcgaggagcctacatccgaggagacctagagaagctctaggcctagacgatgagctaagagcccgtctccctgcattcggattcccagtctctacaattcggtcagggagcgtgatagtaggagaatggtattgcccgtttatgtttgtgaaggagaattgtagtttaagttaccaaatgaggaagtcaatgttctataggatcacactatcccaatactgggaacggatctatcattgtgaaaacaatgacgcccacaacaatattgacgaaaacaatgatgacaacgaagaagaagtggtgagcgtagaggcgaacgtcgtgagagaggccaactatgtgaagggtatggaggcggttaagggggagaaagaagggcatggaggatttcattggtataggcaagttcaaggtccacggggaccgggggagaggaggaggaaaaggggtgtaagttctccggtggggctgagttttgtggtggtagaaaggatgagaagagtaatggaggaaggagggtgggtgggtggaggaaggaaggtggtgagagtggagagagatgaaccaattaggatttctagaagagattggaggagatttgggtgttatgtgttggtggagagttttgggctgagaagagcagatggagttttgttggttaaatgtgtatttagacatactaatagacttagatgtaactgggagtaa

SEQ ID NO: 857 - DNA, 1589 bp, Eutrema halophilum
ctgttatatttggctttaacttcttttgttttctctttagaaaaataaagtcacgacttgcccaatcagctaacacttaaattaaactgctttaccctccactatcaaaagttacatcgagtcaccccactattctacaatcttgtcgttttcaaccccaaaattgttcaaatactttaataaaacccattaaaccgatactataacctcctcataatactaatacccttacagagtcaagaacaaaaatgtatgtgacgaggacactgtcgcagttcagaaaatttcagaagacactctcggaggagtcaccggaaggtccattctccggcgttcttgtaattacagacgaagaagcagaaacagaggacacgttctgtttcgggatatgtaagaggacaaaaatcgagaagcttccgttccctcaggacaagatcttatcaattgttcacagagacagttccggtaacagagagacttcggttaaaaaggtcttgttcataccggctcttgatcaaccattgtcttcaaatcggtattacgttgttcacgctagaggcagacacaaagggaaagtctgtgtgtgctcaagggagatagagaaagggttatgttgttttccagatatcttgcatgacaagaaacctaaacctttggatccaagaaacatatatcagacggttaagatcaaccgccatcacgagcggacgttctttgcaaaatccgttgctccagacggtacaccaccttcatttctcaagaagaaagggtgggagctacgaacttctaggagcctgcatccgaggagacctagagaagctctaggcctagacgatgagctaagagctcgtctccctgaatttggattcccgatctctacaattcgatccgggagcgtgatagtaggagaatggtattgcccgtttatgtttgtgaaggagaattgtagtgtaagtcaccaaatgaggaagtcaatgttctataggatgacactatcccaatactgggaacgaatctaccactgcgaaaacaataacttgaatgaaaccaacaacaatctcgacgaaaacaatggtgaaaatgaagaagaagtggtcagagtacacacgaacgtagtgagagaggcgaactatgttatgggcgtggaggcagttaagggagagaaagaagggcatggagggttttattggtataggccagttcaaggttcacggggaccaaatgaaaggaggaggaagacacgtttagggtctgccgtggggctgagtttcgctgtagtggaaaggatgagaagggtaatggaggaaggaggatgggtgggaggagggaggaaggtggtgagagtggagagagatgagcaaattagggtttctagaagagattttagggatatgaatggtaacaatgatagagattggaggagatttgggtgttatgtgttggtggagagttttgggttgagaagagctgatggagttttgttggttaaatgtgtatttagacatactcaaagactgagatgtaagtgggagtgactcttcattaattagtaattgtacatataatacttctatacaaaaattcccaag

SEQ ID NO: 858 - DNA, 1632 bp, Eutrema parvulum
tttatcttcttttcttttcttttctctttagaaaaacaaagtcacgacttgccaatcagcaaacatttaaattacacaactttgcccccactatcaaaagttacatcgagcctccccactactctataatcgtgtcgtttttaccctcaaaagtgttgaaaattctctaataaaacccatcaaatctatactaaaaacgcactcataatcacagttctcttaaaagcttcaagaacaaaaatgtacgtgacgaggacattgtcgcagttcagaaaatatcagaagacgctctcggaagagtcaccggaaggtcccttttccggcgttctggttattacagacgaagaagcagaaacagaggacacgttctgtttcgggatgtgtacgagaacaaaaatcgagaagctgccgttccctcaggacaagatcttatcagttgttcacacagacagttctggaaacagagagacttcggttaagaaggtcttgttcataccggctctcgatcaaccattgtcttcaaatcggtattacgtaattcacgctagaggcagacacaaagggaaagtttgtgtttgttctagggagatagggaaaggattatgttgttttccagatatcttgcatgacaagaaacctaaacctttggatccaagaaacatatatcagacggtgaagattaaccggcatcacgaccggacgttctttgcgaaatctgttgctccagaaggtacgccaccttcatttctcaagaagaaaggatgggaactacgaacctcgaggagccttcatccccgaagacctagagaagctctaggcctagacgatgaactaagagcccgtctgcctaaatctgatttcccgatctctacaattcggtcggggagtgtgatagtaggagaatggtattgcccgtttatgtttgtgaaggagaatcgtagtgtaagtcaccaaatgaggaagtcaatgttctataggatgacactatcccaatattgggaacggatctaccattgcgaaaacagtaacttgaatgaaaccaacaacgatcttgatgaaaatgaagaagaagtggtgagagtagacgcaacggtgatgagagaagtgaactatgtgatgggtatggaggcggttaagggggataaagaagagcatggagggttttattggtataggcaggttcaatgttcgctgggaccaagggagaagaggaggaggaagacaggttctggctctgcggtaggcttgagtttcgcggtggtggaaagaatgagaagggtaatggaggaaggaggatgggtgggaggagggaggaaggtagtgagagtggagagagatgagcaactcaaggattataaaagagattttaggaatatgaatggtaacaatgatagagattggaagagatttgggtgttacgtgttggtggagagttttgggttgagaagagcagatggagtgttgttggttaaatgtgtatttagacatactcaaagactgatttgtaagtgggagtgactcttcattatgttttaaaatatatatacatatatactaatattcctaagccttatggattattttcatgaaatactaggtatgattattagaacacgataaaaaaggcgagat

SEQ ID NO: 859 - DNA, 1353 bp, Arabidopsis lyrata
ggtaaacggcaaatacctttttctttcacttttctcttcttctcgaatctgagagagagatcaacattcaacaatggcggtcaaatcaaaactcgtctctcttctcttcctcgtagcaacactatcatccgcattcgcagcttcgttttccgattcagattccgattcagatcttctaaacgaacttgtatctctcagatcaacaagcgaatcaggcgtaatccatctcgatgaccatggaatctcaaaattcctaacctccgcttccactcctcgtccttactcgttactcgtcttcttcgacgcaactcagcttcacagcaaaaacgagcttcgtcttcaagagctccgtcgcgaattcggtatcgtctccgcttcattcctcgctaacaacaatggatctgaaggaactaagcttttcttctgtgagatcgagttttcacagtctcaatcttcgttccagctctttggcgttaacgctttacctcacattcgtcttgtaagtccttcgatatcgaatctacgtgatgaatctggtcaaatggatcaatcggattactctagattagcggaatcaatggctgagttcgtcgagcaacgaactaaactcaaggtcggtcctattcaacgtccaccgcttctatcgaaaccgcagatcggcgtaatcgttgcgttgatcgttatcgctactccgtttatcatcaaacgagttctaaaaggagaaactattcttcatgatagtagactttggttatctggtgctatcttcatttacttctttagcgttgctggtacaatgcacaacattatcaggaaaatgccgatgtttcttcaagatcgtaatgatccgaataagcttgtcttcttctaccaaggatctggaatgcagcttggagctgaaggatttgctgttggattcttgtatactgttgttggattgcttttggcgtttgttaccaatgtgcttgttcgagtgaagaatcttactgcacagagattgattatgcttttggctttgttcatatcgttctgggctgtgaagaaagttgtttacttggataattggaagactggatatggtattcatccgtattggccatcgagttggcgttgatttcgatcgacacacttgaggatatgtgtttcacaaggtaatggctttagttttggaaacaaacagttctgggaattgagtaatgatgttttggatgttttgtgtttcgatttgaaatacttttgaatcggtgtagtactactatttcagatggtttactttaaactccttactgctacattagtcccttgttaagttatttatctgaatgagtaacatatatgagcaagaatatggga

SEQ ID NO: 860 - DNA, 1369 bp, Eutrema parvulum
ggcaaaattaagagtctcgtggaaccctctccatcaactagaggctttctggtaaacggccagtaccctttttctttcacttttctcttctctttccgaatctgaaacttcacctggagagagacaaaccttcaaggtgagatcgacaatggcgattaataaaagactcttatctcttctatttcttttagcagccgtatcgtcgatcgtagctgcatctttctcggattctgattccgattcagatcttatcaacgagcttgtttcactcagatcagccaccgaatcaggcgttatccatctcgacgaccatggaatatccaaattcctcacttccgtttccactcctagaccttactccattctcgttttcttcgacgctactcagctccacagcaaaagcgagctacgtctccaggagcttcgtcgcgagttcggcatcgtctccgcttctttcctcgccaacaacaacggatccgatgcaaccaagcttttcttctgcgagatcgagttctcgcagtcccagtcttcgttccagctcttcggcgttaacgctctccctcacatccgccttgtaagccattcgatatcgaatcttcgcgacgaatccggtcagatggaccaatcggatttctctcgtttagcggaatccatggcggagttcgtcgaacagcgaacaaagctaaccgtcggtcctataaaacgaccgccgtttctctcgaaggcgcagatcagtgtcatcatcgcgttgatcgttatcgctactccgttcatcatcaaacggattctgaaaggagaaactcttctccatgaccgtaggctttggttatccggtgcaattttcatctacttcttcagcgtcgcgggtacaatgcacaacatcattaggaaaatgccgatgttccttcaggatcgtaacgatccaaacaagctcgttttcttctaccaaggatctggaatgcagcttggagccgaaggattcgctgtggggttcttgtacactgtggttggattgctcttggcgtttgtcaccaatgtgcttgttcgagttaggaacctcaatgcacaaagattggtaatgcttttggctctgttcatatcgttctgggctgtgaagaaagttgtttacttggataactggaagacaggatatgggattcatccgtattggccatcaagttggcgttgatttcactctcgttgaggtaatgggtttagttttcaaaacgtttcttgaacggagtaatgatattttggacattttgtgttttgattcgaatactttgaatcagtgtagtacaattttcagatggtttaaactcattactgcttactagttccttgttagtcattcatctgattgagaaac

SEQ ID NO: 861 - DNA, 1424 bp, Eutrema halophilum
aaaattaagagcctcgtagaccttcttcttgaaatagaagctttcttgtaaacgtcaatgcccttttttttttcttcggtcttcttccttcgctttccgaatctgaactcacctggaaaaagagagagagagaccttcaaggtgagatcgacaatggcgatcaataataataaactcttatctcttctattcctcttagcatccgtatcatcaatcgtatcagcttcgttttcggatccagattccgattcagatcttatcaacgagcttgtttctctcagatcagccgccgaatcaggcgtaatccgtctcgacgaccatggaatatccaaattcctcacctccgtttcaactccacgtccttactccatactcgtcttcttcgacgctactcagctacacagcaaaagcgagcttcgtcttcaggagctccgtcgtgagttcggcatcgtctccgcttccttcctcgccaacaacaatggatctcagggaaccaagctcttcttctgcgagatcgagttttcgaagtctcaatcgtctttccagctcttcggcgtcaacgctcttcctcacatccgtctcgttagtcctttgacatcgaacctccgcgacgaatctggtcaaatggaccaatcggattactctcgtttagcggaatcaatggctgagttcgtcgagcagcgaacaaagctcaccgtcggtccaattaaacggccgccgcttctttccaaatcgcagatcagtgtcatcgtagcgttgatcgttgtctcttctccgttcatcatcaaacggattctcaaaggagaaactcttctccatgaccgtaggctttggttatcaggtgctatattcatctacttcttcagcgtcgctggaacgatgcacaacatcatcaggaaaatgccgatgtttctccaggatcgtaacgatccgaacaagctcgttttcttctaccaaggatctgggatgcagcttggagctgagggattcgcggttggattcttgtatactgtggtgggattgcttttggcctttgtcaccaatgtgcttgtcaaagttaagaacctcaatgcacagagattggtgatgctttttgctctgttcgtatcgttctgggctgtgaagaaagtggtttacttggataattggaagactggatatgggattcatccgtattggccatcaagttggcgttgattttcactcctttttgaggaatgtgtctttcacaaaggtaatggatttagctttcgaaaacacttttggaaactgagtaatgacactttggagacgttttgtgtttcgattcgaatactttgaatcggtgtagtacaatattcagatggtttaagaactcattactgctatactagttccttgttagttttttacatctgattgagaaacatataaccaaaaatatg

SEQ ID NO: 862 - DNA, 1295 bp, Raphanus sativus
ggggcaatacctttctcttctctttccgaatctgagctcaccccccccctctttggagagagatcgattaacaatggcgatcaatagaaaactcgtatctcttctcttcctcttagcaaccgtatcatcattcgcatcagcatccttctccgatccagattccgactccgatctcgtcaacgaactcgtttccctgagatcaaactcagaatcaggcgtaatccatctcgacgacaatggaatctccaaattcctcatctcctcacccacaccacgaccttactccatcctcgtcttcttcgacgccactcagctccacagcaaaaccgagctccgtctccaagagctccgccgcgagttcggcctcgtctccgctaccttcctcgctaacaacaacggatccgatctaaacaagcttttcttctgcgagatcgagttctcccgatcccaagcttccttccagcgattcggcgttaacgctctccctcacatccgtcttgtatccggttcaacctcaaaactaagcgacgaatctggtcaaatggaccaatctgatttctctcgtttagctgaatccatggctgagttcgtcgagcaaagaaccaagctcaccgtcggtccgatccaacggccgccgtttctctccaaggcgcagatcagcgtcatcgttgctttgatcgttatcgccactccctttgtcatcaaacggattctgaaaggagaaactcttcttcatgaccgtaggctttggttatcaggtgctatctttatctacttcttcagcgtcgcgggaacaatgcacaacatcatcaggaagatgcctatgtttcttcaggatcgtaacgatcccaacaagcttgttttcttctaccaaggatctggaatgcagcttggagctgagggattcgctgtggggttcttgtacactgttgttggcttgctcttggcgtttgttactaatgtgcttgttcgagtaaggaatcttaatgttcagagattggtgatgcttgtggctctctttgtatccttctgggctgtcaagaaagttgttttcttggataattggaagactggctatgggattcatccctactggccttcaagttggcgttgatttctcaacctcttttgaggtgatgtgtttaattttcaagacatttctgggacattttgtgttttaacgaggtacaatttcagatggtttaaactcatcactactttactagttccttattacaccttcatctgattgagaaacattagatatacatctcttctttaggcaaaaaaaaaaa

SEQ ID NO: 863 - DNA, 1078 bp, Brassica napus
ggagagagacaaaccttcaagtgaggtcgatcaacaatggcgatcaataaaaaactcgtatctcttctcttcctcttagcagccgtatcatcattcgcatcagcatctttctccgactccgactccgactccgattcagatctcaccaacgaactcgtttccctcagatcaaactccgaatcaggcgtgatccatctcgacgaccatggaatctccaaattcctcatctcctctcccacaccacgaccttactcgatcctcgtcttcttcgacgccactcagctccacagcaaaaccgagctccgtctccaagagctccgccgcgagttcggcctcgtctccgctaacttcctcgctaacaacaacggatccgatctaaacaaacttttcttctgcgagatcgagttctcgcgatcccaatcttccttccagcggttcggcgttaacgctctccctcacatccgtcttgtaagcggttcaacatcaaaactaagcgatgaatctggtcaaatggaccagtcagatttcgctaggttagctgaatccatggctgagttcgtcgagcaaagaaccaaactaactgttggcccgatccaacggccgccgtttctctccaaggcgcagatcagcgtcatcgtagccatgatcgtgatcgcgactccgtttgtcatcaaacgtattctgaaaggagagactcttcttcatgatcgtaggctttggttatcaggtgctatcttcatctacttcttcagcgttgcaggaacaatgcacaacatcatcaggaagatgcctatgtttcttcaggatcgtaacgacccgaacaagctcgttttcttctaccaaggatctgggatgcagcttggagctgagggattcgctgtggggttcttgtacactgtggttggattgctcttggcgtttgtcactaatgtgcttgttcgagttaggaaccttaatgttcagagattggtgatgcttgtggccctgtttgtatccttctgggctgtgaagaaagtggtttacttggataattggaagactggatatgggattcatccgtattggccatcgagttggc

SEQ ID NO: 864 - DNA, 1127 bp, Brassica napus
gaggctctctggtaaacggcaatgccctcgtctttcacctttctctcctcctcccgaatttgaactcacctggacacaaaacaatggcgatcagtaaagaactcttatctcttctactcctcgtattctatctatcatcaatcgcatcatcatctttctcagatccagattccgattcagatctcaccaacgaactcgtttccctcagatcaaactccgaatcaggcgtaatccatctcgacgaccatggaatctccaaattcctcatctcctctcccacacctcgtccctactcaatcctcgtcttcttcgacgccactcaactccacagcaaaaccgagctccgtctccaagagctccgccgcgagttcggcctcgtctccgccaccttcctcgccaacaacaacggatccgatctaaacaagcttttcttctgcgagatcgagttctcgcggtcccaatcttccttccagcgattcggcgtcaacgctctccctcacatccgtctcgtaacaggttcaacatcgaaactaagcgacgaatctggtcaaatggatcagtctgatttcgcaaggttagccgaatccatggctgagttcgtcgagcagcgaaccaagctcaccgtcggtccgatccagcgtccgccgtttctttccaaggcgcagatcagcgtcatcgtggcgttgatcgttatcgctactccgtttgtcatcaaacggattctgaaaggagagactcttctccatgaccataggctttggttatcaggcgctatcttcatctacttcttcagcgtcgcgggaacaatgcacaacattatcaggaagatgcctatgtttcttcaggatcgtaacgacccgaacaagcttgttttcttctaccaaggatctgggatgcagcttggagctgagggattcgctgtggggttcttgtacactgtcgttgggttgctcttggcgtttgttactaatgtgcttgttcgagttaggaaccttaatgttcagagactggtgatgcttgtggctctggttgtatcctcctgggctgtgaagcaagttgtttacttggataattggaagactggttatgggattcatgcctattggccatcgagttggcagtgattt

SEQ ID NO: 865 - DNA, 1228 bp, Brassica rapa
gccggtaaacgggcaataccctcgtctttcacctttctcttctcctcccgaatttgaactcacctggtggacaagacaatggcgatcgataaaaaactcttatctcttctactcctcgtatcctccttatcatcaatcgcatcagcatccttctcagatccagattccgattcagatctcaccaacgagctcgcttccctgagatcaaactccgaatcaggcgtaatccatctcgacgaccatggaatctccaaattcctcatctcctctcccactccacgtccttactcaatcctcgtcttcttcgacgccactcagctccacagcaaaacggagctccgtctccaagagctccgccgcgagttcggcctcgtctccgccaccttcctcgccaacaacaacggatccgatctgaacaagcttttcttctgcgagatcgagttctcgcggtcccagtcttccttccagcgattcggcgtcaacgctctccctcacatccgtctcgtaaccgcttcaacagcgaaactaagcgacgaatctggtcaaatggaccagtctgatttcgcgaggttagccgaatccatggctgagttcgtcgagcagcgaaccaagctcaccgtcggtccgatccaacgtccgccgtttctttccaaggcgcagatcagcgtcatcgtggcgatgatcgtaatcgcgactccgtttgtcatcaaacggattctgagaggagagactcttctccatgaccataggctttggttatcaggcgctatcttcatctacttcttcagcgtcgcgggaacgatgcacaacattatcaggaaaatgcctatgtttctccaggatcgtaacgatccgaacaagcttgttttcttctaccaaggatctgggatgcagcttggagctgaggggttcgctgtggggttcttgtacactgtcgttgggttgctcttggcgtttgttactaatgtgcttgttcgggttaggaaccttaatgttcagagactggtgatgcttgtggctctggttgtgtcctcctgggctgtgaagcaagttgtttacttggataattggaagactggttatgggattcatccctattggccatcgagttggcagtgaggtgatgggggtttagttttcaagacattttctggaactgagttattatgatatgttggactttttgtgttttgaatcattgtagtacaatttcagatggttttaaact

SEQ ID NO: 866 - DNA, 1294 bp, Brassica napus
gggcaaaatgaagagcttcgtagaccttcttctccaactagaggctctccggtaaacgggcaataccctcgtctttcaccttcctcttctcctcccgaatttgaactcacccacctggacatgacaatggcgatcgataaaaaactcttatctcttctactcctcgtatcctccctatcatcaatcgcatcagcatccttctcagatccagattccgattcagatctcaccaacgagctcgcttccctgagatcaaactccgaatcaggcgtaatccatctcgacgaccatggaatctccaaattcctcatctcctctcccacacctcgtccctactcaatcctcctcttcttcgacgccactcagctccacagcaaaaccgagctccgtctccaagagctccgccgcgagttcggcctcgtctccgccaccttcctcgccaacaacaacggatccgatctgaacaagcttttcttctgcgagatcgagttctcgcggtcccaatcttccttccagcgattcggcgtcaacgctctccctcacatccgtctcgtaaccggttcaacagcgaaactaagcgacgaatctggtcaaatggaccagtctgatttcgcgaggttagccgaatccatggctgagttcgtcgagcagcgaaccaagctcaccgtcggtccgatccaacgtccgccgtttctttccaaggcgcagatcagcgtcatcgtggcgatgatcgtaatcgcgactccgtttgtcatcaaacggattctgagaggagagactcttctccatgaccataggctttggttatcaggcgctatcttcatctacttcttcagcgtcgcgggaacgatgcacaacattatcaggaagatgcctatgtttctccaggatcgtaacgatccgaacaagcttgttttcttctaccaaggatctgggatgcagcttggagctgaggggttcgctgtggggttcttgtacactgtcgttgggttgctcttggcgtttgttactaatgtgcttgttcgggttaggaaccttaatgttcagagactggtgatgcttgtggctctggttgtgtcctcctgggctgtgaagcaagttgtttacttggataattggaagactggttatgggattcatccctattggccatcgagttggcagtgaggtgatgggggtttagttttcaagacattttctggaactgagttattatgatatgatggacgttttgtgttttgaatcagtgtagtacaatttcagatggttttaaactcagtactgctttactact

SEQ ID NO: 867 - DNA, 1352 bp, Brassica napus
gagaggctctctggtaaacggcaatgccctcgtctttcacctttctctcctcctcccgaatttgaactcacctggacacaaaacaatggcgatcagtaaagaactcttatctcttctactcctcgtattctatctatcatcaatcgcatcatcatctttctcagatccagattccgattcagatctcaccaacgaactcgtttccctcagatcaaactccgaatcaggcgtaatccatctcgacgaccatggaatctccaaattcctcatctcctctcccacacctcgtccctactcaatcctcgtcttcttcgacgccactcaactccacagcaaaaccgagctccgtctccaagagctccgccgcgagttcggcctcgtctccgccaccttcctcgccaacaacaacggatccgatctaaacaagcttttcttctgcgagatcgagttctcgcggtcccaatcttccttccagcgattcggcgtcaacgctctccctcacatccgtctcgtaacaggttcaacatcgaaactaagcgacgaatctggtcaaatggatcagtctgattttgcaaggttagccgaatccatggctgagttcgtcgagcagcgaaccaagctcaccgtcggtccgatccagcgtccgccgtttctttccaaggcgcagatcaacgtcatcgtggcgatgttcgttatcgctactccgtttgtcatcaaacggattctgaaaggagagactcttctccatgaccataggctttggttatcaggcgctatcttcatctacttcttcagcgtcgcgggaacaatgcacaacattataaggaagatgcctatgtttcttcaggatcgtaacgacccgaacaagcttgttttcttctaccaaggatctgggatgcagcttggagctgagggattcgctgtggggttcttgtacactgtcgttgggttgctcttggcgtttgttactaatgtgcttgttcgagttaggaaccttaatgttcagagactggtgatgcttgtggctctggttgtatcctcctgggctgtgaagcaagttgtttacttggataattggaagactggttatagtattcatccctattggccatcgagttggcagtgatttcacctcgtttgaggtgatgggggtttagttttcaagacattttctggaactgagttattattatatgttggacgttttctgttttgattctagtactttgaatcagtgtagtacaatttcagatggtttaaactcatttttctgctttccttgttacttttttagtcagtgacaaccattgctccctgttctgtaggctctgtataggaggaaccatactcag

SEQ ID NO: 868 - DNA, 1388 bp, Brassica napus
gaggctctccggtaaacgggcaataccctcgtctttcacctttctcttctcctcccgaatttgactcacctggtggacaagacaatggcgatcgataaaaaactcttatctcttctactcctcgtatcctccctatcatcaatcgcatcagcatccttctcagatccagattccgattcagatctcaccaacgagctcgcttccctgagatcaaactccgaatcaggcgtaatccatctcgacgaccatggaatctccaaattcctcatctcctctcccgcacctcgtccttactcaatcctcgtcttcttcgacgccactcagctccacagcaaaaccgagctccgtctccaagagctccgccgcgaattcggcctcgtctccgccaccttcctcgccaacaacaacggatccgatctgaacaagcttttcttctgcgagatcgagttctcgcggtcccagtcttccttccagcgattcggcgtcaacgctctccctcacatccgtctcgtaaccgcttcaacagcgaaactaagcgacgaatctggtcaaatggaccagtctgatttcgcgaggttagccgaatccatggctgagttcgtcgagcagcgaaccaagctcaccgtcggtccgatccaacgtccgccgtttctttccaaggcgcagatcagcgtcatcgtggcgatgatcgtaatcgcgactccgtttgtcatcaaacggattctgagaggagagactcttctccatgaccataggctttggttatcaggcgctatcttcatctacttcttcagcgtcgcgggaacgatgcacaacattatcaggaaaatgcctatgtttctccaggatcgtaacgatccgaacaagcttgttttcttctaccaaggatctgggatgcagcttggagctgaggggttcgctgtggggttcttgtacactgtcgttgggttgctcttggcgtttgttactaatgtgcttgttcgggttaggaaccttaatgttcagagactggtgatgcttgtggctctggttgtgtcctcctgggctgtgaagcaagttgtttacttggataattggaagactggttatgggattcatccctattggccatcgagttggcagtgaggtgatgggggtttagttttcaagacattttctggaactgagttattatgatatgatggacgttttgtgttttgaatcagtgtagtacaatttcagatggttttaaactcagtactgctttactacttccttgttactctatatagtcagtgacaaccattgcccactgttctgtaggctctgtataggaggagccatactcagaaattcagattcttttgggctctctatctgcatattgccaaattgttaggataagtgaa

SEQ ID NO: 869 - DNA, 1301 bp, Raphanus sativus
  misc_feature (64)..(64): n is a, c, g, or t
  misc_feature (201)..(201): n is a, c, g, or t
  misc_feature (447)..(447): n is a, c, g, or t
  misc_feature (720)..(720): n is a, c, g, or t
  misc_feature (933)..(933): n is a, c, g, or t
  misc_feature (1047)..(1047): n is a, c, g, or t
  misc_feature (1089)..(1089): n is a, c, g, or t
  misc_feature (1203)..(1203): n is a, c, g, or t
  misc_feature (1233)..(1233): n is a, c, g, or t
  misc_feature (1247)..(1247): n is a, c, g, or t
acaatggcgatcaataaaaaactcttatctcttatactcctcgtatcctccctatcatcaatcncatcatcatcatctttctcagatcccgattccgattcagatctcaccaacgaactcgtctccctcagatcaaactccgaatcaggcgtaatccatctcgacgaccatggaatctccaaattcctcatctcctccccnactccacgcccttactccatcctcgtcttcttcgacgccactcagctccacagcaaaaccgagctccgtctccaagagctccgccgcgaattccacctcctctccgccaccttcctcgccgctaacaacaacggatccgatctaaacaaactcttcttctgcgagatcgagttctcccagtcccaatcctccttcaaacgattcaacgtcaacgctctccctcacatccgtctcgtaaccgcctcnacgtcgaaactaaccgacgagtccggacaaatggatcaatccgatttctctaggttagccgaatcaatggccgagttcgtcgagcagcgaaccaaactcaccgtaggtccgatccagcgcccgccgcttctctccaagccccagatcagcgtcatcgtggcgatgatcgtcgtcgctactccgttcgtcatcaaacggattcttagaggagagactcttctccatgaccacaggctttggctatcaggcgccatcttcgtctacttcttcagngtggcggggacgatgcacaacattatcaggaagatgcctatgtttctccaggatcgtaacgatccgaacaagcttgttttcttctaccaaggatcagggatgcagcttggagctgaggggttcgctgtggggttcttgtacactgtggttgggttgctcttggcgtttgttactaacgtgcttgttcgagttgggaacgttaatgttcagagnttggtgatgcttgtggctctggttgtgtcctcctgggctgtgaagcaggttgtttacttggataattggaagactggttatgggattcatccctattggccttctagttggcantgatttcacactcgttgggtttagttttcaagacgttttctngaacttgagttatgatatgttggacgtttttttttgtgttttgattctctactactttgaatcagtgtagtacaatttcagatggtttaaactcattactgttttcctagttcnttgttactctctagtcagtgacaaccattnctcactgctctgtnggctatgtataagaggaaccatattcagaaattcagatacttttgggctgtcta

SEQ ID NO: 870 - DNA, 2324 bp, Arabidopsis lyrata
aattttattatttgattttcagtcctatctcttgtcttgttctgagatcagatgtataaaaaagagacttcttttcttcttctctcttgattctctcttccactgtcattatcctcaagatttgtctcttgtgagactcgatgacgcttcatcgatctcttgtgttctttttcttgttcctctcatgtttctctctttcttcatgggctcttcctctctgttccgattcaagagctccctcggaggtgaattcgacattgagcttttgtccttacaaaggaaaaacatgctgcaattcaatggaagattccagtttgatgaagcaatttcaagctatgaacatttccgacaagggttgtgcttctgttgtaaaatcaatcctttgtgctaaatgcgatcctttttcatcggatttattcagagataactcagatcagcagtctgttccaatcctctgcaactctaccagttcagcaaattccacagaggatttttgctctgagacatgggagacatgtcaaaacgtttccatatcgggttctcttttcgctgcctcattgcaaggccgagctggagccccagcaaataacaatgcctccaagcttgctgatgtatggcagtccaaaaccgatttctgtagtgcctttggtggagctagctccaatgaaactgtttgcttcagcggtgagccagttgctcttactgacaatgacactactcctgacaagccgccttctggtttatgccttgagaaaatcgggaatggttcttacctcaacatggttccccaccctgatggctccaaccgtgcattcttctctacgcaacctggaatagtattcttggctggtataccggatcaagattctggcggggtattggacgtggatccatctagcccgtttgtggatttgactgatgagattcattttgatactgagtttgggatgatgggaatggcttttcatccaaagtttgctcaaaatgggcggtatttcgcttcttttaactgtgataagtccaagtggccgggctgtactggaaggtgctcatgtaactccgatgtgaactgtgatccttccaaactaactcctgacagtggatctcaaccttgccaattccaaaccgtaatagctgagtatacagccaatggtacctcatcagacccttctaaggcaaagaatgctaagccaacagaagtcaggaggattttcacaatgggacttcccttcacatcacaccatgctggacagattctctttggtccagatgggtatctatactttatgatgggagatggaggtggaggcgcagacccatacaatttctcacagaacaagaaatctttgctaggaaagatcatgaggcttgatgtagataacattcctagtgcttctgagatctccaaaatgggtctatggggaaactactctataccaaaagacaacccttttcgtgaagacaaagagcttgaacctgaaatatgggctattggattgagaaacccttggagatgcagctttgattcttctaggccttcttactttatgtgtgctgatgttggacaggacacatatgaagaggtggatctcattaccaaaggaggaaactacggttggcgtgtttacgaaggcccggatcttttccagccggaggcatcccccggaggaaacacatctattaaatcattaaacccaatatttcctgtgatgggttacaaccactctgaagttgactcaagcggaaaatcagcttcaatcactggagggtacttttatagatctgagactgatccttgcatagctggaatgtatgtgtatgctgatctatatggaaatggcgtgtgggcggggattgaaactcctgctaatagcgggaactttgtgaccaacagaacaaccttcagctgcgccggtgactcacccatgaaatgcagcgattctccgggaacttcagggttatctctaggatatgtcttctcctttggtgaggataacaacaaagacatctacttgcttacaagcaatggtgtctatagagtggttaggccgagccgttgcaacttgacttgctccaaggaaaactccacggcagctagaagaaaacccggtccctcgagttctccttcttcttcgccgtcctcttgttataagcatataaatggtttccatggaagcttcgtggttttatttgtgtctctgtctttgattctgctaggtttattaaactagtttttcaaaagttgtttcttcttgtttgtgttgaaaagtatgttgaggatggtttgagagaatacatgtatgatgatgaatgagaccaaagat

SEQ ID NO: 871 - DNA, 2563 bp, Eutrema halophilum
tcgtcctctctttctttgacacgagacagttgaaagttcaaacatgatgatattcaataattgataacagatgagagatttctggggatatggttgttggtagtcatgggaagacagtaaacgccatcgcaactgcatttattctgtctgtagagtcaaacaaactaattttattattatttgctcatctcttgtcctgtcctgagatcagatgcagtataaaacagaggcttctttattcttttcttttctactgtcattatccattatccccaagatttgtctcttctgagacacgatgacgcttcatcgatctcttgtgttcttcttcttgttcctttcatgcttcgctctttcttcatgggctcttcctctatgttccgattcaagagctcccttggaggtgaattcaacattgagcttttgcccttacaaaggaaaaacatgctgcgatacaatggaagattccaatttgaataaacaatttcaagctatgaacatttcggacaagggttgtgcttctattgtaaagtcaatcctctgtgctaaatgcgatcctttttcatcggacttattcagagataattcagatcagcagtctgttccaatcctctgcaactcaaccagttcagcaaattccacaaaggacttttgctctgagacatgggagacatgccaaaacgtatccatatcgggttctcttttcgctgcctcgttgcaaggccgagtcggagcgccagctaacaacaatgcctctaagctcgctgatctatggcagtccaaaaccgatttctgcagctcctttggtggagctagctccaatgaaactgtttgctttagcggtgagccagttactctcaatgacactactcctgacaaaccgcctcctggtctttgccttgagaaaatcggcaacggctcttacctcaacatggttcctcaccctgatggctcgaaccgtgcattcttctctacacaacctggaatagtgttcttggctggtctaccggatcaggattcgggcggggtactggatgtggatccatctagcccgtttgtagatttgactgatgaagttcattttgatacagagtttgggatgatgggtatggcttttcatccaaagtttgctcaaaatgggcgctttttcgcttctttcaactgtgataagtccaagtggccaggctgtactggaagatgctcgtgcaactccgatgtgaactgtgatccttctaaactaactcctgacagtggttctcaaccatgccaattccaaactgtaatagctgagtatacaaccaatggaacttcctcagacccttctaaggcaaagaacgctaagccgactgaagtccggaggattttcacaatgggacttcccttcacatctcaccatgctggacagattctctttggtccttcagatgggtacctatactttatgatgggagatggaggtggaggcgcagacccgtataatttcgcacagaacaagaagtctttgcttggaaagatcatgaggcttgatgtagataacattcctagtgcttctgagatttccaaaatgggtctttgggggaactactctataccaaaagacaaccctttccgtgaagacaaagagcttgaaccagaaatatgggctgttggattgaggaacccttggagatgcagctttgattcttctaggccttcctacttcatgtgtgctgatgttggacaggacacatatgaagaggttgatctcattaccaaaggaggaaactacggttggcgtgtttacgaaggcccggatcttttccatcccgagtcatcccctggaggaaagacatctgctaaatccgtaaactcgatatttcctgtgatgggttacaatcactccgaagttgactcaagcggaaaatcagcttcaatcactggaggatacttttatagatcagagactgatccttgcatagctggaatgtacttgtatgctgatctatatggaaatggagtgtgggcagggattgagacgcccgctaatagcggtaactttgtgagcaacagaacaacctttagctgtgctggtgactcaccaatgaaatgcagcgattctccgggatctacaggtttaactctaggctatatcttctcctttggggaggataacaacaaagacatctacttgctcacaagcaatggtgtctatagagtggttaggccaagccgttgcaacttgacttgctccaaggagaataccacggcggctagaagaaaccccagtccctcgagttctccttcttcttcagcgtcttcttgttataggcatatgaatggtttccatggaagctcggtggttttattggtgtctctatctctgattctgctggttttgttagtgtaaatgtacaatgttgaaaaggtttaatctttttcataggatgaaagtttccaaaagttgtcccttgtttgtgtttaagaagattcgtgagttttgttattgaattgtatcttcaggatgttttgagaggatacatgtatgatgaatgagacagattgaggtaaaattttcaaacttcac

SEQ ID NO: 872 - DNA, 2568 bp, Eutrema parvulum
aaagataaagacagaaactttgtccatcgcctctctctttgacacgagaaagttgaaaaattcaaagcgaacatgatgagattcattaattatatcagaggagagatttctgaggatatggttgttggtagtcatgggaagacagtaaacgccatcgcaactgcatttattctgtctgtagagtcaaacaaactaattttattatttgcctatctctttgtcctgtcctgagatcaggtgtataaaatagagattcatttcttttccactgtcattatctattccccaagagttgtctcttctgagacacgatgacgcttcatcgatctcttctgttcttcttcttgttcctctcatgcttcggtctttcttcatgggctcttcctctttgttccgattcaagagctcccttggagttgaattcgacattgagcttttgtccgtacaaaggcaaaacatgctgcgatacaaaggaagattccaatttgaacaagcaatttcaagctatgaacatttcggacaagggttgtgcttctgttgtaaagtcaatcctttgtgctaaatgcgatcctttttcatcggacttattcagagataactcagatgagcagtctgttccaatcctctgcaactctacagattcagtaaattccacaaagaacttttgctctgagacatgggatacatgtcaaaacgtttccatatcgggttctctttttgctccctcgctgctaggccgtgctggagcgccaacgaataccaatgcctccaagctggctgatctatggcagtccaaaaccgatttttgcagtgcctttggtggagctagttccaatgaaaccatttgctttagcggccagccagttactcttagtgacactactcctgacaagcctcctcctggtctatgccttgagaaaatcgggaacggctcttacctcaacatggttcctcaccctgatggctccaaccgtgcgttcttctctacacaacctggaatagtattcttggctggtataccagatcaggactcgggcggtgtattggatgtggatccatctagcgcgtttgtggatttgactgatgaagttcactttgatactgagtttgggatgatgggtatggcttttcatccaaagtttgctcaaaatgggaggtttttcgcttctttcaactgcgataagtccaaatggtcaggctgtactggaagatgctcgtgtaactcggatgtgaactgtgatccttccaaactaactcctgacagtggatctcaaccatgccaattccaaactgtaatagcagagtattcaaccaatggtacctcatcagacccttctaaggcgaagaacgctaagccaacagaagtcaggaggatcttcactatgggactgcctttcacatctcaccatgctggacagattctctttggtccctcagatgggtacctatactttatgatgggagatggaggtggaggcgcagacccgtataatttctcacagaacaagaaatctttgctaggaaaaatcatgaggcttgatgtagataacattcctagtgattctgaaatctccaaaatgggtctatggggaaactactctgtaccaaaagacaatcctttccgagaagacaaagagcttgaacctgaaatatgggccgttggattgagaaacccttggagatgcagctttgattcttctaggccttcctacttcatgtgtgctgatgttgggcaggacacatatgaagaggtggatctcattacgaaaggaggaaactacggttggcgtgtttatgaaggcctggatcttttccatccggagtcatcccctggaggaaacacatctgctaaatccttaaacccgatatttcctgtgatgggttacaaccactctgaagttgattcaagcggaaagtcagcttcaatcactggaggatacttctatagatcagagactgatccttgcgtagctggaatgtacttgtatgctgatctgtatggaaacggagtgtgggcagggattgaaacgccagctagcagcgggaactttgtgtccaacagaataacatttagctgtgccggtgactcacccatgaaatgcagcgattccccgggaacttcagggttatctctaggctatatcttctcctttggtgaggataacaacaaagacatctacttgctcacaagcaatggcgtctatagagtggttaggccgagccgctgcaacttgacttgctccaaggagaattccacggcggctaggagaagcccaagtccctcgatttctccttcttcttcgtcgtcgtcttgttataggcatatgaattgtttccatggaagcttggtggtttcattggtgtctttgtctctgattctgctggctttgttagtgtaaatgtatgtggaaaaagtttaatcttttttcattggatgaaagttttcaagagctgtcccttgtttgtgtttaagaagattcgtgagttttgtaattgaattgaattgtatcttcaggaatacattatactgtacatgtatgatgaatgagacagattgaggagatattt

SEQ ID NO: 873 - DNA, 2490 bp, Brassica napus
caacatgatgatagtattcattaaataatatcagaggagagatttctggggatatggttgttggtagtcatgggaagacagtaaacgccatcgcaactgcatttattctgtccgcaaagtcaaacaaactaaactagttctctattattttgattccttgtcctgtcctgagaatcagatgtataaaatacagacttcttttcttttccactgtcattatccatacctcaagatctgtctcttgtgagacaagatgatgatacttcatcgatctcttgtgatcttcttcttgtgcatcttatgctcgactctttcttcattggcccttcctctttgttctgattcaagagctcccttagaggggaattcaacattgagcttttgtccttacaaaggcaaaacatgctgcgatacaaaggaagattcaaatctgaacaagcagtttcagtctatgaacatttcagacaaggcttgtgcttctgttgtaaagtcaatcctttgttctagatgtgatcctttttcatcagaattattcagagaccattcagatcagctatctgttccaatcctctgcagcaataccagttcagctaattccactaaggacttctgctctgaaacatgggagacatgtcaaaacatctccataacaggctctcttttcgctccctcgttacaaggccaagctggagcaccagtgaacaccaacgtctccaagctttctgatctatggcagtccaaaactgatttctgcagcgcctttgctagctccaatgaaaccatttgcttcagcggagagccagttactcttaatgacaccactcctgaaaagcctcctcctggtctatgccttgagaaaatcggaaacggatcttacctcaacatggttcctcaccctgatggctcaaaccgcgccttcttctctacacaacctggagtagtgttcttggctggtttacaggatcaggactcgggtggggtcttggatgtggatccatctagtccctttgttgatttgactgatgaagttcattttgatacttcttttggaatgatgggtatggcttttcatcccaagtttgctcagaacgggcggtttttcgcttctttcaactgtgataagtccaagtggccaggctgtactggaagatgctcttgtaactctgatgtgaactgtgatccttccaagataactcctgatagtggatctcaaccatgccagttccaaactgtaatagctgagtactcagccaatggtacctcatcagacccttctaaggccaagaacgctaagccaacagaagtcaggaggatattcacaatgggacttcctttcacatcacaccatgctggacagattctctttggtccttctgatgggtacttatactttatgatgggagatggaggtggaggcgccgacccttataacttctcacagaacaagaagtctttgctagggaagatcatgaggcttgatgtagataacattcctagcgcttctgatatctccaaaaggggtctgtggggaaactactctatccctaaagacaaccctttccgtgaagacaaagagcttgaacctgagatatgggctgttggattgagaaacccttggagatgcagctttgattcttctaggccttcttacttcatgtgtgctgatgttggacaggacacatatgaagaggtggatcttattaccaaaggaggaaactacggttggcgtgtgtatgaaggccctgagcttttccaacctgagtcatcacctggtggaaacacatctgctaaatcaataaacactatattccctgtgatgggttacaaccattctgaagttgactcaagtggaaaatcagcttcaatcactggaggatacttttacagatcagagacagatccttgcatagatggaatgtacttgtatgctgatctttatggaaatggagtgtgggcagggattgaaacgcctgctaatagcgggaactttgtgtcccacagaataaccttcagctgcgccagtgactcaccaatgaaatgtgatgattctccggggacttcagggttgtctttaggatatatcttctcatttggtgaggacaacaacaaagacatctacttactcacaagcaatggtgtctatagagtggttaggccaagccgctgcaacttgacttgctccaaggagaactccacagtagctagaagaaaccctggtccctcggtttctccttcttcttcttcgtcttcttgttatatgcatatgaatggtttccatggaatcttggtgtctttgtctttgattctactggctttgttagtgtaagtgtatgtggagaaggtctatctttttttcatatgttttaaagaatatttgtgagttctgttattcaatttgtatgatcaggatgttctgagagactgcacacatacatgtatcataaatgagacaggttgaagagatttttacaaatgtatgttatttgaaac

SEQ ID NO: 874 - DNA, 1085 bp, Arabidopsis lyrata
ctcgatttagagagagaacaagacttattcaagcttcgaacaatgtcgatgttaatggctgtgaaaaccacttcgctctgttgcagcagcttaaacctgagggcttcaccaacattccgacggaatccacgagcggcgagattgatgaatccgacggcgagaatccaaacacgtattcatcgtctgattgaagaacaaggcattgttcttatgcctggatgctacgacgccttatcggcggctattgtgcagcaaaccggattctccgctggttttatatccggttacgccttatccgcttctcttctgggaaaacccgatttcggtttgctaacaccaccggagatggctgcgacggcaaggtcggtgtgtgcgtcagctccaaatataccaatcattgcagatgctgataccggtggtggaaatgcgcttaacgttcaaagaaccgttaaggatttgattgcagcaggtgcttctggttgcttccttgaggaccaagcatggccaaagaagtgtggtcatatgcgtggtaaacaggtgataccagctgaagaacatgccgctaaaatagcatcagccagagacgctatcggagactctgaattctttcttgttgcaagaacagatgtgcgtgctacttctgcaaaatcaggtcttgaagacgctattgcacgggttaatctctacatggaggcgggagctgatgcttcctttgtagaggcaccaagagacgacgatgagctcaaggaaattggaaaacgcacaaaaggttatagagtttgcaacatgattgaaggaggagtcacaccattgcacacgcctgttgagcttaaagaaatggggtttcacttgatcgttcacccgcttaccgcactctatgcatcgactcgagctctggttgatgttctcaagactcttaaagaaaacggaagcactcgagatcacttgcaaaagatggctacttttgaggaattcaatagtttagtggatttagattcatggtttgagctcgaagctcgctattcaaacctcaggaacgctcttgggacaacaaaatcatgaagatagacacaactttttttttt

SEQ ID NO: 875 - DNA, 1348 bp, Eutrema halophilum
ggcctcggttttctcgtctcccttctccaattaaacggctttgataagaaagagagagagcgagagacagagaagaaagacttatcgagcttggattcgaagaatgtcgatgctcatggcgctcaaaaccacttccctttgcagcaccttaaacctgactccttcacctagaatccagacgaatcctcgcgcggcgagatcggtgaatccgacggcgagaatccaaacacgtatccatcgtctgattgaagaccaaggcattgtccttatgcctggatgctacgacgccttatcggccgccatcgtccaacagaccggattctccgccggttttatctccggttacgctctctccgcttctttattgggaaaacccgatttcggtttgctaacaccgccggagatggctgcgacggcgaggtcggtgtgtgcgtcagctccaaatatacccatcattgcagatgccgataccggtggaggaaatgcgctaaacgttcaaagaactgtaaaggacttgatcgcagctggtgctgctggttgcttccttgaggaccaagcatggccaaagaaatgcggtcacatgcgcggcaaacaggttatatcagcagaagaacatgcagccaagatagcatcagccagagacgctattggagattccgacttctttcttgtcgcaagaacagacgtgcgtgctacttctgcaaaatcaggtcttgaagacgccattgcgcgagttaatctctacatggaggctggagcggatgcttcctttgtggaggctccgagagatgatgatgagctcaaggaaatcggaaaacgtacaaagggttacagagtttgcaacatgattgaaggtggagtcacgccattgcacacccctgaggagcttaaagaaatgggttttcacttgatcgttcaccctctaaccgcactctatgcatccactcgagctttggtcgatgtactcaagactcttaaagaaaacggaagcactcgagatcacttggaaaagatggctacctttgaggaattcaatactttggtggatttagagtcatggtttgagcttgaagctcgctactcaaaccttaggaacgctcttgggacaacaaaatcatgaagaggctacgacacagacgcaagtttctcctttttttttttaactctctcaagcttaaatttgtttcctattttttgttcagacgattatttgagcaatggtctcatcaataatgtaactttttcagtcgtaaagaaattcgtatttccaatttagcagaataaccatctataatgaacaatgtcctgagcaaaataagcgatctccatgctgatgtaattattgatg

SEQ ID NO: 876 - DNA, 1308 bp, Eutrema parvulum
taaccgaacctcacttttggtccatttatcggcgtcggttttctcgtctccactctctaatcaaacggcacgagagagagagagagaaagagaagaaagacttgtcgagcttctaagaatgtcgatgttaatggcggtcaaaaccacttccctctgcagcaccttaaacctgacggcttcaccgggaatccggagtacgaatcctcgcgcggcgagatcggtgaatccgacggcgagagtccaaacacgtattcatcgtgtgattgaagaacaaggcattatccttatgcctggatgctacgacgccttatcggccgccatcgtgcagcaaaccggattctccgccggtttcatctccggttacgctctctccgcttctctattgggaaaacccgatttcggtttgctaacgccgccggagatggctgcgacagcaagatcggtgtgtgcctcggctccaaatatacccatcattgcagatgccgatactggtggaggaaatgcgctaaacgttcaaagaactgtaaaggacttgatcgcagctggtgctgctggttgcttccttgaggaccaagcatggccaaagaaatgcggtcatatgcgcggcaaacaggttatatcagcagaagaacatgctgccaagatagcatcagctcgagacgctattggagattctgacttcttccttgttgcaagaacagacacacgtgctacttctgcaaaatcagggcttgaagatgccattgcgcgtgttaatctctacatggaggcgggagcggatgcttcctttgtggaggcaccgagagacgatgatgagctcaaggaaattggaaaacgcacaaagggtttcagagtttgcaacatgattgaagggggagtcacaccattgcacacccctgaggagcttaaagaaatgggatttcacttgattgttcacccgttaaccgcactctatgcatcagctcgagctctggtcgatgttctcaagactcttaaagaaaacggaaccacgcgagatcacttgcaaaagatggctacttttgaggaattcaatagtttggtggatttagagtcatggtttgagctcgaagctcgctactcaaaccttaggaatgctcttgggacgacaacaaaatcatgaagaggctgctgcagtgctgcgacagagacacaagtttttctttggttcaagtctctctcaagctcttttgtttgctaatttttccgacgattatttgagcattttttcttatcaataatgtaacttttgcagtcatataaattcgaatacccaatttagcagaaaaa

SEQ ID NO: 877 - DNA, 1347 bp, Eutrema halophilum
acgtaaccaaacctcactttaataagtgttggtccatttatcggcctcggttttctcgtctccacactccaattaaacggcacgatagagagaagagaagacttatcgagaggagcttccaagaatgtcgatgctaatggcagccaaaaccacttccctctgcagcactttaaacctgacggcttcaccaagaatccgaaccacgaatcctcgcgcggcgagatcggtgaatccgacggcgagaatccaaacacgcattcatcgtttgattgaagaccaaggcattatcctcatgcctggatgctacgacgccttatcggccgccatcgtccagcaaaccggattctccgccggtttcatatccggttatgcactctccgcttctcttttgggaaaacccgatttcggtttgctaacacccccggagatggctgcgacggcaaggtccgtgtgtgcttccgctccaaatatacccatcattgcagatgccgatactggtggaggaaatgcgctaaacgttcaaagaactataaaggatttgatcgcagctggtgctgctggttgcttccttgaggaccaagcgtggccaaagaaatgcggtcatatgcgaggcaaacaggttatatcagcagaagaacacgctgccaagatagcatcagccagagacgctatcggagattctgacttcttccttgtcgctagaacagacgcacgtgctacttctgctaaatcagggcttgaagacgccattgcgcgtgttaatctctacatggaggcgggagcggatgcttcctttgtggaggcaccaagagacgatgatgagctcaaggaaattggaaagcgcacaaagggtttcagagtttgcaacatgattgaaggcggagtcacgccattgcacacccctgaggagcttaaagaaatgggatttcacttgattgttcacccgttgacagcactctatgcatccactcgagctctggtcgatgttctcaagactcttaaagaaaaaggaaccacgcgagatcacttgcaaaagatggctacttttgaggaattcaacagcttggtggatttagagtcatggtttgagctcgaagctcgctactcaaacctgaggaacgctcttgggacgacaacaaaatcatgaagaggctgctcctacagagacccaagcctttttttttttttttttttctcaaatctctcgcaagcgtcttttgtttgctaatttttcagacgattatttgagcaattggctcatcaataatgtaacttttgcagtcgtatagaaattcgtatttccacttataatgaacattgtcctgagcaaaaaacaaaaaaacaaaa

SEQ ID NO: 878 - DNA, 1211 bp, Brassica napus
aatcaaaacaacacagatacagagagatagtgagacttatcgagagagctgcttccaagaatgtcgatgctcatggcggtcaaacccacttccctatgcaacaccttaaaccttacggcttcaccgagattcccacgcaccaatcctcgcgcggcgagattggttaatccgacggcgaggatccaaacacgtatccatcgtctgatccaagaccaaggcattatcctcatgcctggatgctacgacgcgttatcagccgccatcgtgcagcaaaccggattctccgctggtttcatctccggttacgctctctccgcttctcttttgggtaaaccggacttcggtttgctaactccaccggagatggctgcgacggcaaggtcggtctgtgcttcggctccaaacatacccatcattgcagatgccgacactggtggaggaaatgcactaaatgtccaaagaactgtaaaggacttgatcgcagctggtgctgctggttgcttccttgaggaccaagcatggccaaagaaatgcggtcatatgcgtgggaaacaagttatctcagcagaagaacacgctgccaagatagcatcagcacgagacgctataggagactctgacttcttccttgtcgcgagaaccgacgcgcgtgccacttctgctaaatcagggcttgaggacgccattgcgcgtgtcaatctctatatggaggctggagcggatgcttcctttgtggaggcaccgagagacgatgaagagctcaaggagataggcaaacgcacaaagggtttcagagtctgcaacatgatcgaaggaggagtcacgccgctgcacacgcccgaggagcttaaggaaatggggtttcacttgattgttcaccccttgaccgcgctctacgcatctgctcgagcgctggtggatgttctcaagactcttaaagaaaacggaaccacgagaggtcacttggagaagatggctacttttgaggagttcaatagtttggtggatttggagtcgtggtttgagctcgaggctcgttactcgaaccttaggaacgctcttgggacgactacaaagtcatgaagagggtgctgctactacagagccacaagtgttgttttttctttgagatgtctctctgtttgcaattatgaatgtatgttttaagcacaaggtctcatcaataagagacaatatggacccttgcagtc

SEQ ID NO: 879 - DNA, 1309 bp, Brassica rapa
  misc_feature (744)..(744): n is a, c, g, or t
acctaaccaaaacacttaaacttctggtccattttatcggcctcggttatctcgtctgctccactatccaatcaaaacaacacagatacagagagatagtgagacttatcgagagagctgcttccaagaatgtcgatgctcatggcggtcaaacccacttccctatgcaacaccttaaaccttacggcttcaccgagatccccacgcaccaatcctcgcgcggcgagattggttaatccgacggcgaggatccaaacacgtatccatcgtctgatccaagaccaaggcattatcctcatgcctggatgctacgacgcgttgtcagccgccatcgtgcagcaaaccggattctccgccggtttcatctccggttacgctctctccgcttctcttttgggtaaaccggacttcggtttgctaactccaccggagatggctgcgacggcaaggtcggtctgtgcttcggctccatacatacccatcattgcagatgctgacactggtggaggaaatgcactaaatgtccaaagaactgtaaaggacttgatcgcagctggtgctgctggttgcttccttgaggaccaagcatggccaaagaaatgcggtcatatgcgtgggaagcaagttatctcagccgaagaacacgctgccaagatagcatcagcacgagacgctataggagactctgacttcttccttgtcgcgagaacagacgcacgtgccacttctgctaaatcagggctngaggacgccattgcgcgtgtcaatctctacatggaggcgggagcggatgcttcctttgtggaggcaccgagagacgacgacgagctcaaggagataggcaaacgcacaaagggtttcagagtctgcaacatgatcgaaggaggagtcacgccgctgcacacgcccgaggagcttaaggaaatggggtttcacttgattgttcatcccttgaccgcgctctacgcttcggctagagcgctggtggatgttctcaagactcttaaagaaaacggaaccacgagaggtcacttggagaagatggctacttttgaggagttcaatagtttggtggatttggagtcgtggtttgagctcgaggctcgttactcgaaccttaggaacgctcttgggacgactacaaagtcatgaagagggtgctgctactacagagccacaagtgttgttttttctttgatatgtctcttctgtttgctaatttcagatgattgtttaagcaatagtctcatcaataagacaataatgtgacttctgcagtcgtacagaagttcgtattttcctagaaaaa

SEQ ID NO: 880 - DNA, 1235 bp, Brassica napus
atccaatcaaaataacacggatacagagagataacgagagttatcgagagagcagcttccaagaatgtcgttgctcatggcggtcaaacccacttccctatgcaacaccttaaaccttacggcttcgccgagatccccacgcaccaatcctcgcgcggcgagattggttaatccgacggcgaggatccaaacacgtatccatcgtctgatccaggaacaaggcagtatcctcatgcctggatgctacgacgcgttatcagccgccatcgtgcagcaaaccggattctcggccggtttcatctccggttacgctctctccgcttctcttttgggtaaaccggacttcggtttgctaactccacccgagatggctgcgacggcacggtcggtctgtgcttcggctcctaacatacccatcattgcagatgctgacactggtggaggaaatgcactaaacgttcaaagaactgtgaaagacttgatcgcagctggtgctgctggctgcttccttgaggaccaagcatggccaaagaaatgcggtcatatgcgtggcaaacaagttatctcagcagaagaacatgctgccaagatagcatcagcgcgagacgctatcggagactctgacttcttcctcgtcgcgagaacagacgcacgtgccacgtctgctaagtcaggactcgaagacgccattgcgcgtgtcaatctctacatggaggctggagcggatgcttcctttgtggaggcacctagagacgacgacgagctcaaggagataggcaaacgcacgaagggtttcagagtctgcaacatgatcgaaggcggagtcacgccgctgcacacgcccgaggagcttaaggaaatggggtttcacttgattgttcaccccttgaccgcgctctacgcatcggctcgagcgcttgtggatgttctcaagactcttaaagaaaacggaaccacgaggggtcacttggaaaagatggctacgtttgaggagttcaatagtttggtggatttggagtcgtggtttgagctcgaggctcgttactcgaaccttaggaacgctcttgggacgactacaaagtcatgaagagggttgctgctactacagaggcacaagtggtttttttctttttctttttctttgaaatgtgtcttaagctcctctgtttgctaattgtcagaggattgtttgagcagttgtctcatcaataagacaataatatgacttctgcagt

SEQ ID NO: 881 - DNA, 1318 bp, Raphanus sativus
  misc_feature (170)..(170): n is a, c, g, or t
ggatcggcctcggtttatcacgtctctccacaatcccccaatcaaacaaacaaacacgatacagagagacggtgaagtagaaaagacttatcgagatatagcttccaagaatgtcgatgatgctcacggcggtcaaaaccccttccctctgcaacaacaccctaaacctnacagcttcaccgagattcccacaacgtgcgaatcctcctcgcgcagcgagatcggtgaatccgacggcgaggatccaaacacgcatccatcgtctgatccaagaccaaggcatcatcctcatgcctggatgctacgacgctttatccgctgccatcgtgcagcaaaccggattctccgccggtttcatctccggttacgctctctccgcttctcttttgggtaaaccggacttcggtttgctaacaccaccggagatggctgcgacggcaaggtccgtctgtgcttcggctccaaacatccccattattgcagatgctgatactggtggaggtaatgcactaaacgttcaaagaactgtaaaggacttgatcgcagctggtgctgctggttgcttccttgaggatcaagcatggccaaagaaatgcggtcatatgcgtggcaaacaggttatatcagcagaagaacatgctgccaagatagcatcagcacgagacgctattggagattctgacttcttccttgtcgcgagaacagacgcacgtgccacttctgctaaatcagggcttgaagacgccatcgctcgtgtcaatctctacatggaggctggcgctgatgcttcctttgtggaggcgccgagagacgatgatgagctcaaggaaataggcaaacgcacaaagggtttcagagtctgcaacatgatcgaaggcggagtcacgccgttgcacacgcctgaggagcttaaagaaatggggtttcacttgattgttcatcccttgaccgcactctacgcatcggctcgagcactagtggatgctctcaagactcttaaagaaaacggaaccacgagaggtcacttggaaaagatggcgacttttgaggagttcaatagtttggtggatttagagtcgtggtttgagctcgaagctcgttattcgaaccttaggaacgctcttgggacgacaacaaaatcttgaagaggctgctgctgcgtactagagagccataaggttttatcttctttcaaatgtctctgaagctcttctgttttgctaattttacagacgatttatttgagcaattgtctcatcaataagacaataatgtaacttttgcagtcgtataaaagttcctatttcctatttatcca

SEQ ID NO: 882 - DNA, 1236 bp, Eutrema halophilum
ttatccgattgatgatactgattttcttgtcttcactctctccaactgcccgagaaaaccttcaaagctccgaaaatgtcgatgttaatggcggtcaaatccacttcactctgcaactcaaacacttcagtttcagccagaatcagacaaaaccctcgcgccgtcagatcggtttatccgacggtgagaatgcagtcacgtgttcaccgtctgatcgaagagcaaggcgccgtgcttattcccggagtctacgacgcattatcggcggctatcgtgcagcagaccggtttctccgccgcgcttatctccggttacgccctctccgcctctattttgggaaaacccgatttcggtttgataacaccgccggagatggcagcagcggcgagatcggtttgtgctgcggctccgaacatacccattattgcggatgcagatactggtggaggaaatgccctcaatgttcaaagaaccgtaaaggacttaatcgcagcaggtgctgccggttgcttccttgaggaccaggcatggccaaagaggtgtggtcatatgcgtggcaaagaggtcatacctgcggaggagcacgctgctaaaatagcatcagcgagagacgctattggagattctgactttttcctcatcgctagaactgatgcgcgcgctctgtctgcaaaaacaggactttcagacgccattgatcgtgctaatctctacatggaggcaggagctgatgcttcctttgttgaggcacctagggacgatgatgagctcaaggaaattggaaagcgcacgaaagggtacagattatgtaacatgcttgaaggtgggcgcacgccattgcatacgccagatgagcttaaggaaatgggatttcatttgatcgctcacccgcttacctcgctctatgcatcaactcgagctctcgtcgatgttctcaagatcctcaaggaaaagggaaccaccaaagatcatttggaaaagatgattactttcgaggagtttaaccgtttagtgaacttggattcgtggtatgagcttgaaactaagtactcaaatctcagaaacgctcttgggacaacaaagtcatgagattctgaaaaaaactgtgtccacaaaggaatctagggcaatgtgtcatcaataatgttatcttctttttcatttgctatgaagctgtttgtatcatttcaataatcttttttgctttggttagcatattcagtaagactattgcaa

SEQ ID NO: 883 - DNA, 1197 bp, Arabidopsis lyrata
cttcactctccaacagtttggtaataatatcttgtgagcttcgagaatgtcgatgttaatggcggccaaatccacttcactctatagctcaaacccaacaatttcagctagaatcgggcaaaaccctcgcgctgtcagatcggtttatccgacggtgagaatgcagtcacgtgttcaccgtctgatcgaagagcagggcgctgtgcttattcccggagtctacgacgcattatcggcggctattgtgcagcagaccggattctccgccgcattaatatccggttacgctctctccgccgtaactttgggaaaacccgatttcggtttgataacaccgccggagatggcagcaacggcgagatcagtgtgtgctgctgctccaacgattccaatcattgccgatgcagatactggtggaggaaatgctctcaatgttcaaagaactgtcaaggacttaatcgcagcaggtgcggctggttgcttccttgaggaccaggcttggccaaagaggtgtggacatatgcgtggcaaagaggtcatacctgcggaggagcacgctgctaaaatagcatcggcaagagacgctattggagatgctgacttttttctaatcgctaggactgatgctcgtgcactatccgcaaaaacaggactttcagacgccattgaccgtgctaatctttacatggaggcaggagctgatgcttcctttgttgaggcaccgagggacgatgatgagcttaaggaaatcggaaggcgcacaaaaggctacagattgtgtaacatgcttgaaggtggacgtacgccattgcatactcctgacgagcttaaagaaatgggctttcatttgatcgcacacccacttacctcgctttatgcatcgacccgagctcttgtggatgtactcaagattctcaaggacaagggaaccaccaaagatcacttagaaaagatgattactttcgaggagtttaacagtttgttggacttggattcatggtatgagcttgaaactaagtactctaacctcagaaacgcgcttgggacaacaaagtgatgagattctgacaactctggccacaatggaagctcttggacaatgtttcatcaataatgttttcttttttttcacttgtttgtgtcattttgacatgtaataactcaaaattatctaatttatttggaaagcttgttctt

SEQ ID NO: 884 - DNA, 1124 bp, Eutrema parvulum
ttatccgattgatactgattttcttgtattcactcctgagccaaaaaagtacctttcaaagcttcgagaatgtcgatgttaatggcggccaaatccacttcactctataactcaaacccttcaatctcagctagaatccagcaaaacactcgcgccgtcagatgggcttatccgacggtgagaatgcagtcacgtgttcaccgtttgatcgaagagcaaggcgcagtgctcattcccggagtctacgacgcattgtcggcggctatcgtgcagcagaccggattctccgccgctctaatctccggttacgccctctccgcctctattttgggaaaacccgatttcggtttgataacaccgccggagatggcggcagcagcgagatcggtttgtgctgcggctccgaacatacccatcattgcagatgcagatactggtggaggaaacgctctcaatgttcaaagaactgtgaaggacttaatcgccgctggtgctgccggttgcttccttgaggatcaggcatggccaaagaggtgtggacatatgcgtggaaaagaggtcatacctgcggaggagcacgctgctaaaatagcatcagcgagagatgctattggaaattctgattttttcctcattgctaggactgacgcgcgtgctctgtctgcaaaaacagggctttcagacgccattgaccgtgctaatctctacgtggaggcaggagctgatgcttcctttgttgaggcaccaagggacgatgatgagcttaaagaaatcggaaagcgcacaaaaggttacagattgtgtaacatgcttgaaggtgggcatacgccattgcatacgcctgatgagcttaaagaaatgggttttcatctgatcgctcacccgcttacctcgctctatgcatcaactcgagctcttgttgatgtcctcaagatcctcaaggaaaagggaaccaccaaagatcatttggaaaagatgataactttcgaggagttcaaccgtcttgtgaacctggattcatggtatgagctcgaaactaagtactcgaatctcagaaacgctctggggacaacaaaaccatgaggtattgaacactctagccacaatggaagttaagctcttgg

SEQ ID NO: 885 - DNA, 1249 bp, Unknown
  Sequence found in Organisms: Arabidopsis thaliana, Arabidopsis lyrata
acgattgatatatactgatctcttgtcttcttcactctccaacggttctgtactatcttcagagcttcgagaatgtcgatgttaatggcggccaaatccacttcactctttagctcaaaccctacaatttcagctaaaatagggcaaaaccctcgcggcgtcagatcggtttatccgacggtgagaatgcagtcacgtgttcaccgtctgattgaagagcaaggtgctgtgcttattcccggagtctacgacgcattatctgcggctattgtgcagcagaccggattctccgccgcattaatctccggttacgccctctccgccgtaactttgggaaaaccagatttcggtttgataacacctccggagatggcagcaacggcgagatcagtgtgtgctgcggctccaaagattccaatcattgcagatgcagatactggtggaggaaatgctctcaatgttcaaagaaccgtcaaggacttaatcgcagcaggtgctgctggttgcttccttgaggaccaggcatggccaaagaggtgtggacatatgcgtggcaaagaggtcatacctgcggaggaacacgctgctaaaatagcatcagcaagagacgctattggagatgctgacttttttctaatcgctaggactgatgctcgtgcactttccgcaaaaacaggactttcagacgccattgaccgtgctaatctttatatggaggcaggagctgatgcttcctttgttgaggcaccgagggacgatgacgagcttaaggaaatcggaaggcgcacaaaaggttacagactgtgtaacatgcttgaaggtggacgcacgccattgcatacgcctgatgagcttaaagaaatgggttttcacttgatcgcacacccacttacctcgctctatgcgtcgactcgagctcttgtcgatgttcttaagattctcaaggagaaaggaaccaccaaagaccacttagaaaagatgataactttcgaagagtttaaccgtttggtgaacttggattcatggtatgagctcgaaaccaagtactctaacctcagaaacgctctaggggaaacaaaataatgagattctgattactctgtccacaatcgaagctcttgcaatgtatcatcaataatgttatcttcttttttcacttgtttgtatcaatattcaataattgtgtgttttgacatgtaaaaactcaaaaaaagttctaatttatttggaaagcttgttcttgctgctt

SEQ ID NO: 886 - DNA, 2051 bp, Theobroma cacao
aggttaaaggaaaatatttcttatgttttactaacttatcctctactctcggaatttaaatatgaaactgtcaattttgttaatgtaaaataaaaataaatattaagttttaataaaataagaaaaaacagaaagctgaggtgggctccggtattagtcatccacttatgtccatatccaaaacgacaacataaaagcagaaaatcgcggtcgttcacgtgctttctatggagcgtaatgccatataaaccgcacattcaaaacccgacaaaaaccctgtataactttccaactcaccaaatttttcaattgctaacttggaaaatgtcgacgataacgatgatggcagccaaagctccttcgctcccacagttgaacttgaaagcttccacattccggtctaggaagaccaagtcgtctcatccaacggtcagaatgcagacgcgcattcaccgtctgatcgaggatcaaggcatcgtgctaatgcctggctgctacgacgctctatcggctgccatagtacagcaatctggtttcactgctggtttcatctctggttatgctctctctgcgtctctccttggcaaacctgacttgggcttgctaacgccacctgagatggcggcgacggcaaggacggtttgtgcggcggctccagtgataccgatgattgcggatgctgatactggtggtggcaatgctctcaatgttcagaggaccatcaaggatttgattgcagcaggtgctgctggctgctttcttgaggatcaagcatggccaaagaagtgtgggcatatgcatggcaaacaggttatacctgctgaggagcatgctgccaaaattgcatctgcaagggatgccattggagattctgactttttccttgtggccagaactgatgcacgtgctacatcagcaaaaactggtctctccgatgccatctcaagagctaatctttacatggaggcaggagcggatgcttgctttgtggaggcaccaaggaatgatgacgagcttaaggagattggacgccaaacaaaagggtacagagtttgtaatatgattgaaggtggggtcacaccattgcacacacctgaggagctgcaagcaatgggctttcatttgatcgtacattcactcaccaccgtctatgcatcagctcgtgcattggttgatgttcttaagatcctgaaggaaaatggaaccactagagatcaccttcaaaagatggctacctttgaagaatttaatcaactggtcaagttggaatcttggtttgaactggaagcacgttattcaaagctgaagagtgcagtaggtgtaaaatcatgagagggtttaggggaaggagaaattaacttgaaatttgtttctacctagtagggggatcatgtgagtttcaaaactacaattcatcattctccgaaggaactgctatgaaaatccacgtgttcatttagaatcagaagtatccagcctgtgattaaacagtggtgagaaaaaattatgcatctaatcatgatatggatgattgttgctgtattactaacacaactttatgctagctctttagagctggcaatcttgctcataaccttaagaatgtcttcttgaggtaccttaccatttgtttcataactatttgctctctgtcaaaatagcttacaggctatggcctaatacagacacgattttagtaagcatgagaggatagtttttaaacaaactgctaaaatgcaaggtggatagaataaaaaaaaaaaagttcagaccttttgcgtgaaaaaaaaaaaatccatatttagtgtccctcaaaatcttgtattggtcctttgccttgcgaatggacatcttcaaactttgctttcctaaacctttgggttaacaatgtttggctggttttctttagcagtttgttctcttgtctagatattataaaagggtacaagtcagcagttcagacctgtagatgtttgttctcttagtctcccctccctccttgcaataaaatgtttaccttcttttatcattaattaatttaaattttgagg

SEQ ID NO: 887 - DNA, 1257 bp, Gossypium hirsutum
cacttccagcttcgaaaatgtcgacgatgaccaccatcatgctaatgccacccaaagccacttcgcttcaacactccaacttcaaaccttccacattacgctcaaggtcgtcgcctaccaagtcttcctatccgacggtcagaatgcagacgcggtttcaccgtctgattgaggaccaaggcatcgttctaatgcctggctgctatgacgctctttcggctgccattgttcagcagtctggtttcacagctggcttcatctctggatatgctctctctgcttctctccttgggaaacctgacttcggcttgctcacgccaccggagatggcggcgacggctagaacggtttgtgcggcggctccgatgatacccattattgcagatgctgatactggtggtggcaatgctcttaatgttcaaaggactgtcagggatttgattgcagctggtgctgctggttgctttcttgaggatcaagcatggccaaagaagtgtgggcatatgcgtggcaagcaggttatacctgcagaggagcatgctgcaaaaattgcatccgcaagagatgccattggagattcagactttttcttagtggctagaactgatgcacgtgctacatcagcaaaaaccggcctttctgatgccatcgctagagctaatctttacatggaggcaggagcagatgcttgctttgtggaggcaccgaggaacgatgatgagcttaaggagatcggacgccatacaaaaggttacagagtttgtaatatgattgaaggtggggtcacacccttgcacacgcctgaggagcttagagcaatggggtttcatttgattgtgcatccactcaccgccctctatgcttcagctcgtgcattggtggacgtcctcaagaacctgaaagaaaacggaactaccagagatcaccttcacaagatggctacatttgaagaatttaaccaactagtcaagttggactcgtggtttgaactcgaagcactctattcaaatcagaagagtcccatgagagtaaatcatgataatgaagggagaaatatgtaggatttttttttcctttttcccaataaaagggaggaattagtctttaccaataaaagggacgatgcaagttttgggaactagatttcatcattctctgaagaacttgtatgaaaatccatgttctttgtttagtatccgagctaccggcatgtgttcaacagtgctgaaaataattatgcatcttgatcatgatttg

SEQ ID NO: 888 - DNA, 1215 bp, Brassica napus
caaaaccttttcaaaaccttggacaatgtcgatgttaatggctgccaaatccacttcgctctgctactcaaacccttctatctcgtccagaaccaagcaaaacccacgcgccgtcagatatgcttatccgacggtgagaatgcagtcgcgtgtccaccgtctgatcgaagagcaaggcgcggtgctcattcccggtgtctacgacgcattgtcggcagctatagtgcagcagaccggattctccgccgcgctgatctccggttacgctctctccgcctctattttgggaaaaccggatttcggtttgataacaccgccggagatggcagcagcagctagatcggtttgttccgctgctccaggcatacccatccttgcagatgcagatactggtggaggcaatgcactcaatgttcaaagaaccgttaaggacttaatcgcagctggtgctgctggttgcttccttgaggatcaggcatggccaaagaggtgtggacatatgcgtggaaaagaggtcatacctgcagaggagcacgccgctaaaatagcatcagccagagacgccattggagattccgactttttcctcatcgctaggactgatgcgcgtgctctgtctgcaaagacagggctttcagaggccattgaccgtgctaatctctacatggaggcaggggctgatgcttcctttgttgaggcaccaagagacgacgatgagcttaaggagatcggaaagcgaacaaaaggctacagagtctgtaacatgcttgaaggtgggcgcacgccattgcatacacctgatgagcttaaagaaatgggctttcatttgatcgctcacccgcttacctcgctctacgcatcaactcgagctcttgtggacgtcctcaagatcctcaaggaaaaaggaaccaccaaagaccatttggcaaagatgattactttcgaggagtttaatcgtttggttaacttgggtgaatggtatgagctcgaaactaagtactctaacctcagaaacgctcttggcacaaacaactaaaccatgagattcgtgtgtgtttatcaataatgttaatcttctttttttcacttgctatgtaataacattatgcttttatgttgttagcatatttttaataagagactaatgccaacttcttctaagattacagagagtcttgactttttttaaaactaaaagttatagatttagttaag

SEQ ID NO: 889 - DNA, 1222 bp, Brassica napus
aacaaaaccttttcaaaaccttggacaatgtcgatgttaatggctgccaaatccacttcactctgctactcaaacccttctatctcgtccagaacaaagcaaaacccacgcgtcgtcagatatgcttatccgacggtgagaatgcagtcgcgtgttcaccgtctgatcgaagagcaaggcgcggtgctcgttcccggagtctacgacgcattgtcggcggctatcgttcagcagaccggattctccgccgcgctgatctctggttacgctctctccgcctctattttgggtaaaccggatttcggtttgataacaccgccggagatggcagcagcagctagatcggtttgttccgctgctccaggcatacccatccttgcagatgcagatactggtggaggcaatgcactcaatgttcaaagaaccgtgaaggacttaatcgcagctggtgctgctggttgcttccttgaggaccaggcatggccaaagaggtgtgggcatatgcgtggaaaagaggtcatacctgcagaggagcacgctgctaaaatagcatcagccagagacgccattggagattctgactttttcctcatcgctaggactgatgcgcgtgctctgtctgcaaagacagggctttcagacgccattgaccgtgctaatctctacatggaggcaggagctgatgcttcctttgttgaggcaccaagagacgatgatgagcttaaggaaatcggaaaacgcacaaaaggttacagactctgcaacatgctcgaaggtgggcgcacgccattgcatacacctgatgagcttaaagaaatgggctttcatttgatcgctcacccgcttacctcgctctatgcatcaactcgagctcttgtggacgtcctcaagatcctcaaggaaaaaggaaccaccaaagaccatttggaaaagatgattactttcgaggagtttaatcgtttggtgaacttgggtgaatggtatgagctcgaaactaagtactctaacctcagaaacgctcttggcacgcacaactaaaccatgagatgtgtgtgtgtgtgtgtgtttatcaataatgttatcttcttcttttttcacttgctatgtaataacattatgctttatgctgttagcatattttaataagacttaatgccaacttcttccaagaattacagaagagtctcgtactttaaattaaaatttatgtattaagtacgaa

SEQ ID NO: 890 - DNA, 1041 bp, Brassica napus
tatcctcatgcctggatgctacgacgcgttatcagccgccatcgtgcagcaaaccggattctccgccggtttcatctccggttacgctctctccgcttctcttttgggtaaaccggacttcggtttgctaactccgcccgagatggctgcgacggcacggtcggtctgtgcttcggctcctaacatacccatcattgcagatgccgacactggtggaggaaatgcactaaacgttcaaagaactgtgaaagacttgatcgcagctggtgctgctggttgcttccttgaggaccaagcatggccaaagaaatgcggtcatatgcgtgggaaacaagttatctcagcagaagaacatgctgccaagatagcatcagcgcgagacgctatcggagactctgacttcttcctcgtcgcgagaacagacgcacgtgccacttctgctaagtcgggactcgaagacgccattgcgcgtgtcaatctctacatggaggctggagcggatgcttcctttgtggaggcacctagagacgacgacgagctcaaggagataggcaaacgcacgaagggtttcagagtctgcaacatgatcgaaggcggagtcacgccgctgcacacgcccgaggagcttaaggaaatggggtttcacttgattgttcaccccttgacggcgctctacgcatcggctcgagcgctggtggatgttctcaagactcttaaagaaaacggaaccacgaggggtcacttggaaaagatggctacgtttgaggagttcaatagtttggtggatttggagtcgtggtttgagctcgaggctcgttactcgaaccttaggaacgctcttgggacgactacaaagtcatgaagagggttgctgctactacagaggcacaagtggttttttctttttctttttctttgaaatgtgtcttgagctcctctgtttgctaattgtcagaggattgtttgagcagttgtctcatcaataagacaataatatgacttctgcagtcgtatagaagttcgtattttcctagatatcag

SEQ ID NO: 891 - DNA, 1245 bp, Brassica rapa
  misc_feature (113)..(113): n is a, c, g, or t
  misc_feature (694)..(694): n is a, c, g, or t
ttatcttgatgatactgattttcttgtcttcttcactcttgactgagagaaacaaaacctttttcaaaacctttggacaatgtcgatgttaatggccgctaaatccacttcgntctgctactcaaacccttcaatctcgtccagaaccaagcaaaacccacgcgccgtcagatatgcttatccgacggtgagaatgcagtcgcgtgtccaccgtctgatcgaagagcaaggcgcggtgctcatccccggtgtctacgacgcattgtccgctgctatagtgcagcagaccggattctccgccgcgctgatctccggttacgctctctccgcctctattttgggaaaaccggatttcggtttgataacaccgccggagatggcagcagcagctagatcggtttgttccgctgctccaggcatacccatccttgcagatgcagatactggtggaggcaatgcactcaatgttcaaagaaccgttaaggacttaatcgcagctggtgctgctggttgcttccttgaggatcaggcatggccaaagaggtgtggacatatgcgtggaaaagaggtcatacctgcagaggagcacgccgctaaaatagcatcagccagagacgccattggagattccgactttttcctcatcgctaggactgatgcgcgtgctctgtctgcaaagacagggctttcagangccattgaccgtgctaatctctacatggaggcaggagctgatgcttcccttcgttgaggcaccaagagacgacgatgagcttaaggagatcggaaagcgaacaaaaggttacagactctgtaacatgcttgaaggtgggcgcacgccattgcatacacctgatgagcttaaagaaatgggctttcatttgatcgctcacccgcttacctcactctacgcatcaactcgagctcttgtggacgtcctcaagatcctcaaggaaaaaggaaccaccaaagaccatttggaaaagatgattactttcgaggagtttaatcgtttggttaacttgggtgaatggtatgagctcgaaactaagtactctaacctcagaaacgctcttggcacaaacaactaaaccatgagatgtgtgtgtgttttatcaataacgttatcttctttttttcacttgctatgtaataacattatgcttttatgttgttagcatatttttaataagagaagtaatgccgacttcttctaagaattacagaagagtccttgactttttt

SEQ ID NO: 892 - DNA, 1215 bp, Raphanus sativus
  misc_feature (756)..(756): n is a, c, g, or t
  misc_feature (919)..(919): n is a, c, g, or t
  misc_feature (951)..(951): n is a, c, g, or t
  misc_feature (955)..(955): n is a, c, g, or t
  misc_feature (960)..(960): n is a, c, g, or t
  misc_feature (1008)..(1008): n is a, c, g, or t
  misc_feature (1039)..(1039): n is a, c, g, or t
  misc_feature (1042)..(1042): n is a, c, g, or t
  misc_feature (1157)..(1157): n is a, c, g, or t
  misc_feature (1207)..(1207): n is a, c, g, or t
  misc_feature (1210)..(1210): n is a, c, g, or t
ggattcagtcttcactctagtctaagaaacaaaaccttttcaaacctacgaaaaatgtcgatgctaatggccgccaaatccacttcgctctgctactcaaaccattcgatctcatccagaaccaagcaaaacccacgcgccgtcgtcatacgggcttatccgacggtgagaatgcagtcacgtgtccaccgactgatcgaagagcaaggcgcagtgctcgttcccggggtctacgacgcattgtcggcggctatcgtgcagcagaccggattctccgccgcgttgatctccggctacgctctctccgcctctattttgggaaaacctgatttcggtttgataacaccgccggagatggcagcagcagctagatcggtttgtgctgctgctccaggcatacccatccttgcagatgcagatactggtggaggcaatgcgctcaatgttcaaagaaccgtaaaggacttaatcgcagctggtgctgctggttgcttccttgaggatcaggcatggccaaagaggtgtgggcatatgcgtgggaaagaggtcatacccgcagaggagcacgctgctaaaatagcatcagccagagacgccattggagattccgactttttcctcatagctaggactgatgcgcgtgctctgtctgcaaaaacagggctttcagacgccattgaccgtgctaatctctacatggaggcaggtgctgatgcttcctttgtcgaagcaccgagagacgacgatgagctcaangaaataggaaaacgcacaaaaggttacagactctgtaacatgctcgaaggtgggcgcaccccgttgcatacacctgatgagcttaaagagatgggtttccatttgatcgctcacccgcttacctcactctacgcatcaactcgagctcttgtggacgtcctcnagatcctcaaggacaaaggaaccaccaaagancatntgganaagatgattactttcgaggagtttaatcgtttggtgaacttgggtgantggtatgagctcgaaactaagtactctaatntcngaaacgctcttggcactcacaactaaaccatgagatactattgaaagctgtgtgttgttatcaaataatgttttctttctttttttcactgtttgtattgtatcagtaacattangttttctttttaatgttgttaacgtattcaataagactactgccaacttnttntaaga

SEQ ID NO: 893 - DNA, 1113 bp, Arabidopsis lyrata
tttttttgtttcctgaccatatttacacagagccaatcagagccttgtttcatcgtcttgtcgaggaggcgataatattagatctgctcaccatttctccgccatcgccgaagatgggagacaacaaccctaaccgaccagaagccgaacgtcttctcggaatcgcagagaagcttctggagtcacgagatctcaacggttcaaaagagtttgcaatcttagctcaagaaacagagccactcctcgaaggcaccgatcaaatcctcgccgtcgtcgatgtcctcctctcatcttcctcagagaatcgcatcaaaaacaaaccaaactggtacaaaatccttcagatcgaagatccaaatgaatcatcaacagacaacgatctaatcaagaaacaataccgtcgtctggctcttcttctccacccagacaaaaaccgcttccctttcgccgatcaagctttcagattcgtgcttgatgcatgggaagttctatcaacaccttcaaagaaatctcaattcgatcgagatttgaatctcatcttcacaaaagtagatctcaatactcaaaaatcgaagaagaaaacaacaaccaatgagaagatggctacgttttggacggcgtgtccgtattgttacagtcttcatgagtatcctagggtttatcaagagtattgtatcagatgtcaaaactgtcaaagagcgtttcacgcggccattattcctcaattgcctccgttggttcctggaaaagatgagtattattgttgttgggggttttttccgatgggatttgttggtggtaaaggaggagaagccgccattgctaacggagttgatgctgccaaattccctaattggatgcctccgcttttctcatccggcggcgttgcagctcctccaagtgttaatggtggcggatacggggttagctttgatggatggtcaggtggtgcagcgaagagagacaacgttggagttaatttagatggaacgccgaagaagagaggaagaggaaggccgaagaagaatccggtttagtgatctcaaaaatttttaaggcaagtttttttttttcaaggcaaggaagattagtgtttgttgtcttagtgtaatc

SEQ ID NO: 894 - DNA, 1843 bp, Arabidopsis lyrata
aaaaaaaaaaagtcaaatccacaagagaaaaatactctctctgatccgatttctccaaagctctcagcttttgaatcgcctctttattttccgggaaaatcaaaacaaaaatcccatctttgagaaaaaaaaaaactcatggttatgaagagagtttcagattttcccaggaaagtgaagagattttagagttattgattgtttctcgagccggttgcttgaagatatagctctggttttttatgcaagatttactctcttagaagaatgagagcagataatgatcacgcgcttggtaactcggtagagatttgcaaagatgaatctaagcctcatcaatgtcttgaagagaactgggaagatgcagagctaaaggtcccggaaaatgggaagaacaacaacaatgtgtgtgagttgttctatgatacaagaagcggcgacgaatgggatgctaatgaggccggaaagaaagtccgagatattagtcatgattgtgatgctaatgtggattctcctgataaaaaggatccggttttctatatggacaagaatgttacggcctgcgatttacctgagattgttgtttgttacaaggagaatacttaccatgtcgtcaaagatatatgtgtcgatgaaggcgtgcctgttcaggagaagttcttattcggcgagaaggattctgtaaagtccagctcaaaaggatttgacgaaagcagacaaaacaaatgtgaatccttcagaaagtaagtctgcggaagacagcaacactaaggttgatgattctgaattctgtaacaattgtaagacagacagagatgttgaagaatcttcaagagaagattttgctgacgctgaaggttctagcgcttacaatcaagagcatttgattgtgacagaggaagccaaggcttcaccctcgcatgggctaaatccatctgaaattgaacctgatgagaattcaaatgacgaagtggctatatcatcagagactgactcaaaggaatctttaaccttgggagatattctatcaagggaagatgaacaaaaatctctcaaccacggtaacattagcagcgatagtcatgaagaacaatctccttctcagcttcaggataaagaaaaaagaagcttagaaaccgcagctatcgaaacagagcttgagaaaacagaggagccaaaaccagtagaagagaagcttccctctgcttctacaacgacccttcaagaaccaaataaaacttgcaacgaccctgaaaagcctgaaactgagaatcatcatcaacaaaattccttagtggaaaactcttacgaagacgataaactttcctcaagcagatttggagagacgagtttctctgcagcagagtcagtttcaatttcaggtcatataacatactcaggaccaattgcatactctggaagcctttctgttcgatccgatgcaagcacaacgagtggaagatcctttgctttccccatattgcaatcagaatggaacagcagtcctgtaagaatggcgaaagctgacaagagaagacaaaaaggaggatggagacacactcttctgtgctgtagattctcttgatgtctctcctccacaatttagtcctaaagcttttcactttgaagcacagaggaagaagaagaagaagaaagatttatgaaattttacagtattttcttacaatgggagtgcttttttttctcttttgggtgagtggtttatagtttattattatgccttggtgtgtaattggcattttggtagtttaacagtttagggcttttgagtttggaaccaatgagtttattataaattttttaatgaagggctctttggatt

SEQ ID NO: 895 - DNA, 726 bp, Arabidopsis thaliana
gcgttgccgcttagcttcgtctgaaaaaagggggatcagttccgtcgccgcttcttcgatttttgacgccgccgcttcttcttcttcctcgcagcaggtaagtcacacaggtaactgaaagatggggcgtgttagaaccaagactgtgaagaaatcttctcgtcaagtcatcgagaagtactactctcgcatgactcttgacttccacactaacaagaaaatccttgaagaggttgccatcatcccttcaaagagactccgcaacaagattgctggattctccacccacttgatgaaacgtatccagaagggaccagtccgtggaatctcactcaagcttcaggaagaggagcgtgaacgccgcatggactttgttcccgatgagtctgccatcaagactgatgagatcaaggtggacaaagagactcttgagatgcttgcttctctaggaatgtctgacactcccggcatctctgcagtcgagccacaacaagctatggcaccaatcgctgctttcggtggtggcagggcacccagaagatactgagatggctttgttatcatcagccaatcaaggcaaacgactggctctcttttttcacagttagggataagaaagacatgtgtgttcttggaaagtttattgtttcttttgattcaagtttttatgtcttaaactcagagtgagactctttcgtattaatgggttttgagttatgtggaacc

SEQ ID NO: 896 - DNA, 677 bp, Arabidopsis thaliana
ggaaactccaaaaccaaaatcgtcgctctctgcctctctcgcatctccaaatcgaaatcgctctctgcctctcttcgtctccgtctccatctttgtctccggtaagtaactgaaagatggggcgtgttagaaccaagaccgtgaagaaatcttctcgtcaagtcattgagaagtactactctcgcatgactcttgactttcacactaacaagaagatccttgaagaggttgccatcatcccatcaaagagactccgcaacaagattgctggattctccacccacttgatgaaacgtatccagaagggaccagtccgtggaatctcactcaagcttcaagaagaagagcgtgaacgccgtatggactttgttcccgatgagtctgctatcaagactgatgagatcaaggtcgacaaagagactcttgagatgcttgcttctctaggaatgtctgacactctcggcatctctgcagtcgacccacaacaagctatggcaccaatccctgctttcggcggcggcagggcacccagaagatactaagatggacgattggctctcttttttcacagttagggacaagaaagacttgtgtggttgtttattgtttcttttgattatgtcttaaactcaatgtgagactctttcgtattaatggtttttgagttatgtggaacc

SEQ ID NO: 897 - DNA, 708 bp, Arabidopsis lyrata
atcagctccgtcttagcttcttcgagttttgtcgccgccgcttcttcttcctcgcagcaggtaagtcacaaggtaactgaaagatggggcgtgtaagaaccaagaccgtgaagaaatcttctcgtcaagtcattgagaagtactactctcgcatgactcttgactttcacactaacaagaagatccttgaagaggttgccatcatcccttcaaagagactccgcaacaagattgctggattctccacccacttgatgaaacgtattcagaagggaccagtccgtggaatctcactcaagcttcaagaagaagagcgtgaacgccgcatggactttgttcccgatgagtctgctatcagaaccgatgagatcaaggtcgacaaagagactcttgagatgcttgcttctctaggaatgtctgacactcccggcatctctgcagtcgagccacaaactatggcaccaatccctgctttcggcagagcacccagaagatactaagatgggttttttatcatttagccaatcaagacaaacgattggctctcttttttcacagttagggacaacaaagacttgtggttcttggaatgtttattgtttcttttgattcaagatttatgtcttaaaactcaaagcgagacttttctttttaatggtttttcagttgtggaaccaagattggcgttaacacttttgatagtagcaa

SEQ ID NO: 898 - DNA, 643 bp, Eutrema parvulum
gttcttcttctcttagcaggtaagtcacaggtaactgaaagatggggcgtgtccgtaccaagaccgtgaagaaatcttctcgtcaagtcatcgagaagtactactctcgtatgaccctggacttccacaccaacaagaagatcctcgaagaagttgctatcatcccttcaaagcgactccgcaacaagattgctggattctccacccacttgatgaaacgtatccagaagggaccagtccgtgggatctcactcaagcttcaagaagaagagcgtgaacgccgcatggactttgttcccgatgagtctgctatcaagaccgacgagatcaaggtcgacaaagagactcttgagatgcttgcttcccttggaatgtctgacattcccggcttctccgaagttgagcctcaggcaatggcaccagctgcttttggcaggccacccagaaggttctgaggagttcctcattatcagtcaatcaagagaaaagattggctgttttttctttacagttagggacaaaagacttgcggttctgggagtgtttattgtttcttttgattcgagattatgtccgaaactggaagtgagactctttttctattcaatggtttttgagttttgatgagcgtgtctttgtgaaa

SEQ ID NO: 899 - DNA, 642 bp, Eutrema parvulum
cttctcttagcaggtaagtcacaggtaactgaaagatggggcgtgtccgtaccaagaccgtgaagaaatcttctcgtcaagtcatcgagaagtactactctcgtatgaccctggacttccacaccaacaagaagatcctcgaagaagttgctatcatcccttcaaagcgactccgcaacaagattgctggattctccacccacttgatgaaacgtatccagaagggaccagtccgtgggatctcactcaagcttcaagaagaagagcgtgaacgccgcatggactttgttcccgatgagtctgctatcaagaccgacgagatcaaggtcgacaaagagactcttgagatgcttgcttcccttggaatgtctgacattcccggcttctccgaagttgagcctcaggcaatggcaccagctgcttttggcaggccacccagaaggttctgaggagttcctcattatcagtcaatcaagagaaaagattggctgttttttctttacagttagggacaaaagacttgcggttctgggagtgtttattgtttcttttgattcgagattatgtccgaaactggaagtgagactctttttctattcaatggtttttgagttttgatgagcgtgtctttgtgaaaccgaa

SEQ ID NO: 900 - DNA, 425 bp, Brassica napus
aaactgaaagatggggcgtgtccgaaccaagaccgtgaagaaatcatcacgtcaagtgatcgagaagtactactctcgcatgacgctcgacttccacaccaacaagaagatcctcgaggaagtcgccatcatcccttcgaagcgtctccgcaacaagatcgctggattctccactcatctcatgaagaggatccagaagggaccggtgcgtggtatctcgctcaagcttcaggaggaagagcgtgagcgccgcatggactttgtccccgatgagtctgctatcaagaccgatgagattaaggttgataaagagactcttgagatgcttgcttcccttgggatgtctgacgttcccggcgtctctgtggttgagcctcaggctgtggcacctgcttttggcaggccaccgagaaggtactgaggag

SEQ ID NO: 901 - DNA, 632 bp, Arabidopsis lyrata
ttctttgctttcttctgtattttgccgccgcatctctgctctccagctccggtcaatccatacaggtaaagtcaaaagttgtgaaagatgggtcgtgttcgtaccaaaacagtgaagaagtcttcacgtcaggtgattgagaagtactactctcggatgactctggacttccacaccaacaaaaagatcttagaagaagttgcaatcatcccatctaaaaggctacgcaacaagattgctggattctccactcacttgatgaaacgtatccaaaagggtccagtccgtggaatctccctcaagctacaagaggaagagcgtgaaagacgcatggactttgtccccgatgagtcagccattaaaaccgatgatgttaaggtggacaaagagactctagagatgcttgcttctttgggaatgtctgatactcgtgggatttctcaagtggagacacaacaagctatggcacctgctgtgtttggacggccggcaagaagatactaaggctgagtttattgggtttgaatcaaagacttaggagacatggattcaacatggtttcctttgtttcaagattaatgcctggaatttacagctcttgctttgtttttaacattttttgttcatttgga

SEQ ID NO: 902 - DNA, 724 bp, Brassica rapa
gcagtctttgcttcttcatcatttttgccgccgcctccttcatcttcactcgcaggtataagtcaaaacagtttttaaaacataaaactgaaagatggggcgtgtccgaaccaagaccgtgaagaaatcatcgcgtcaagtgatcgagaagtactactctcgcatgacgctcgacttccacactaacaagaagatcctcgaggaagtcgccatcatcccttcgaagcgtctccgcaacaagatcgctggattctccactcatctcatgaagaggatccagaagggaccggtgcgtggtatctcgctcaagcttcaggaggaagagcgtgagcgccgcatggactttgtgcccgatgagtctgctatcaagaccgatgagattaaggttgataaagagactcttgagatgcttgcttcccttgggatgtctgacgttcctggtgtatctgtggttgagcctcaggctgtggctcctgcttttggcaggccaccaagaaggtactgaggagttcaatcaagagaagaaacttgctgttctttagagtgtttattgtttcttttgtttggatatttatgtctgaatctgaaagtgatacactctttttttttattacattgagtttggagtttttgatgatcattaatatttgagttaaaagttgcaactattgtagttcatgcgttctttgttctaaatatttcacaactcgagatgagagcacat

SEQ ID NO: 903 - DNA, 650 bp, Brassica napus
catttttgccgccgcctcctccttcatcttcactcgcaggtataagtcaaaacagtttttaaaacataaaactgaaagatggggcgtgtccgaaccaagaccgtgaagaaatcatcacgtcaagtgatcgagaagtactactctcgcatgacgctcgacttccacactaacaagaagatcctcgaggaagtcgccatcatcccttcgaagcgtctccgcaacaagatcgctggattctccactcatctcatgaagaggatccagaagggaccggtgcgtggtatctcgctcaagcttcaggaggaagagcgtgagcgccgcatggactttgtgcccgatgagtctgctatcaagaccgatgagattaaggttgataaagagactcttgagatgcttgcttcccttgggatgtctgacgttcctggtgtatctgtggttgagcctcaggctgtggctcctgcttttggcaggccaccgagaaggtactgaggagttcaatcaagagaagaaacttgctgttctttagagtgtttattgtttcttttgtttggatatttatgtctgaatctgaaagtgatacactctttttttttattacattgagtttggagtttttgatgatcattaatatttgagttaaaagttgcaac

SEQ ID NO: 904 - DNA, 621 bp, Brassica napus
gccgccgcctccttcatcttcactcgcaggtataagtcaaaacagtttttaaaacataaaactgaaagatggggcgtgtccgaaccaagaccgtgaagaaatcatcacgtcaagtgatcgagaagtactactctcgcatgacgctcgacttccacaccaacaagaagatcctcgaagaggtcgcaatcatcccttcgaagcgtctccgcaacaagattgctggattctccacccatttgatgaagaggatccagaagggaccggtgcgtggtatctcgctcaagcttcaggaggaagagcgtgagcgccgcatggactttgtgcccgatgagtctgctatcaagaccgatgagattaaggttgataaagagactcttgagatgcttgcttcccttgggatgtctgacgttcccggcgtctctgtggttgagcctcaggctgtggcacctgcttttggcaggccaccgagaaggtactgagaggaaccttgctgttcttagagtgtttattgtttcttttgtttggatatttctgaaagtaaagactctttttctattacatgagttttgagtttttgatgaatcattgatattcgagttaaaaggtgcaactattgtagtt

SEQ ID NO: 905 - DNA, 664 bp, Brassica napus
gcttcttcatcatttttgccgccgcctccttcatcttcactcgcaggtataagtcaaaacagtttttaaaacataaaactgaaagatggggcgtgtccgaaccaagaccgtgaagaaatcatcacgtcaagtgatcgagaagtactactctcgcatgacgctcgacttccacaccaacaagaagatcctcgaagaggtcgcaatcatcccttcgaagcgtctccgcaacaagattgctggattctccacccatttgatgaagaggatccagaagggaccggtgcgtggtatctcgctcaagcttcaggaggaagagcgtgagcgccgcatggactttgtgcccgatgagtctgctatcaagaccgatgagattaaggttgataaagagactcttgagatgcttgcttcccttgggatgtctgacgttcccggcgtctctgtggttgagcctcaggctgtggcacctgcttttggcaggccaccgagaaggtactgagaggaaccttgctgttcttagagtgtttattgtttcttttgtttggatatttctgaaagtaaagactctttttctattacatgagttttgagtttttgatgaatcattgatattcgagttaaaaggtgcaactattgtagttcatgcgttcttagttctaaaaatttc

SEQ ID NO: 906 - DNA, 664 bp, Brassica napus
gccgccgcctccttcatcttcactcgcaggtataagtcaaaacagagtttaaaacataaaactgaaagatggggcgtgtccgaaccaagaccgtgaagaaatcatcacgtcaagtgatcgagaagtactactctcgcatgacgctcgacttccacaccaacaagaagatcctcgaggaagtcgccatcatcccttcgaagcgtctccgcaacaagatcgctggattctccactcatctcatgaagaggatccagaagggaccggtgcgtggtatctcgctcaagcttcaggaggaagagcgtgagcgccgcatggactttgtccccgatgagtctgctatcaagaccgatgagattaaggttgataaagagactcttgagatgcttgcttcccttgggatgtctgacgttcccggcgtctctgtggttgagcctcaggctgtggcacctgcttttggcaggccaccgagaaggtactgaggagttcaatcaagagaagagaagaaccttgctgtattgtttcttttgtttggataattatgtctgaaactgaaagtaaagactctttttctattacatgagttttgagtttttgatgatcattaagatttgaattaaaagttgcaactattgtaaattcatgcgttcttagttctaaaaatttc

SEQ ID NO: 907 - DNA, 703 bp, Brassica napus
atcatttttgccgccgcctcctccttcatcttcactcgcaggtataagtcaaaacagtttttaaaacataaaactgaaagatggggcgtgtccgaaccaagaccgtgaagaaatcatcacgtcaagtgatcgagaagtactactctcgcatgacgctcgacttccacactaacaagaagatcctcgaggaagtcgccatcatcccttcgaagcgtctccgcaacaagatcgctggattctccactcatctcatgaagaggatccagaagggaccggtgcgtggtatctcgctcaagcttcaggaggaagagcgtgagcgccgcatggactttgtgcccgatgagtctgctatcaagaccgatgagattaaggttgataaagagactcttgagatgcttgcttcccttgggatgtctgacgttcctggtgtatctgtggttgagcctcaggctgtggctcctgcttttggcaggccaccgagaaggtactgaggagttcaatcaagagaagaaacttgctgttctttagagtgtttattgtttcttttgtttggatatttatgtctgaatctgaaagtgatacactctttttttttattacattgagtttggagtttttgatgatcattaatatttgagttaaaagttgcaactattgtagttcatacgttctttgttctaaatatttcacaactcgagatgag

SEQ ID NO: 908 - DNA, 616 bp, Brassica juncea
ctcaatcatttttgccgccgccttcaatcttccccgcaggtaagtcaaccggtttaactaaactgaaagatggggcgtgtccgaaccaagaccgtgaagaaatcatcgcgccaggtcatcgagaagtactactctcgcatgacgctagacttccacaccaacaagaagatcctcgaagaagtcgccatcatcccatctaagcgtctccgcaacaagatcgctggattctcaacccatttgatgaagaggatccagaagggaccggtccgtggtatctcactcaagcttcaagaggaagagcgtgagcgacgcatggactttgtgcccgatgagtctgctatcaagaccgatgagatcaaggtcgacaaagagactcttgagatgcttgcttcccttgggatgtctgacgttcctggcgtctctgttgttgagcctctggctgcggcacctgcttttggcaggccaccaagaaggtactaaggagtcgaatcaagagaagaaccattctactcttcttagagtgtttattgtttgtttttattcgagatttgtgtctgaagctgacagtgaaactcctgtttctactactacatggtttttgagttttaagttgcaa

SEQ ID NO: 909 - DNA, 820 bp, Brassica oleracea
  misc_feature (296)..(296): n is a, c, g, or t
gagtctttgcttcttcatcatttttgccgccgcctccttcatcttcactcgcaggtataagtcaaaacagtttttaaaacataaaactgaaagatggggcgtgtccgaaccaagaccgtgaagaaatcatcacgtcaagtgatcgagaagtactactctcgcatgacgctcgacttccacaccaacaagaagatcctcgaagaggtcgcaatcatcccttcgaagcgtctccgcaacaagattgctggattctccacccatttgatgaagaggatccagaagggaccggtgcgtgntatctcgctcaagcttcaggaggaagagcgtgagcgccgcatggactttgtgcccgatgagtctgctatcaagaccgatgagattaaggttgataaagagactcttgagatgcttgcttcccttgggatgtctgacgttcccggcgtctctgtggttgagcctcaggctgtggcacctgcttttggcaggccaccgagaaggtactgagaggaaccttgctgttcttagagtgtttattgtttcttttgtttggatatttctgaaagtaaagactctttttctattacatgagttttgagtttttgatgaatcattgatattcgagttagaaggtgcaactattgtagttcatgcgttcttagttctaaaaatttcacaacttcagatgagagcacattgataattgaacgtttaaattgattaacggtttgataatcgaacattgtcttaagacttcgatgggcctataaccacattaagctgtgtatcattgtcttatgacttagcttctgtggcgtgcttc

SEQ ID NO: 910 - DNA, 634 bp, Brassica napus
ccacgcgtccggcttcatcttcctagcagacaacttaaaagatggggcgtgtccgaaccaagaccgtgaagaaatcatctcgccaagtcatcgagaagtactactctcgcatgacactcgacttccacaccaacaagaagatcctcgaagaagtcgcaatcatcccttcgaagcgtctccgcaacaagatcgctggattctccacccacttgatgaagcgtatccagaagggaccggtccgtggcatctcgctcaagcttcaagaggaagagcgcgagcgccgcatggactttgtgcccgacgagtctgctatcaagaccgatgtgatcaaggtcgataaggagactctggagatgcttgcttcccttggaatgtctgacactagtggcatctctgaagtcgagccacaggctgcacctgctttcagcaggccaccaagaaggttctgaggaggttgttgttgttatcagtcgatcaggagagatatttagattggctgtttttgttttgaagttagggacaaaagacttgctgttcttgaaatgtttattgtttcttttgattggaggtttatgtcctaaactgaaagctacactctttttctattccatggttttatgttttgatgatcgtt

SEQ ID NO: 911 - DNA, 676 bp, Brassica juncea
ggggcgtgtccgaaccaagaccgtgaagaaatcatcgcgtcaagtgatcgagaagtactactctcgcatgacgctcgacttccacactaacaagaagatcctcgaggaagtcgccatcatcccttcgaagcgtctccgcaacaagatcgctggattctccactcatctcatgaagaggatccagaagggaccggtgcgtggtatctcgctcaagcttcaggaggaagagcgtgagcgccgcatggactttgtgcccgatgagtctgctatcaagaccgatgagattaaggttgataaagagactcttgagatgcttgcttcccttgggatgtctgacgttcctggtgtatctgtggttgagccacagactgtggcacctgcttttggcaggccaccgagaaggtactgaggagttcaatcaagagaagaaacttgctgttctttagagtgtttattgtttcttttgtttggatatttatgtctgaatctgaaagtgatacactctttttttttattacattgagtttggagtttttgatgatcattaatatttgagttaaaagttgcaactattgtagttcatgcgttctttgttctaaatatttcacaactcgagatgagagcacattgataattaatagttcgtctactttcttatgataataaagtgagttgt

SEQ ID NO: 912 - DNA, 654 bp, Brassica oleracea
agggtctcttcttcatttttgccgcagcttcatcttcctagcaggtaagtttcagacaacttaaagatggggcgtgtccgaaccaagaccgtgaagaaatcatctcgccaagtcatcgagaagtactactctcgcatgacactcgacttccacaccaacaagaagatcctcgaagaagtggcaatcatcccatcgaagcgtctccgcaacaagatcgctggattctccacccacttgatgaagcgtatccagaagggaccggtccgtggcatctcgctcaagcttcaagaggaagagcgcgagcgccgcatggactttgtccccgacgagtctgctatcaagaccgatgtgataaaggtcgacaaggagactctggagatgcttgcttcccttggaatgtctgacactagtggcatctctgaagtcgagccacaggctgcaccttctttcagcaggccaccaagaaggttctgaggagcttgttgttgttatcagtcgatcaggagagatatttagattggctgtttttgttttgaagttagggacaaaagacttgctgttcttgaaatgtttattgtttcttttgattggaggtttatgtcctaaactgaaagttacactctttttctattccatggttttatgttttgatgt

SEQ ID NO: 913 - DNA, 664 bp, Brassica rapa
ctcttcttcatttttgccgcagcttcatcttcctagcaggtaagtttcagacaacttaaagatggggcgtgtccgaaccaagaccgtgaagaaatcatctcgccaagtcatcgagaagtactactctcgcatgacactcgacttccacaccaacaagaagatcctcgaagaagtcgccatcatcccttcgaagcgtctccgcaacaagatcgctggattctccacccacttgatgaagcgtatccagaagggaccggtccgtggcatctcgctcaagcttcaagaggaagagcgtgagcgccgcatggactttgtccccgacgagtctgctatcaagaccgatgtgatcaaggtcgacaaggagactctggagatgcttgcttcccttggcatgtctgacactagtggcatctctgaagtcgagccacaggctgcacctactttcagcaggccaccaagaaggttctgaggagtttattgttattattatcagtcgaatcaaaagagaaatctttagatttggctgtttttgttttgaagttagggacaaaagacttgctgttcttgaaatgtttattgttgcttttgattcgagatttatgtcctgaactgaaagttacactctcttttttattccatggtttttaagttttgatgaaaaaaa

SEQ ID NO: 914 - DNA, 695 bp, Brassica napus
ggcttcatcttcctagcaggtaagtttcagacaacttaaagatggggcgtgtccgaaccaagaccgtgaagaaatcatctcgccaagtcatcgagaagtactactctcgcatgacactcgacttccacaccaacaagaagatcctcgaagaagtcgccatcatcccttcgaagcgtctccgcaacaagatcgctggattctccacccacttgatgaagcgtatccagaagggaccggtccgtggcatctctctcaagcttcaagaggaagagcgcgagcgccgcatggactttgtccccgacgagtctgctatcaagaccgatgtgatcaaggtcgacaaggagactctggagatgcttgcttcccttggcatgtctgacactagtggcatctctgaagtcgagccacaggctgcacctactttcagcaggccaccaagaaggttctgaggaggttgttgttattattatcagtcgaatcaaaagagaaatctttagacttgctgttcttgaaatgtttattgtttcttttgattcgagatttatgtcctaaactgaaagttacactctttttctattccatggttttatgttttgacgatcttttctcttatgataccagaaacttatttgtttctcataaactgattcaatttcttagattgaaattaaaagtcagttaaattaattttagac

SEQ ID NO: 915 - DNA, 679 bp, Brassica napus
gcgtccgcttcctagcaggtaagtttcagacaacttaaagatggggcgtgtccgaaccaagaccgtgaagaaatcatctcgccaagtcatcgagaagtactactctcgcatgacactcgacttccacaccaacaagaagatcctcgaagaagtcgccatcatcccttcgaagcgtctccgcaacaagatcgctggattctccacccacttgatgaagcgtatccagaagggaccggtccgtggcatctctctcaagcttcaagaggaagagcgcgagcgccgcatggactttgtccccgacgagtctgctatcaagaccgatgtgatcaaggtcgacaaggagactctggagatgcttgcttcccttggcatgtctgacactagtggcatctctgaagtcgagccacaggctgcacctactttcagcaggccaccaagaaggttctgaggaggttgttgttattattatcagtcgaatcaaaagagaaatctttagacttgctgttcttgaaatgtttattgtttcttttgattcgagatttatgtcctaaactgaaagttacactctttttctattccatggttttatgttttgacgatcttttctcttatgataccagaaacttatttgtttctcataaactgattcaatttcttagattgaaattaaaagtcagtt

SEQ ID NO: 916 - DNA, 644 bp, Brassica napus
gcttcatcttcctagcaggtaagtttcagacaacttaaagatggggcgtgtccgaaccaagaccgtgaagaaatcatctcgccaagtcatcgagaagtactactctcgcatgacactcgacttccacaccaacaagaagatcctcgaagaagtggcaatcatcccatcgaagcgtctccgcaacaagatcgctggattctccacccacttgatgaagcgtatccagaagggaccggtccgtggcatctcgctcaagcttcaagaggaagagcgcgagcgccgcatggactttgtccccgacgagtctgctatcaagaccgatgtgataaaggtcgacaaggagactctggagatgcttgcttcccttggaatgtctgacactagtggcatctctgaagtcgagccacaggctgcaccttctttcagcaggccaccaagaaggttctgaggagcttgttgttgttatcagtcgatcaggagagatatttagattggctgtttttgttttgaagttagggacaaaagacttgctgttcttgaaatgtttattgtttcttttgattggaggtttatgtcctaaactgaaagttacactctttttctattccatggttttatgttttgatgatcgtttttcttatgat

SEQ ID NO: 917 - DNA, 675 bp, Cleome gynandra
ttaatagctttgccgccgctgagcttcataccattgccgccgctgcttcctctttcctcgcaggattttctgcctcagtctcgagagtaccggtaagtcagtagttgctgaaagatgggtcgtgttcgaaccaagacagtgaagaaatcttctcgtcaggtcatcgagaagtattactctaagatgacccttgacttccacaccaacaagaagattctggaagaagttgcaatcataccgtcaaagaggctacgtaacaagattgctgggttctccacccacttgatgaagcgaatccagaagggacccgttcgtggaatctcactaaaattgcaggaggaagagcgtgagcgccgcatggactttgtaccggatgagtctgccattaagaccgatgagatcaaggtcgacaaggaaaccctagagatgcttgcatctttggggatgtctgacattcctggtctgtctgaagtcgagccacaagcaatggcaccaagcaatgtgtttggcaggccaggccgaagatactgaagtgtttcgatcgtttacagttaggaacaagactttggcttgtcatgtcttatgaatgaacattgattgttgctttcgatttaaggttttgtgtctgaaagtggatcttttgcgttgtggctttctagtttggttggatatgtt

SEQ ID NO: 918 - DNA, 654 bp, Cleome gynandra
ctgactccattctttgctcttgctctcagccttctcggcgttcaggtaagtgttgaaagatgggtcgtgttcgcaccaagaccgtgaagaagtcttctcgtcaggtcattgagaagtattactccaagatgacccttgacttccacaccaataagaagatcttggaggaagttgccatcatcccctcaaagaggcttcgcaacaagattgctgggttctccacccacttgatgaagcgtatccagaagggcccagttcgtggaatctccctgaaactccaggaggaagagcgtgagcgacgcatggactttgtccctgatgagtctgccattaagaccgatgagatcaaggttgacaaggagaccctagagatgcttgcttctcttggaatgtctgaccttcctggcctatctgaagtcgagccgcaggctatggcaccgagcaatgtgtttggcaggccgggcagaaggtactgagaggagcatgataagttcagccgatttaaagttaggaacaaggctttgattttcaatgtattatggatgaacagtgttgctttgggtttaaggctttatataacgtctgaaattagatttttggtgatacgttatctatttggaaccaaatttgatttaatagtcagaacattcacaa

SEQ ID NO: 919 - DNA, 669 bp, Cleome spinosa
tcgggtaagactgtatctttccagtctcttagcttcatcgttttgccgccgcttctccgcttcaggcccgagcgatacaggtaagtcaggtgttgaaaagatgggccgtgtccgtaccaagacagtgaagaaatcttctcgtcaggtcatcgagaagtattactcaaagatgacactcgacttccacacgaacaagaagatcttggaagaagttgcaatcatcccctccaagaggcttcgcaacaagattgccgggttttccacccacttgatgaaacgtatccagaagggaccagtccgtggaatctccctgaaactccaggaggaagaacgtgaacgccgcatggactttgtccccgacgagtctgccattaaaaccgacgagatcaaggtcgataaggaaaccctagagatgcttgcttctctgggaatgtctgatattccgggtctgtctgaagtggagccgcaggctatggcgccaaccaacctgtttggcaggccgggcagaaggtactgagttgccaatggctggttcttgaaagtaatatggatatgaaacatcgtttgctttcggtttaaggttaatgtctgaatatggaactgttgcatttgatctttcattttttggttgatatgtttttgttctatttggtaaccaaagagttgtag

SEQ ID NO: 920 - DNA, 724 bp, Raphanus sativus
gggaacctatatatatatttataataaaacgcaacatccctcctcctccgtctttgtttcctcatcattttttgccgccgccttcaggtaagtcaacagctttaaactaagcttaaaagatggggcgtgtccgaaccaagaccgtgaagaaatcatcacgtcaagtgatcgagaagtactactctcgcatgacgctcgacttccacaccaacaagaagatcctcgaggaagtcgccatcatcccttccaagcgtctccgcaacaagattgctggattctccactcatctcatgaagaggatccagaagggaccggtacgtggtatctcgctcaagcttcaagaggaagagcgtgagcgccgcatggactttgtgcccgatgagtctgctatcaagaccgatgagatcaaggtcgacaaggagactcttgagatgcttgcttcccttgggatgtctgacgttgctggcgtctctgtggttgagcctctggctgtggctcctgcttttggtggcaggccacaaagaaggttctaaaggagtttattatcactattatgagtcaatcaaagagaaacctgctgttcttatagtgtttattgtttcttttgattcgagatttttatgtcccaagctgaaagtgagactacttttctactatatgagtttttgttgatcgtttgttaagagacatcaagatttgagttaaaaatgctttcttagttcta

SEQ ID NO: 921 - DNA, 1297 bp, Brassica napus
gttagcaaaaaaaacctttattttcttgaagaccaacatggagaagcataattaaaaaagaaaaatataaaaccaactaagaactcattatttataattctgatatctaactaaagcccctaagctggcgagggagcagatggagtagatccagctttggtggcgcaatgtagcttaacaaagtagtcaaagaaagggttatggtaagctccaaaaacagtcttgtcacagtctacatccatcttctgtatcgaagcacaacaatccgatccaataacaggtttgtgggtgaagaaagctttctggatatccgccatacatgtttttacatccttgcaatcagacaagcacttggcgactaccggtggtggatggaacggaacagggtggaaagggtggttgtagccggctgggagtggcggaaaggcctttccgccagcacatgggaacgtccactgtggcggcttagggtgaaagtaagggtaggaatggtaatgccaccattcgagcttttcgctacgcaatgatggcattgactccatatcacttgctgtgacttgagatgtgacatagcatgagaagagtataatagcaacaagcatcgcgagattcttcatttttctttggattcttgggagcttttatgcaggtaagtttcagacaacttaaaagatggggcgtgtccgaaccaagaccgtgaagaaatcatctcgccaagtcatcgagaagtactactctcgcatgacactcgacttccacaccaacaagaagatcctcgaagaagtggcaatcatcccatcgaagcgtctccgcaacaagatcgctggattctccacccacttgatgaagcgtatccagaagggaccggtccgtggcatctcgctcaagcttcaagaggaagagcgcgagcgccgcatggactttgtgcccgacgagtctgctatcaagaccgatgtgataaaggtcgacaaggagactctggagatgcttgcttcccttggaatgtctgacactagtggcatctctgaagtcgagccacaggctgcaccttctttcagcaggccaccaagaaggttctgaggagcttgttgttgttatcagtcgatcaggagagatatttagattggctgtttttgttttgaagttagggacaaaagacttgctgttcttgaaatgtttattgtttcttttgattggaggtttatgtcctaaactgaaagttacactctttttctattccatggttttatgttttgatgatcgtttttcttatgatgcctttatatagttgtttctc

SEQ ID NO: 922 - DNA, 610 bp, Eutrema halophilum
ctggttcttcttctcttatagcaggtaagtggcaggtaaattgaaagatggggcgtgtcagaaccaagaccgtgaagaaatcttctcgtcaagtcatcgagaagtactactctcgcatgactcttgatttccacaccaacaagaagatcttggaagaagttgcgatcatcccttcaaagcgactacgcaacaagattgctggattctccacccacttgatgaaacgtatccaaaagggtccagtgcgtggaatctcactcaagctacaagaggaagagcgcgaaaggcgaatggactttgtccccgacgagtcagccattaaaaccgatgagattaaggtggacaaagagactctacagatgcttgcttcgttgggaatgtctgatattcccgggttttctgtagtggagccacaagctatggcaccaggcaatgtgtttggccgtcctggaagaagattctaagtcttgcgtttatctaaatgagttaggaaacaaagagtcttgtttttatccgagtgttatggattcgacgttgtttccttcttctgttcgggattattgtctcgctttgttttgaatttttgtttatcatcttttgtctatttgga

SEQ ID NO: 923 - DNA, 725 bp, Eutrema halophilum
ccggctgctctaacgcctctttgcaccgctttgttttcgctctccttccgttcattctcctttaagcaggtaagtagcagttaaactgaaagatggggcgtgtcagaaccaagaccgtgaagaaatcttctcgtcaagtcatcgagaagtactactctcgcatgactcttgacttccacaccaacaagaagatcttggaagaagttgcaatcatcccttctaagcgactacgcaacaaaattgctggattctccactcacttgatgaaacgtatccaaaagggtccagtccgtggaatctcactcaagctacaagaggaagagcgtgagaggcgaatggactttgtccccgacgagtcagccattaaaaccgatgagattaaggtggacaaagagactctacagatgcttgcttctttgggaatgtctgatattcccgggttttctgtagtggagccacaagctatggcaccaggcaatgtgtttggccgtcctggaagaagattctaaagtcttgcctttatcgaaaggagttaggacacagagagtctgtgttatggattcgacgttgtttccttcttctgttcggcattattaatgtctcgctttgttttgaatttttgtttatcaatcttttgtctatttggaactaaaatcttggatttgcttgcaatcatcagttgaaacatcacttagaatatctataaaatatttctttttgaatgc

SEQ ID NO: 924 - DNA, 975 bp, Brassica juncea
gggcgtgtccgaaccaagacggtgaagaaatcatctcgtcaggtcatagagaagtactactctcgcatgacactcgacttccacaccaacaagaagatcctcgaagaagtcgccatcatcccatccaaacgtctccgcaacaagatcgctggattctccacccatttgatgaagcgtatccagaagggaccggtccgtggcatctctctcaagcttcaagaggaagagcgcgagcgccgcatggactttgtccccgacgagtctgctatcaagaccgatgtgatcaaggtcgacaaggagactctggagatgcttgcttcccttggcatgtctgacactagtggcatctctgaagtcgagccacaggctgcacctactttcagcaggccaccaagaaggttctgaggaggttgttgttattattatcagtcgaatcaaaagagaaatctttagacttgctgttcttgaaatgtttattgtttcttttgattcgagatttatgtcctaaactgaaagttacactctttttctattccatggttttatgtttccgtcaagttgaaattcattcataatcgaaataccaaaattcatacaaaagttgacaccaaaacgaaatatccccataaccaagagcccatagaaagcggcaactagaacccacacacgggcgacttgaatccacaccgggatgactcgagaaataaacataagatctaaaggacagtagaaacacataataggttaacatctatgcaggagccaaaacagaaaacctagcagactttaactaagaaagggccaaatgatcgggagttaccgttgctgcctatagcccaccacccgataacctccacttccgcacccaaccacactttatcgttgctgcctcgcacgccaaacgataagaccaagaaccggaggcttcatatctcgacaaggggaaccgctgctcagtccacacgccttgaatgc

SEQ ID NO: 925 - DNA, 730 bp, Cleome spinosa
tatataaatccctctagggttttctctctctctctctctaatacgtggagagcttcttcttcgagcggccaaaatccttctattcaccttcgcaatcccgcgaatctcaggtaagtcggtgttgaaagatgggtcgtgttcgtaccaagaccgtgaagaagtcgtctcgtcaggtcatcgagaagtattactccaggatgacccttgacttccacaccaacaagaagatcttggaggaagttgccatcattccgacaaagaggctgcgcaacaagattgccgggttttccacccacttgatgcagcgcatccagaagggacccgtccgtggaatctccctgaaactccaggaggaagagcgtgagcgtcgcatggactttgtccccgatgagtctgccatcaagaccgatgagatcaaggttgacaaggagacccttgagatgcttgcttctctcggaatgtctgaccttccgggtctgtctgaagtcgagcctcaggccatggcaccgagcaacctgtttggaaggccaggcagaaggtactgagtgtatcgaggatttacagttaggaacaagactttggcttttgaagtatgatggagattaaacattgttgctttcggtggaactcttgcgttgtggctttcattttggtttgatatgttgtctattttggtaaccaatgttataagcatccgcagtcctcattcaatgtgatttggtgtttttga

SEQ ID NO: 926 - DNA, 668 bp, Cleome spinosa
cgctttctcctttgtttcatcgttttgccgccgccgctgcttcatcattctcgcaggcttctccgcttcaggctcggactatacaggtaagtcggagctgaaacatgggtcgtgttcgtaccaagactgtgaagaaatcttctcgtcaggtcatcgagaagtattactcgagaatgacccttgatttccacaccaacaagaagatcctcgaggaagttgccattatcccctcgaagaggcttcgcaacaagattgccgggttctccacacacttgatgaaacgtatccagaagggcccggtccgaggaatctccctgaaactgcaggaggaagagcgtgaacgtcgcatggactttgtcccggacgagtctgccattaagaccgacgagatcaaggttgacaaggaaaccctagagatgctttcttctctgggaatgtctgatcttcctggtctgtcagaagttgagccacaggctatggcaccagtcaacatgtttggcaggccaggcagaaggttctgaagatgacaagcatcatcatggaagaacacattgttactttagcttttaaggttaatgtctgaaagttggaactgtttgtgttgtggctttcattttttgggtgatatgttgtctatttggaaccaagattttgagttacaatagtca

SEQ ID NO: 927 - DNA, 666 bp, Raphanus sativus
  misc_feature (280)..(280): n is a, c, g, or t
ttttttgccgccgccttcaggtaaagtcaaacaggtaaactaaacttaaaagatggggcgtgtccgaaccaagaccgtgaagaaatcatcacgtcaagtgatcgagaagtactactctcgcatgacgctcgacttccacaccaacaagaagatcctcgaagaagtcgccatcatcccttccaagcgtctccgcaacaagattgctggattctccactcatctcatgaaacgtatccagaagggaccggtacgtggcatctcgctcaagcttcaagaggangagcgtgagcgccgcatggactttgtgcccgatgagtctgctatcaagaccgatgagatcaaggtcgacaaggagactcttgagatgcttgcttcccttggcatgtctgacgttgctggcgtctctgtggttgagcctctgactgtggctcctgcttttggtggcaggccacaaagaaggttctaaaggagtttattatcactattatgagtcaatcaaagagaaacctgctgttcttatagtgtttattgtttcttttgattcgagatttttatgtcccaagctgaaagtgagactacttttctactatatgagtttttgagtttttgtcgatcgtttgttaagaggcaacttgaaattgcacaacttgagattgttcaaccgga

SEQ ID NO: 928 - DNA, 726 bp, Thellungiella halophila
  misc_feature (590)..(590): n is a, c, g, or t
gccggctgctctaacgcctctttgcaccgctttgttttcgctctccttccgttcattctcctttaagcaggtaagtagcagttaaactgaaagatggggcgtgtcagaaccaagaccgtgaagaaatcttctcgtcaagtcatcgagaagtactactctcgcatgactcttgacttccacaccaacaagaagatcttggaagaagttgcaatcatcccttctaagcgactacgcaacaaaattgctggattctccactcacttgatgaaacgtatccaaaagggtccagtccgtggaatctcactcaagctacaagaggaagagcgtgagaggcgaatggactttgtccccgacgagtcagccattaaaaccgatgagattaaggtggacaaagagactctacagatgcttgcttctttgggaatgtctgatattcccgggttttctgtagtggagccacaagctatggcaccaggcaatgtgtttggccgtcctggaagaagattctaaagtcttgcctttatcgaaaggagttaggacacagagagtctgtgttatggattcgacgttgtttccttcttctgttcggnattattaatgtctcgctttgttttgaatttttgtttatcaatcttttgtctatttggaactaaaatcttggatttgcttgcaatcatcagttgaaacatcacttagaatatctataaaatatttctttttgaatgc

SEQ ID NO: 929 - DNA, 563 bp, Eutrema parvulum
tttgggcaggtaagtctaaaagtagtgaaagatgggtcgtgttcgtaccaaaactgtgaagaaatcttcacgtcaggtgattgagaagtactactcaaggatgactcttgacttccacaccaacaagaagattttggaagaagttgcaatcatcccgtcaaaaagactacgcaacaagattgctggattctccacccatttgatgaaacgtatccaaaagggtccagtccgtggaatctccctcaagctacaagaggaagagcgtgaacgacgaatggactttgttcccgacgagtcagccattaaaaccgatgagattaaggtcgacaaagagactctagagatgcttgcttgtttgggaatgtccgatattcccggcttttctgaagtggagccacaagcaatggcaccgaccattggccggcctggaagaagattctaaggcttgagtttagacaagattttggtttttattggggtgttatggattcaacattgtttccttggattcaaaattaatgtatggaacttacaaactctcattttgttttgatatattgttt

SEQ ID NO: 930 - DNA, 624 bp, Brassica juncea
tcttcatcttcctcgcaggtaagtaagtaagtcaagagataactgaaagatggggcgtgtccgtaccaagaccgtgaagaaatcttctcgccaagtcatcgagaagtattactctcgcatgacgctcgacttccacacgaacaagaagatcctcgaagaagtcgccatcatcccttcgaagaggctccgcaacaagattgctggattctccactcatctcatgaagaggatccagaagggaccagtccgtggtatctcgctcaagcttcaagaggaagagcgtgagcgccgcatggactttgtccccgatgagtctgctatcaagaccgatgtgatcaaggtggacaaggagactctagagatgcttgcttcccttggaatggctgacactcctggcttctctgaagtcgagactcaggctcctgcacctgcttttggcaggccacccagaaggttctgaggagtttgctctttattatcagtcaatcaagattctgttgccttttcaattttagggacacaagagttgcagttcttttgagtgttttatgtcttttgattcgagacttatgtctgaaactgaaagttaagacttttttctatattccatacttttttgagttt

SEQ ID NO: 931 - DNA, 737 bp, Brassica oleracea
gaaagaaaaggcaatttctcttctccgtctttgctcctttcatttttgctgccgcttcatcatcttcctcgcaggtaagtaagcaagaacagagataaactgaaagatggggcgtgtccgtaccaagaccgtgaagaaatcatctcgccaagtcatcgagaagtattactctcgcatgacactcgacttccacaccaataagaagatcctcgaagaagtcgcaatcatcccttcgaagcgtctccgcaacaagatcgctggattctccactcatctcatgaagaggatccagaagggaccagtccgtggtatctcgctcaagcttcaagaggaagagcgtgagcgccgcatggactttgttcccgatgagtctgccatcaagaccgatgtgatcaaggtggacaaagagactcttgagatgcttgcttcccttggaatggctgacactcctggcttctctgaagtcgagacgcaggctccggctcctgcttttggcaggccacccagaaggttctgaggtgttggttgctctcttataatcagccaatcaagatgctgttgccttttcaatcttagggacaaaagagttgcagttgcttgagtgtttatgtcttttgattcatgacttatgtctgaaactgaaagttagactctttttttttcttttctattccatggtttttgagttttagatgatcatttagttaactaacacatgtcggtaataacagcatttg

SEQ ID NO: 932 - DNA, 666 bp, Brassica rapa
cccacgcgtccgcggacgcgtgggcatttttgctgccgcttcttcatcttcctcgcaggtaagtaagtaagtcagagataaactgaaagatggggcgtgtccgtaccaagaccgtgaagaaatcttctcgccaagtcatcgagaagtattactctcgcatgacactcgacttccacacgaacaagaagatcctcgaagaagtcgcaatcatcccttcgaagcgtctccgcaacaagatcgctggattctccacccatttgatgaagaggatccagaagggaccagtccgtggtatctcgctcaagcttcaagaggaagagcgtgagcgccgcatggactttgttcccgatgagtctgccatcaagaccgatgtgatcaaggtggacaaggagactcttgagatgcttgcttcccttggaatggctgacactcctggcttctctgaagttgagactcaggctccggctcctgcttttggcaggccacccagaaggttctgaggagtttgctctttattatcagtcaatcaagattctgttgccttttcaattttagggacacaagagttgcagttctttgagtgttttatgtcttttgattcgagacttatgtctgaaactgaaagttaagacttttttctatattccatacttttttgagttttaa

SEQ ID NO: 933 - DNA, 639 bp, Brassica rapa
catttttgctgccgcttcttcatcttcctcgcaggtaagtaagtaagtcaagagataactgaaagatggggcgtgtccgtaccaagaccgtgaagaaatcttctcgccaagtcatcgagaagtattactctcgcatgacactcgacttccacacgaacaagaagatcctcgaagaagtcgcaatcatcccttcgaagcgtctccgcaacaagatcgccggattctccacccatttgatgaagaggatccagaagggaccagtccgtggtatctcgctcaagcttcaagaggaagagcgtgagcgccgcatggactttgtccccgatgagtctgctatcaagaccgatgtgatcaaggtggacaaggagactctagagatgcttgcttcccttggaatggctgacactcctggcttctctgaagtcgagacacaggctccggctcctgcttttggcaggcctcccagaaggttctgaggagtttgctctttattatcagccaatcaaaatgctgttgctttttcaatcttagggacacaagagttgcagttctctgagtgtttatgtcttttgattcgagacttatgtctgaaactgaaatttaagacttttttctatattccatacttttttgagtttt

SEQ ID NO: 934 - DNA, 633 bp, Brassica napus
atttttgctgccgcttcttcatcttcctcgcaggtaagtaagtaagtcaagagataactgaaagatggggcgtgtccgtaccaagaccgtgaagaaatcttctcgccaagtcatcgagaagtattactctcgcatgacactcgacttccacacgaacaagaagatcctcgaagaagtcgcaatcatcccttcgaagcgtctccgcaacaagatcgccggattctccacccatttgatgaagaggatccagaagggaccagtccgtggtatctcgctcaagcttcaagaggaagagcgtgagcgccgcatggactttgtccccgatgagtctgctatcaagaccgatgtgatcaaggtggacaaggagactctagagatgcttgcttcccttggaatggctgacactcctggcttctctgaagtcgagacacaggctccggctcctgcttttggcaggcctcccagaaggttctgaggagtttgctctttattatcagccaatcaaaatgctgttgctttttcaatcttagggacacaagagttgcagttctctgagtgtttatgtcttttgattcgagacttatgtctgaaactgaaatttaagacttttttctatattccatacttttttga

SEQ ID NO: 935 - DNA, 675 bp, Brassica napus
gaaagaaaaggcagtttctcatctccgtctttgctcctttcatttttgctgccgcttcttcatcttcctcgcaggtaagtaagtaagtcaagagataactgaaagatggggcgtgtccgtaccaagaccgtgaagaaatcttctcgccaagtcatcgagaagtattactctcgcatgacactcgacttccacacgaacaagaagatcctcgaagaagtcgcaatcatcccttcgaagcgtctccgcaacaagatcgccggattctccacccatttgatgaagaggatccagaagggaccagtccgtggtatctcgctcaagcttcaagaggaagagcgtgagcgccgcatggactttgtccccgatgagtctgctatcaagaccgatgtgatcaaggtggacaaggagactctagagatgcttgcttcccttggaatggctgacactcctggcttctctgaagtcgagacacaggctccggctcctgcttttggcaggcctcccagaaggttctgaggagtttgctctttattatcagccaatcaaaatgctgttgctttttcaatcttagggacacaagagttgcagttctctgagtgtttatgtcttttgattcgagacttatgtctgaaactgaaatttaagacttttttctatattccatacttttttgag

SEQ ID NO: 936 - DNA, 1527 bp, Brassica napus
catacttcatttaaaaccagtgacatggcagacaacaacataaaatatatttgaatgattaaacaaaatccaaaatcctcacaagtaactcaaccattcaccaacaaggaaaatactatcaaaacttcatatgaaaaaaatgagacttggctctctctaatttctttttggaggatgaacaccgccgcacttgtgccccttatgccctccttgctgatttgcaactttggctttctttgatgcaactgtgttgttgttgttcattgctccaccatttggtctcttcttgctcggaggctcaacctttacgggtgtatcctcttcttcttcttctgagtcatcctcatccacatccgaacccatctcatcagagtcagattcaccatcttcaaggttggccttttgaccattcagctcattggcctttgatttctccaattcacttcgaaacatatccatgggaatatcctcatcctctgaatcaaaatcagagttgagctcaccatccatagtatcaacggtcttgtaaccaagaagatagacactggagcttttgcactcatgtgagacctcaaaatcttgctcgaacaagagatcgagataaacttgaggaaccttctgagagaggtttccgatgacaagcttttgcttatcatcaccaccaaccttcacaaagacctgaacagtcttatctccaaccttgttgaactcaccaattgcaatctgagagacatggatcatgtaaccatcttcttgttccaccttggtgggctttccaggcttaatctcaataccccaaaactccatagctagcgaaagaggtggctgcttgaagatgaagaagagattagggatttttgctgccgcttgttcatcttcctcgcaggtaagtaagtaagtcaagagataactgaaagatggggcgtgtccgtaccaagaccgtgaagaaatcttctcgccaagtcatcgagaagtattactctcgcatgacactcgacttccacacgaacaagaagatcctcgaagaagtcgcaatcatcccttcgaagcgtctccgcaacaagatcgccggattctccacccatttgatgaagaggatccagaagggaccagtccgtggtatctcgctcaagcttcaagaggaagagcgtgagcgccgcatggactttgtccccgatgagtctgctatcaagaccgatgtgatcaaggtggacaaggagactctagagatgcttgcttcccttggaatggctgacactcctggcttctctgaagtcgagactcaggctccggcacctgcttttggcaggccacccagaaggttctgaggagtttgctctttattatcagtcaatcaagattctgttgccttttcaattttagggacacaagagttgcagttctttgagtgttttatgtcttttgattcgagacttatgtctgaaactgaaagttaagacttttttctatattccatacttttttgagttttgatgagcgttggtttattttattttattttatttt

SEQ ID NO: 937 - DNA, 719 bp, Brassica napus
ggatttttgctgccgcttcatcatcttcctcgcaggtaagtaagcaagaacagagataaactgagagatggggcgtgtccgtaccaagaccgtgaagaaatcatctcgccaagtcatcgagaagtactattctcgcatgacactcgacttccacaccaacaagaagatcctcgaagaagtcgcaatcatcccttcgaagcgtctccgcaacaagatcgctggattctccactcatctcatgaagaggatccagaagggaccagtccgtggtatctcgctcaagcttcaagaggaagagcgtgagcgccgcatggactttgttcccgatgagtctgccatcaagaccgatgtgatcaaggtggacaaagagactcttgagatgcttgcttcccttggaatggctgacactcctggcttctctgaagtcgagacgcaggctccggctcctgcttttggcaggccacccagaaggttctgaggtgttggttgctctcttataatcagccaatcaagatgctgttgccttttcaatcttagggacaaaagagttgcagttgcttgagtgtttatgtcttttgattcatgacttatgtctgaaactgaaagttagactctttttttttcttttctattccatggtttttgagtttagatgatcatttagttaactaacacatgtcggtaataacagcatttgatgtggtctttgttgccacttg

SEQ ID NO: 938 - DNA, 777 bp, Brassica napus
ctggaccctgcggtccggtccggaattttgggtcgaggcagcgttttcatttttgctgccgcttcatcatcttcctcgcaggtaagtaagcaagaacagagataaactgagagatggggcgtgtccgtaccaagaccgtgaagaaatcatctcgccaagtcatcgagaagtactattctcgcatgacactcgacttccacaccaacaagaagatcctcgaagaagtcgcaatcatcccttcgaagcgtctccgcaacaagatcgctggattctccactcatctcatgaagaggatccagaagggaccagtccgtggtatctcgctcaagcttcaagaggaagagcgtgagcgccgcatggactttgttcccgatgagtctgccatcaagaccgatgtgatcaaggtggacaaagagactcttgagatgcttgcttcccttggaatggctgacactcctggcttctctgaagtcgagacgcaggctccggctcctgcttttggcaggccacccagaaggttctgaggtgttggttgctctcttataatcagccaatcaagatgctgttgccttttcaatcttagggacaaaagagttgcagttgcttgagtgtttatgtcttttgattcatgacttatgtctgaaactgaaagttagactctttttttttcttttctattccatggtttttgagtttagatgatcatttagttaactaacacatgtcggtaataacagcatttgatgtggtctttgttgccacttgagacgataattg

SEQ ID NO: 939 - DNA, 634 bp, Brassica napus
atttttgctgccgcttcttcatcttcctcgcaggtaagtaagtaagtcaagagataactgaaagatggggcgtgtccgtaccaagaccgtgaagaaatcttctcgccaagtcatcgagaagtattactctcgcatgacactcgacttccacacgaacaagaagatcctcgaagaagtcgccatcatcccttcgaagcgtctccgcaacaagatcgctggattctccactcatctcatgaagaggatccagaagggaccggtccgtggtatctcgctcaagcttcaagaggaagagcgtgagcgccgcatggactttgtccccgatgagtctgctatcaagaccgatgtgatcaaggtcgacaaggagacgctagagatgcttgcttcccttggaatggctgacactcctggcttctctgaagtcgagactcaggctccggcacctgcttttggcaggcctcccagaaggttctgaggagtttgctctttattatcagccaatcaaaatgctgttgctttttcaatcttagggacacaagagttgcagttctttgagtgttttatgtcttttgattcgagacttatgtctgaaactgaaagttaagacttttttctctattccaagcttttttga

SEQ ID NO: 940 - DNA, 697 bp, Brassica napus
tcggccttatggccgggggctcctttcatttttgctgccgcttcttcatcttcctcgcaggtaagtaagtaagtcaagagataactgaaagatggggcgtgtccgtaccaagaccgtgaagaaatcttctcgccaagtcatcgagaagtattactctcgcatgacactcgacttccacacgaacaagaagatcctcgaagaagtcgccatcatcccttcgaagcgtctccgcaacaagatcgctggattctccactcatctcatgaagaggatccagaagggaccggtccgtggtatctcgctcaagcttcaagaggaagagcgtgagcgccgcatggactttgtccccgatgagtctgctatcaagaccgatgtgatcaaggtcgacaaggagacgctagagatgcttgcttcccttggaatggctgacactcctggcttctctgaagtcgagactcaggctccggcacctgcttttggcaggcctcccagaaggttctgaggagtttgctctttattatcagccaatcaaaatgctgttgctttttcaatcttagggacacaagagttgcagttctttgagtgttttatgtcttttgattcgagacttatgtctgaaactgaaagttaagacttttttctctattccaagcttttttgaccaaccatctccaaacaaaccccctccccttggggc

SEQ ID NO: 941 - DNA, 762 bp, Raphanus sativus
gggacattatttatacactaaaattttcgtcagctccgtcttttagcttatcttctattcatttacagtcgcttcatcatctctccagctccgaccaggacgtaacaggtaagtacaaaaaagagtggtgaaagatgggtcgtgttcgtaccaaaacagtgaagaaatcgtcacgtcaggtgatcgagaagtactactcgaggatgacactcgacttccacacgaacaagaagatcttggaggaagtcgcaatcatcccttccaaaagactacgtaacaagatcgctggcttctccacccacttgatgaagcgtatccaaaagggaccggtgcgtgggatctcgctcaagctgcaggaggaggagcgcgaacggagaatggactttgtccccgacgagtcggcgatcaagaccgatgatgtgaaggtggacaaagagacgctagagatgcttgcttcgttgggaatgtctgacgtttccgggttttctcaagtggagacacaagcggccgtggcaccaggcaatgcgtttggccgtggtggaagaagattttaaggcattgagttttgttttttttgttttgtgttatggaatgattcacaacgttgttaatctctttcgtatattcttgcagtactgtttttatccaagtttcagaagtgttgaattaaatcatttcgaatcaacaaatgagttttaattatttctttttgtattggggaattatggattaattcaacattgtttagttgcttcacgatcg

SEQ ID NO: 942 - DNA, 668 bp, Raphanus sativus
  misc_feature (73)..(73): n is a, c, g, or t
  misc_feature (96)..(96): n is a, c, g, or t
  misc_feature (99)..(99): n is a, c, g, or t
  misc_feature (549)..(549): n is a, c, g, or t
  misc_feature (577)..(577): n is a, c, g, or t
  misc_feature (592)..(592): n is a, c, g, or t
atcttctgtgcatttacagtcgcttcaatcttctctccagctccgacgaggacgtaataggtaagtacaaaanagggtggtgaaaagatgggtcgngtncgtaccaaaacagtgaagaaatcgtcacgtcaggtgatcgagaagtactactcgaggatgacactcgacttccacacgaacaagaagatcttggaggaagtcgcaatcatcccttccaaaagactacgcaacaagatcgctggattctccacccacttgatgaagcgtatccagaagggaccggtgcgtgggatctcgctcaagctacaggaggaggagcgcgaacggagaatggactttgtccccgacgagtcggcgatcaagaccgatgatgtgaaggtggacaaggagacgctagagatgcttgcgtctttgggaatgtctgacgtttccgggttttctcaagtggagacacaagcggccgtggcgccaggcaatgcgtttggccgtggtggaagaagattctaaggcatatgagttttgttttttttgttggagtgttatggattnattcaacattgtgtttccttcggttcanagattaatctctttngtatattcttgcagtactgtttccattcatgtgtcacaagtgttgaattaaatctttgaatcacagcaaatgagtt

SEQ ID NO: 943 - DNA, 654 bp, Arabidopsis thaliana
tttttctttttctttgctttcttctgtatttgccgccgcttctctgctctccagctccggtcaatccgtacaggtaagtcaaaaagttgtgaaagatgggtcgtgttcgtaccaaaacggttaagaagtcttcacgtcaggtgattgagaagtactactcacggatgacactagacttccacaccaacaagaagatcttggaagaagttgcaatcatcccatcgaaaaggctacgcaacaagattgctggattctccactcacttgatgaaacgtatccaaaagggtccagtccgtggaatctccctcaagctacaagaggaagagcgtgaaaggcgaatggactttgttcccgatgagtcagccattaaaatcgatgatgttaaggtggacaaagagacactagagatgcttgcttctttgggaatgtctgatattgctgggatttctcaagtggagacacaacaagctatggcacctgctgtgtttggacgtcccgcaggaagataccaacgctaagtttattgggtttcaatcaaagatttcggagacgagagtttggtttattggtctagtatggattcaacatcgtttcctttgatttaagattaatgtcgtttcctttgatttaagattaatgtctggaatttatagc

SEQ ID NO: 944 - DNA, 708 bp, Brassica napus
ctgcatttaccgccgcttcatcttctccccagctccccagctccggccaggccgtacagtttaagtaaaaaaaagtgtggtgaaagatgggtcgtgttcgtaccaaaaccgtgaagaaatcatcacgtcaggtgatagagaagtactactcaaggatgacactagacttccacacgaacaagaagatcttggaggaagtcgcgatcatcccgtcgaaaagactacggaacaagatcgctggattctccacacacttgatgaaacgtatccaaaagggtccagtccgcgggatctcgctcaagctgcaagaggaggagcgcgaacggagaatggactttgtccccgacgagtcggcgattaaaacggatgacgttaaggtggataaagagacgctagagatgcttgcttcattggggatgtctgatgtttccgggttttctcaagtggagacacaagcagccgtggtaccgagcaatgcgtttggccgtggtggaagaagattctaaggcatttttttgaatcaacaaatgagttttgttttgttttttggagtgtttatggattaattcaacgttgtttccatggattcgagattaaaaatttacgagctctcactttgttttaatatatcgaattaaatcatattttgtataactattattattagctcatagccaaactgtaaatacgatgatgagtcaggggcat

SEQ ID NO: 945 - DNA, 491 bp, Eutrema parvulum
agaagcagaagtagagagaggctcaaaaagtttcataactctaaaatctacaggcaaggatgggtcgcgtccgcacgaagacggtgaagaaatcatctcgccaggtgatcgagaagtactactcgcgcatgactctcgatttccacaccaacaagaagattctcgaagaggtcgcaatcatcccttccaagaggctccgcaacaagatcgccggattctccacccatctcatgaagaggatccagaaggggcctgtccgtggaatctccctcaagcttcaagaggaagagcgtgagcgccgcatggacttcgtccctgacgaatccgccattaaaaccgatcacatcgaggtcgacaaggagacactcgacatgcttgcctccttgggaatgtccgacatgccaggcgtcgtcaaggtggatcccgtctccgccgctcctgttgccgcctttggattgggccgtggaaggaggtactagagaatcggtcct

SEQ ID NO: 946 - DNA, 464 bp, Arabidopsis lyrata
cccccaaatcacaaccaaaaaatgggtcgcgttcgcacgaagactgtgaagaaatcatctcgtcaggtgatcgagaagtactactctcgcatgactcttgatttccacacgaacaagaagatcctcgaagaagtcgcaatcatcccatcgaagagactccgcaacaagatcgctggtttctccactcatctcatgaagaggatccaaaagggacctgtccgtggaatctccctcaagcttcaggaggaagagcgtgagcgccgtatggactttgtccctgacgaatccgccattaaaaccgatcacatcgaggtcgataaggagacgcttgagatgcttgcttccttgggaatgtctgagctaccaggtgttgttaaggtggatccagccgctgctgctccggttgctgcatttggattgggtcgtggaaggaggtactagagtgtccatcgatcaaatcaatc

SEQ ID NO: 947 - DNA, 678 bp, Brassica juncea
tttttcaccagccgcttcatcgtcctcgcaggtaagtaagtcacaggaaactaactgaaagatggggcgtgtccgaaccaagaccgtgaagaaatcatctcgtcaggtcatcgagaagtactactctcgcatgacactcgacttccacaccaacaagaagatcctcgaagaagtcgcaatcatcccttcaaagcgtctccgcaacaagatcgccggattctccacccatctcatgaagaggatccagaagggaccggtgcgtggtatctcgctcaagcttcaagaggaagagcgtgagcgccgcatggactttgtgcccgacgagtctgccatcaagaccgatgtgatcaaggtcgacaaagagactcttgagatgcttgcttcccttggcatggctgacactcccggcgtctctgaagtcgagactcaggctgcacctacttttaacaggccacccagaaggttctgaggagtttgttgctatcatcagtcaatgaagagaaatcttatagattattattggctgttgttttttcactgttaggagacaaaagagttgcagttctttgagtgtttatgtctttttgattcgagatttatttctgaaactgaaagttaagactcttttctctatttcatggtttttgagttttgatgatcatcgagttactgatgtga

SEQ ID NO: 948 - DNA, 580 bp, Brassica juncea
taactgaaagatggggcgtgtccgaaccaagacggtgaagaaatcatctcgtcaggtcatagagaagtactactctcgcatgacactcgacttccacaccaacaagaagatcctcgaagaagtcgccatcatcccatccaaacgtctccgcaacaagatcgctggattctccacccatctgatgaaacgtatccagaagggaccggtccgcggcatctcgctcaagcttcaggaggaagagcgcgagcgccgcatggactttgtccccgacgagtctgctatcaagaccgatgtgatcaaggtcgacaaggagacgctggagatgcttgcttcccttgggatgtctgacgctcatggcttctctgaagtcgaggcgcaggcggcaccttcttttgctaggccaccgagaaggttctgaggaggttgtttgttgttgtttatcagtcgaatcaagggaggaatctttagatttggctgttgttgtttcgaagttagggacaaaaagacttgctgctgtttttgaaatgttattgtttctgtatactctctctttctattccatggtttctttaagttttgc

SEQ ID NO: 949 - DNA, 666 bp, Brassica juncea
ggcttatcttctgcatttaccgacgcgtcatctcctctccagctccggccaaccgtacagtttaagtaaaaaaaaagtgtggtgagagatgggtcgtgttcgtaccaaaaccgtgaagaaatcatcacgtcaagtgatagagaagtactactcaaggatgacactcgacttccacacgaataagaagatcttggaggaagttgcgatcatcccgtcgaaaagactacgcaacaagatcgctggattctccacacacttgatgaaacgtatccagaagggaccagtgcgtgggatctcgctcaagctgcaagaggaagagcgtgaacggagaatggactttgtccccgacgagtcggcgattaaaacggatgatgttaaggtggataaggagacgctggagatgcttgcttctttgggaatgtctgatgtttccgggttttctcaagtggaggcacaagccgtggtacagagcaatgcgtttggccgtggtggaagaagattctaaggcagttttttgaatctaacaaatgaagttttgttttatttatcggagtgtttgtggattcattcaacattgtttccttggattcgagattaaatctacgagctctcgctttgtttttttgcaaattttgatctttttaaatatctgcaactacatttaca

SEQ ID NO: 950 - DNA, 615 bp, Brassica rapa
  misc_feature (448)..(448): n is a, c, g, or t
  misc_feature (450)..(450): n is a, c, g, or t
  misc_feature (474)..(474): n is a, c, g, or t
  misc_feature (514)..(514): n is a, c, g, or t
  misc_feature (518)..(518): n is a, c, g, or t
  misc_feature (534)..(534): n is a, c, g, or t
  misc_feature (541)..(541): n is a, c, g, or t
  misc_feature (556)..(556): n is a, c, g, or t
  misc_feature (571)..(571): n is a, c, g, or t
  misc_feature (577)..(577): n is a, c, g, or t
  misc_feature (593)..(594): n is a, c, g, or t
  misc_feature (598)..(598): n is a, c, g, or t
atcttctgcatttaccgacgcgtcatctcctctccagctccggccaaccgtacagtttaagtaaaaaaaaaagtgtggtgagagatgggtcgtgttcgtaccaaaaccgtgaagaaatcatcacgtcaagtgatagagaagtactactcaaggatgacactcgacttccacacgaataagaagatcttggaggaagttgcgatcatcccgtcgaaaagactacgcaacaagatcgctggattctccacacacttgatgaaacgtatccagaagggaccagtgcgtgggatctcgctcaagctgcaagaggaagagcgtgaacggagaatggactttgtccccgacgagtcggcgattaaaacggatgatgttaaggtggataaggagacgctggagatgcttgcttctttgggaatgtctgatgtttccgggttttctcaagtggagncncaagccgtggtacagagcaatgcntttggccgtggtggaagaagattctaaggcatttttgtancagngaattgtttttttatnggagtgnttatggattaattcnacattgtttccttgnttcaanattaaatttacgagtnnctcngtttttgatatatcgaa

SEQ ID NO: 951 - DNA, 513 bp, Brassica napus
ccagctccggccaaccgtacagtttaagtaaaaaaaaaagtgtggtgagagatgggtcgtgttcgtaccaaaaccgtgaagaaatcatcacgtcaagtgatagagaagtactactcaaggatgacactcgacttccacacgaacaagaagatcttggaggaagttgcgatcatcccgtcgaaaagactacgcaacaagatcgctggattctccacacacttgatgaaacgtatccagaagggaccagtgcgtgggatctcgctcaagctgcaagaggaagagcgtgaacggagaatggactttgtccccgacgagtcggcgattaaaacggatgatgttaaggtggataaggagacgctggagatgcttgcttctttgggaatgtctgatgtttccgggttttctcaagtggaggcacaagccgtggtacagagcaatgcgtttggccgtggtggaagaagattctaaaggcatttttttgaatcaacgaatgagttttaattttgttttttg

SEQ ID NO: 952 - DNA, 749 bp, Brassica napus
atcaacgcagagtacgccgggggtccttttgctcatcttctgcatttaccgccgcttcatcttctccccagctccccagctccggccaggccgtacagtttaagtaaaaaaaagtgtggtgaaagatgggtcgtgttcgtaccaaaaccgtgaagaaatcatcacgtcaggtgatagagaagtactactcaaggatgacactagacttccacacgaacaagaagatcttggaggaagtcgcgatcatcccgtcgaaaagactacggaacaagatcgctggattctccacacacttgatgaaacgtatccaaaagggtccagtccgcgggatctcgctcaagctgcaagaggaggagcgcgaacggagaatggactttgtccccgacgagtcggcgattaaaacggatgacgttaaggtggataaagagacgctagagatgcttgcttcattggggatgtctgatgtttccgggttttctcaagtggagacacaagcagccgtggtaccgagcaatacgtttggccgtggtggaagaagattctaaaggcatttttttgaatctaacaaatgagttttgttttgttttttggagtgtttatggattaattcaacgttgtttccatggattcgagattaaaaatttacgagctctcactttgttttaatatatcgaattaaatcatattttgtataactattattattagctcatagccaaactgtaaatacgatgatgagtcaggggcat

SEQ ID NO: 953 - DNA, 871 bp, Raphanus sativus
tttttgccgccgcttcttctttgcaggtaagctctcgttaaccttaagaaactgcgtaatcttcgaggaaccataagcttttgatctgttctatgaaaggtgtagaatgttagtcgtaggaactgctagattcgtcagtggcttagatttagatttagattttgccataacaattcatgtgtgttgaaatattaggacatgacatgcttcaaagtgttcttttgctaagacatgagttttatctttgcaggtaagtagcagataaccgaaaagatgggacgtgtcagaaccaagaccgtgaagaaatcatctcgtcaagtcatcgagaagtactactctcgcatgacactcgacttccacacgaacaagaagatcctcgaagaagtcgcaatcatcccttcgaagcgtcttcgcaacaagatcgctggattctccacccatttgatgaaacgtatccagaagggaccggtccgtggcatctcgctcaagcttcaagaggaagagcgtgagcgccgcatggactttgttcccgatgagtctgccatcaagaccgatgtgatcaaggtcgataaagagactctagagatgcttgcttcccttggaatgtctgacgctcatggcttctctgaagttgaggcacaggcggcaccttctttcagcaggccaccaagaaggttctgaggaggaggttgttgttgttatcagtcgaatcaagagagaaatctttagattggctgtttttgttttgaagttagggacgaaagacttactgttcttgaaatgtttattgtttcttttgattcgagatttatgtcctaaactgaaagttatacactttttctattccatggttttaagttcttgatgacca

SEQ ID NO: 954 - DNA, 700 bp, Raphanus sativus
  misc_feature (646)..(646): n is a, c, g, or t
tctttgcaggtaagtagcatataaccgaaaagatgggacgtgtccgaaccaagaccgtgaagaaatcatctcgtcaagtcatcgagaagtactactctcgcatgacactcgacttccacaccaacaagaagatcctcgaagaagtcgcaatcatcccttcgaagcgtctccgcaacaagatcgctggattctccacccatttgatgaaacgtatccagaagggaccggtccgtggcatctcgctcaagcttcaagaggaagagcgcgagcgccgcatggactttgtgcccgatgagtctgccatcaagactgatgtgatcaaggtcgataaagagactctggagatgcttgcttcccttggaatgtctgacgctcatggcttctctgaagtcgaggcacaggccgcaccttctttcagcaggccaccaagaaggttctgaggaggaggttgttgttgttgttgttatcagtctaacccaaagagaaatctttagattggctgtttttgttttgaagttagggacgaaagacttggattcgagattgctgttcttgaaatgtttattgcttgttttgattctagatttatgtcctaaactaaaagtcatacactttttctattccatggttttaagtttttgatgancattcgtgaatcgtgatgaaacaacaatacgagggagaaattataattttattt

SEQ ID NO: 955 - DNA, 1006 bp, Brassica napus
aaagcctttaaaccaaataactggcgctaactctggccctcgaagccgtccggtttaagactggtgctctcttcttgatggaaacacattgacgcactttggtcagaacatcccaattcaaccttgttctcgctgtagttgctgaggttgttctccttggtggagctgagtactaccgaatcaccaacggacttggacttcgaagacaagcttcacccagagccatgacctttggacttgctaaagaccctgaacaaggagctcttctcaggttaaagagatcacaacgggagattggccacgttttccatgttcgctttcttcatccaagcttatgttaccggagaagggcctgttgagaaccgcaagcagagaggcgaaaagatgggacgcgtgcgcacgaagacggtgaagaagtcctctcgccaggtgatcgagaagtactactctcgcatgacgctcgatttccacacgaacaagaagatcctcgaggaagtcgcgatcattccttcgaagcgcctccgcaacaagatcgccggattctccactcatctgatgaagaggatccagaagggacccgtccgcgggatctccctcaagctccaggaggaggagcgcgagcgccgcatggacttcgtccccgacgagtccgccattaaaaccgatcgcatcgaggtcgataaggagacgctggacatgcttgcctccttggggatgggagatttgccaggtgtcgtcaaggtggagccggtctcggctgcccctatcgcaggctttggccgtggaaggaggttctagaagaatcgatcctttaagtatcttttcgtatgtgtttgtttgctgaacgttgaatgttcttataagctttaatgttaacagttggtgaatgcttcgttagagaacttaggttggtagatcatctattattcgttgaactatatataatcaatctgcacacacacactcagacattgtggatgcattatggttggagtgtgtgagcact

SEQ ID NO: 956 - DNA, 797 bp, Citrus clementina
agtttcgctagcactcgtcttcgctttagctgccgcaatctcttgacatctcaagctcttctgcttcaccgtctttgtcttcttcaagacagcagcagcagcttcttaaactgaaatgggtcgtgttcgtaccaagaccgtgaagaagtcctctcgccaggtgattgagaggtactactcaagaatgacactggacttccataccaacaagaagattttggaggaggttgctatcatcccctcgaagaggctgcgtaacaaaattgctgggttctcaacccatttgatgaagaggattcagaagggtccagttcgtggaatctcccttaaattgcaggaagaggagcgcgaacgccgcatggactttgtgcctgatgagtcagctattaagactgatgaaattaaggttgacaaggaaaccttggatatgcttgctgctcttggcatgtctgacatttctgggcttgttgaagttgagccacagagcatgattgctcctccagtttttggtcggggtggtggcaggaggtactgagttaattgaggctttgtggctcaatcaagaatgagaagtttaggttcttattaatcagtacttcttgtgtttgttatgaatgcttttgtgactagttttctttactattttaagaagggtgtttagttaaaacttgaactctggcatcatactttagttgatttaatggacttgttttgtcttttcattttatttgttttactgggatgcaacttactgaagttataatgcatattagttttgcagttgctctttagattgt

SEQ ID NO: 957 - DNA, 706 bp, Brassica rapa
  misc_feature (580)..(580): n is a, c, g, or t
  misc_feature (582)..(582): n is a, c, g, or t
  misc_feature (633)..(633): n is a, c, g, or t
  misc_feature (692)..(692): n is a, c, g, or t
gaaaagatgggacgcgtccgcacgaagacggtgaagaagtcctctcgccaggtgatcgagaagtactactctcgcatgacgctcgatttccacacgaacaagaagatcctcgaggaagtcgcgatcattccttcgaagcgcctccgcaacaagatcgccggattctccactcatctgatgaagaggatccagaagggacccgtccgcgggatctccctcaagctccaggaggaggagcgcgagcgccgcatggactttgttcccgacgagtccgccattaaaaccgatcgcatcgaggtcgataaggagacgctggacatgcttgcctccttggggatgggagacatgccaggtgtcgtcaaggtggagccggtctcggctgctcctatcgcaggctttggccgtggaaggaggttctagaagaatcgatcctttaagtatcttttcgtatgtgtttgttttgctgaacgttgaatgttcttataagctttaatgttaacagttggtgaatgcttcgttagagaacttaggttggtagatcatctattattttgaactataaaaaatcaatctgcacacncncactcagacattgtggatgcattatggttggagtgtgtgagctctagcttntgaaatcctcataaggcatctctttgttagaaccatcatcgagttttgtttgagaaagnatcggtattgaaga

SEQ ID NO: 958 - DNA, 572 bp, Brassica napus
ggatccatcagaataaaaccttaaccctactctccgccgtcatcagaacctcaagcagagaggcaaaagatgggacgcgtccgcacgaagacggtgaagaagtcctctcgccaggtgatcgagaagtactactctcgcatgacgctcgatttccacacgaacaagaagatcctcgaggaagtcgcgatcatcccttcgaagcgcctccgcaacaagatcgccggattctccacgcatctcatgaagaggatccagaagggacccgtccgcgggatctccctcaagctccaggaggaggagcgcgagcgccgcatggactttgttcccgacgagtccgccattaaaaccgatcgcatcgaggtcgataaggagacgctggacatgcttgcctccttggggatgggagatttgccaggtgtcgtcaaggtggagccggtctcggctgctcctatcgcaggctttggccgtggaaggaggttctagaagaatcgatcctttaagtatcttttcgtatgtgtttgttttactgaacgttgaatgttcttataacctttaatgttataagtttcata

SEQ ID NO: 959 - DNA, 659 bp, Brassica napus
aagcagagaggcaaaagatgggacgcgtccgcacgaagacggtgaagaagtcctctcgccaggtgatcgagaagtactactctcgcatgacgctcgatttccacacgaacaagaagatcctcgaggaagtcgcgatcatcccttcgaagcgcctccgcaacaagatcgccggattctccacgcatctcatgaagaggatccagaagggacccgtccgcgggatctccctcaagctccaggaggaggagcgcgagcgccgcatggactttgttcccgacgagtccgccattaaaaccgatcgcatcgaggtcgataaggagacgctggacatgcttgcctccttggggatgggagatttgccaggtgtcgtcaaggtggagccggtctcggctgctcctatcgcaggctttggccgtggaaggaggttctagaagaatcgatcctttaagtatcttttcgtatgtgtttgttttactgaacgttgaatgttcttataacctttaatgttataagtttcataacagttggtgaatgcttcgttagagaacttaggttggtagatcattgtggatgcattatggttggagtgtgtgagcactagcttctgaaatcctcataaggcatctctttgttagaaccatcatcgagttttgtttgag

SEQ ID NO: 960 - DNA, 798 bp, Citrus sinensis
cggacgcgtgagcactcgtcttcgctttagctgccgcaatctctcgacatctcaagctcttctgcttcaccgtctttgtcttcttcaagacagcagcagcagcttcttaaactgaaatgggtcgtgttcgtaccaagaccgtgaagaagtcctctcgccaggtgattgagaggtactactcaagaatgacactggacttccataccaacaagaagattttggaggaggttgctatcatcccctcgaagaggctgcgtaacaaaattgctgggttctcaacccatttgatgaagaggattcagaagggtccagttcgtggaatctcccttaaattgcaggaagaggagcgcgaacgccgcatggactttgtgcctgatgagtcagctattaagactgatgaaattaaggttgacaaggaaaccttggatatgcttgctgctcttggcatgtccgacatttctgggcttgttgaagttgagccacagagcatgattgctcctccagtttttggtcggggtggtggcaggaggtactgagttaattgaggctttgtggctcaatcaagaatgagaagtttaggttcttattaatcagtacttcttgtgtttgttatgaatgcttttgtgactagttttctttactattttaagaagggtgtttagttaaaacttgaactctggcatcatactttagttgatttaatggacttgttttgtcttttcattttatttgttttactgggatgcaacttactgaagttataatgcatattagttttgcagttgctctttaaaaaaa

SEQ ID NO: 961 - DNA, 843 bp, Eucalyptus grandis
atacttataaacgcaatctacttgccaaacctcattccttgttgcagtcgccgagtgcccattccatctccagctccatctttggtctgctcctcctctcagcaggtaaaggtaagccatcatgggtcgtgtccgcaccaagaccgtgaagaagtcctctcgccaggttatcgagaggtactactctcgcatgactctggacttccacacgaacaagaagatcctggaggaagttgccatcatcccatcaaagaggctccgaaacaagatcgccgggttctccacccacttgatgaagcgcattcagaagggacccgtccgtgggatctcattgaagctgcaggaggaggagcgcgagcgccgcatggactttgtgcccgaagagtcggccatcaagaccaacgagatcaaggttgacaaggagacccttgacatgcttgcttctcttggcatgtccgacattcctgggctcgttgaggtcgagccgcaggttatgatgcctccccaggcttttggccgcggtggaccaaggaggtactgatttaggccatgcaattgctgtgagaagaatggagacgtttttgtggttgtctgatttttctttcgatagtgggttagtatttgttaaggactatgttgaattaaactagtcagctgggtgtgttcaacgtcgactttgaagcatgatattttgaattttgagctgcaatacaatttcctttcgcgttcaccaagcccatatgttattgtgactctctgcatgctgaagattttggtgttctgttttgtggaaatatgtaaacttctcttgaagttttgctagagcaagcgtatttgctcttc

SEQ ID NO: 962 - DNA, 742 bp, Eucalyptus grandis
cggccggggattccttgttgcagtcgccgagtgcccattccatctccagctccatcttcggtctgctcctcctctctgcaggtaaaggtaagccatcatgggtcgtgtccgcaccaagaccgtgaagaagtcctctcgccaggttatcgagaggtactactctcgcatgactctggacttccacacgaacaagaagatcctggaggaagttgccatcatcccatcaaagaggctccgaaacaagatcgccgggttctccacccacttgatgaagcgcattcagaagggacccgtccgtgggatctcattgaagctgcaggaggaggagcgtgagcgccgcatggactttgtgcccgaagagtcggccatcaagaccaacgagatcaaggttgacaaggagacccttgacatgcttgcttctcttggcatgtccgacattcctgggctcgttgaggtcgagccgcaggttatgatgcctccccaggcttttggccgcggtggaccaaggaggtactgatttaggccatgcaattgctgtgagaagaatggagacgtttttgtggttgtctgatttttctttcgatagtgggttagtatttgttaaggactatgttgaattaaactagtcagctgggtgtgttcaacgtcgactttgaagcatgatattttgaattttgagctgcaatacaatttcctttcgcgttcaccaagcccatatgttattgtgactctctgcatgcag

SEQ ID NO: 963 - DNA, 651 bp, Raphanus sativus
gtctttgctccttcatttgtttaccgccgcatcatcttcctcgcaggtaagtaagctaagtcacaggtaaactgaaaagatggggcgtgtccgaaccaagacggtgaagaaatcatctcgtcaggtgatcgagaaatactactctcgcatgacactcgacttccacaccaacaagaagatcctcgaagaagtcgcaatcatcccttcgaagcgtctccgcaacaagatcgccggattctccacccatctcatgaagaggatccagaagggaccagtgcgtggcatctcactcaagctccaagaggaagagcgtgagcgccgcatggactttgtccccgacgagtctgctatcaggaccgatttgatcaaggtcgacaaagagactctcgagatgcttgcttcccttggaatgggtgacactcctggcgtctctattgtcgagacacaggctccggcacctacttttaacaggccacccagaaggttctgaggatagtgtgtttggctgttgtttttttttcttcactgttagggacaaaagagttgcatttcgagtgtttatgtcttttgattctagtcttgtgtctgaaactgaaagttaagactctttttctgttccatgctttttgagttttgatgatctttgagtaa

SEQ ID NO: 964 - DNA, 721 bp, Raphanus sativus
  misc_feature (4)..(4): n is a, c, g, or t
  misc_feature (508)..(508): n is a, c, g, or t
ggcngtctttgctccttcatttgtttaccgccgcatcatcttcctcgcaggtaagtaagcaagtcacaggtaaactgaaaagatggggcgtgtccgaaccaagacggtgaagaaatcatctcgtcaggtgatcgagaaatactactctcgcatgacactggacttccacaccaacaagaagatcctcgaagaagtggcaatcatcccttcgaagcgtctccgcaacaagatcgccggattctccacccatctcatgaagaggatccagaagggaccggtgcgtggcatctcactcaagctccaagaggaagagcgtgagcgccgcatggactttgtccccgacgagtctgctatcaggaccgatgtgatcaaggtcgacaaagagactctcgagatgcttgcttcccttggaatgggtgacactcctggcgtctctatagtcgagacacaggctccggcacctacttttaacaggccacccagaaggttctgaggagagtttgtttgnctgttgtttttatttcttcactgttagggacaaaagagttgcatttcgagtgtttatgtcttttgattctagacttatgtctgaaactgaaagttaagactctttttctattccatgcttttttgagttttgatgatctttgagtaagtcttggtaataacagttgtctatgtgattgccactggagtttatactttcataaattcaaaatca

SEQ ID NO: 965 - DNA, 642 bp, Raphanus sativus
gtctttgatccttcatttgtttaccgccgcatcatcttcctcgcaggtaagtaagcaagtcacaggtaaactgaaaagatggggcgtgtccgaaccaagacggtgaagaaatcatctcgtcaggtgatcgagaaatactactctcgcatgacactggacttccacaccaacaagaagatcctcgaagaagtggcaatcatcccttcgaagcgtctccgcaacaagatcgccgggttctccacccatctcatgaagaggatccagaagggaccggtgcgtggcatctcactcaagctccaagaggaggagcgtgagcgccgcatggactttgtccccgacgagtctgctatcaggaccgatgtgatcaaggtcgacaaagagactctcgagatgcttgcctcccttggaatgggtgacactcccggcgtctctatagtcgagacacaggctccggcaactacttttaacaggccacccagaaggttctgaggagtgtgtgtttggctgttgtttttttttcttcattgttagggacaaaagagttgcatttcgagtgtttatgtcttttgattctagacttatgtctgaaactgaatgttaagactctttttctattccatgcttttttgagttttgatgatc

SEQ ID NO: 966 - DNA, 782 bp, Cucurbita pepo
cggcaccacaacttcgctctctctctggtactcttcagaaccctttcgtcctctccttccaggtaaagttcggtagaagatgggtcgtgttcgtaccaagactgtgaagaaatcttcacgccaggtgattgagagatactactctaaaatgacactggatttccacactaacaagaagatcttggaagaggttgcgatcatcccatcgaagaggctccgaaacaagattgctggtttctcaacccacttgatgaagagaattcagaagggtccagtcaggggcatctcattgaagctgcaagaagaagagcgtgaacgtcgtatggatttcgttccagacgaatcagctattaagattgatgaaattaaggttgacaaggagacacttgatatgcttgctgcttttggcatgtcagacattcctggactcgttgaggtcgagccacaggctatggctccactccaagctttcggtaggggtgcaggtggcccgaggagatactaaggtaatcgaggttacgccactgcttttgggaattagaagtttttttttattgaatatcttaaggccatggacattcttgttgctagttctcttcagatttgtccttaaatttggtacttgtctttttagttttgactttgagtggatgttcaaatcattctggacatggatgatgatacttttgtttaagtattgaatatttctgaagttaacattttgctattagtcattcttcacagctgcaatttcactcttatgcactttgatagtttgtacc

SEQ ID NO: 967 - DNA, 910 bp, Cucumis sativus
cacacctcacctcacctcaccgtactcttccaaaccctttccttcctttcttcaggtaaagtttggtagaagatgggtcgtgttagaaccaagactgtgaagaagtcttcacgccaggtgattgagaagtactactcgaaaatgacactggattttcacacgaacaagaagatcttggaagaggttgcaatcatcccctccaaaaggctgcgaaacaagattgctggattctcaacccacttgatgaagagaattcagaagggtccagtcaggggcatctcattgaagcttcaagaagaagagcgtgaacgccgtatggactttgtcccagatgaatcagccattaagattgacgaaattaaggttgataaggagacacttgatatgcttgctgctttcggcatgtcggacattcctggacttgtggaggttgagccacaagctatgattcctccccaagcttttggaaggggtgcaggtggcccaaggagatactaaggtaaggtaattgagactactcaacagcttttgggaattagaagttttttgttatttaatatcataaggccatggatattattgttgctagttactatcagattggtccttaaatgtttgacttgtctttttagttttgattttgaatggatgtttaaatcattttggacatggatgatgatacttttgttttaagttttgaagatctctgaagtaaacgtttttggtattagtcagatttcacaattgccattccttcttttagttcagcttcttctaatttggctctgtttcaaggcttttctcttgataaaccatgttgggtgcattataatctttagttataagatttcaattcctatcccccatatgcgaagtcactacaatgatgatatgggttgtgatttttgga

SEQ ID NO: 968 - DNA, 729 bp, Momordica charantia
tattaggtttttctctcaagtcgcagcggcagcaaactcgcgctctctggtacttcacaaccctctcgtcttcccttcaggtaagtttcggtagaaaatgggtcgtgttcgcacgaagactgtgaagaaatcttcacgccaggtgattgagaggtactactctcgaatgactctggatttccacacaaacaagaagatcttggaagaggttgccatcatcccctcaaagaggctgcggaacaagattgctggtttctcaacccacttgatgaagagaattcagaagggtccagtcaggggcatctcattgaagctgcaagaagaagagcgtgagcgtcgtatggacttcgtgccagatgaatcagctattaagattgacgaaattaaggttgacaaggagacacttgatatgcttgctgcttttggcatgtcagacattcctggacttgttgaggttgagccacaggctatgattccaccccaagctttcggcaggggtgcagttggcccaaggagatactaaggtagtcgagactacgcatcgtatggccatggttgttggtagttattttcagtttattaattaaatgtggtacttttcttgttagtttcaattttgaatggatgtttaaatcattttggacatggatagttatacctttgttccaagtgttggagatctctgaagttgaatggttttgctattagtcaaatttcataacttcgaat

SEQ ID NO: 969 - DNA, 539 bp, Brassica napus
atggacgcgtgcgcacgaagacggtgaagaagtcctcacgccaggttatcgagaagtactactcgcgcatgacgctcgatttccacacgaacaagaagatcctcgaggaagtcgcgatcatcccttcgaagcggctccgcaacaagatcgccggattctccacgcatctgatgaagaggatccagaaggggcccgtccgcgggatctccctcaagctccaggaggaggagcgcgagcgccgcatggacttcgtccccgacgagtccgccattaaaaccgatcgcatcgaggtcgataaggagacgctggacatgcttgcctcgttggggatgggagacatgccaggtgtcgtcaaggtggagccggtctcggctgctcctatcgcaggctttggccgtggaaggaggttctagaagaatcgatcctttttaagtatcatttcatatgtgtttgtttttgctgaactttgaatgttcgataaggttttaaatgtttaatgttactttgataagtttcataacagttagtgaatgcttcgt

SEQ ID NO: 970 - DNA, 797 bp, Citrus sinensis
agtttcgctagcactcgtcttcgctttagctgccgcaatctctcgacatctcaagctcttctgcttcaccgtctttgtcttcttcaagacagcagcagcagcttcttaaactgaaatgggtcgtgttcgtaccaagaccgtgaagaagtcctctcgccaggtgattgagaggtactactcaagaatgacactggacttccataccaacaagaaaattttggaggaggttgctatcatcccctcgaagaggctgcgtaacaaaattgctgggttctcaacccatttgatgaagaggattcagaagggtccagttcgtggaatctcccttaaattgcaggaagaggagcgcgaacgccgcatggactttgtgcctgatgagtcagctattaagactgatgaaattaaggttgacaaggaaaccttggatatgcttgctgctcttggcatgtccgacatttctgggcttgttgaagttgagccacagagcatgattactcctccagtttttggtcggggtggtggcaggaggtactgagttaattgaggctttgtggctcaatcaagaatgagaagtttaggttcttattaatcagtacttcttgtgtttgttatgaatgcttttgtgactagttttctttactattttaagaagggtgtttagttaaaacttgaactctggcatcatactttagttgatttaatggacttgttttgtcttttcattttatttgttttactgggatgcaacttactgaagttataatgcatattagttttgcagttgctcgttagattgt

SEQ ID NO: 971 - DNA, 550 bp, Brassica oleracea
  misc_feature (40)..(40): n is a, c, g, or t
  misc_feature (61)..(61): n is a, c, g, or t
  misc_feature (67)..(67): n is a, c, g, or t
  misc_feature (76)..(76): n is a, c, g, or t
  misc_feature (193)..(193): n is a, c, g, or t
  misc_feature (199)..(199): n is a, c, g, or t
  misc_feature (204)..(204): n is a, c, g, or t
  misc_feature (220)..(220): n is a, c, g, or t
gaaccctaaaaatccacagaggcgaaagatgggacgcgtncgcacgaagacggtgaagaantcctcncgccaggtnatcgagaagtactactcgcgcatgacgctcgatttccacacgaacaagaagatcctcgaggaagtcgcgatcatcccttcgaagcggctccgcaacaagatcgccggattctccacncatctnatgangaggatccagaagggncccgtccgcgggatctccctcaagctccaggaggaggagcgcgagcgccgcatggacttcgtccccgacgagtccgccattaaaaccgatcgcatcgaggtcgataaggagacgctggacatgcttgcctcgttggggatgggagacatgccaggtgtcgtcaaggtggagccagtctcggctgctcctatcgcaggctttggccgtggaaggaggttctagaagaatcgatcctttttaagtatcatttcgtatgtgtttgtttgtgctgaactttgaatgttcgataaggttttaaatgtttaatgttacttttataagtttcaaaaa

SEQ ID NO: 972 - DNA, 877 bp, Citrullus lanatus
gttttttttttctcaggtaaagtttggtagaagatgggtcgtgttagaaccaagactgtgaagaagtcttcacgccaggtgattgagaggtactactcaaaaatgacattggatttccacacgaacaagaagatcttggaagaggttgccatcatcccctcaaaaaggctgcgaaacaagattgctggtttctcaacccacttgatgaagagaattcagaagggtccagtcaggggcatctcattgaagctgcaagaagaagagcgtgaacgccgtatggactttgtcccagatgaatcagccatcaagattgacgaaattaaggtcgacaaagagacacttgatatgcttgctgcttttggtatgtcagatattcctggacttgtggaggtcgagccacaggctatgattccgccccaagcctttggaaggggtgcaggtggcccaaggagatactaaggtaattgagactactcgacaacttttgggaattagaagttttttgttattcaatattgcaaggccatggatattcttgttgcttgttattatcagattggtccttaaatgtggtacttgtctttttagttttgattttgaatggatgtttaaatcattttggacatggatgccggatggtgatacttttgttttaagtattggagatttctgaagtaaacgtttttgctattagtcagatttcacaactgccattccctttttgaagttcagttttctaatttgctctgttccaaggcatttcttttgattatgtggggtgctttatagtctctagttgtaagatttcaaaccaaacccccctttgatttatcatatgattgtgcaaagttaccacaatgatgtgtgttttgatttt

SEQ ID NO: 973 - DNA, 974 bp, Cucumis melo
aatagcagcggcagcttcaccacaccacaccgtactcttccaaaccctttcgtttctcttttcaggtaaagtttggtagaagatgggtcgtgttagaaccaagactgtgaagaagtcttcacgccaggtgattgagaggtactactcgaaaatgacactggatttccacacgaacaagaagatcttggaagaggttgccatcatcccctctaaaaggctgcgaaacaagattgctggattctcaacccacttgatgaagagaattcagaagggtccagtcaggggcatctcattgaagcttcaagaagaagagagggaacgtcgtatggactttgtcccagatgaatcagccattaagatcgacgaaattaaggttgataaggagacacttgatatgcttgctgcttttggcatgtcggacattcctggacttgtggaggttgagccacaagctatgattcctccccaagcttttggcaggggtgcaggtggcccaaggagatactaagataaggtaattgagactactcagcagctttttgggaattagaagttttttgttattcaatatcataaggccatggatattattgttgctagttactatcagattggtccttaaatgtttgacttttctttttagttttgattttgaatggatgtttaaatcattttggacatggatgatgatacttttgttttaagttttggagatctctgaagtaaacgtttttttgctatttagtcagatttcactattgccattccttctcttagttcagctttttctaatttgtgctctgtttcaaggcatttctcttgataaatcatctggggtgccttgtaatcttagttataagatttcatttttatccccctttgattaacaacccacatcatagtagtgactttggattagatttggtgttaccttgttcttacctcaataagagatgttccaatgtacactttca

SEQ ID NO: 974 - DNA, 557 bp, Eutrema halophilum
ctgaagtagagagacccgggaagttttgggaaccctaaaacacaagcaaagatgggtcgcgttcgcacgaagacggtgaagaaatcgtctcgtcaggtgatagagaagtactactcgcgcatgacgcttgatttccacaccaacaagaagattctggaagaggtcgcaatcatcccttccaagaggctgcgcaacaagatcgccggattctccacccatctcatgaagaggatccagaagggacctgtccgtggaatctccctgaagctccaggaggaagagcgtgagcgccgcatggacttcgtccccgacgaatccgccattagaaccgaccacatcgccgtcgacaaggagacgctcgacatgcttgcctccttgggaatgtcggatatgccaggtgtcgtcaaggtcgatcccgtctccgccgctcctgttgctgcctttggatttggccgtggaaggaagttctagattatcgatcctcgtcactcagatatgtgggttttttgctaaatcgttgtaagctaaacttcaatgctctataagctttaatgtca

SEQ ID NO: 975 - DNA, 633 bp, Raphanus sativus
gctccttcatttgcttgccgccgcatcatctccctcgcaggtaagtaagcaagtcacaggtaaaccgaaaagatggggcgtgtcagaaccaagacggtgaagaaatcatctcgccaggtgatcgagaaatactactctcgcatgacactcgacttccacaccaacaagaagatcctcgaagaagtcgcaatcatcccttcgaagcgtctccgcaacaggatcgccgggttctccacccatctcatgaagaggatccagaagggaccagtgcgcggcatctcactcaagctccaataggaggagcgtgagcgccgcatggactttgtccccgacgagtctgctatcaggaccgatgtgatcaaggtcgacaaagagactctcgagatgcttgcctcccttggaatgggtgacactcccggcgtctctatagtcgagacacaggctccggcacctacttttaacaggccacccagaaggttctgaggagagtttgtttggctgttgtttttttttttcttcactgttagggggacaaaagagttacatttcgagtgtttatgtcttttgattctagacttatgtccgaaactgaaagttaagactctttttctattccatgcttttttgagtttt

SEQ ID NO: 976 - DNA, 630 bp, Raphanus sativus
ggagaagcactagtagagaagaagctcgtcgtaaccctaaaatctagcggcgaggatgggacgcgtccgcacgaagacggtgaagaaatcctcccgccaagtgatcgagaagtactactcgcgcatgacgctcgacttccacacgaacaagaagatcctcgaggaggtcgcgatcatcccttcgaagcgtctccgcaacaagatcgcgggattctccacgcatctcttgaagaggatccagaaggggcccgtccgcgggatctcactcaagctccaggaggaggagcgcgagcgacgcatggacttcgtccccgacgaatccgccatcaaaaccgatcgcatcgaggtggataaggagacgctggacatgctcgcctccttggggatggcggatatgccaggtgtcgtcaaggtggatccggtctcggctgctcctgttgctgcatttggccgtggaaggaggttctagaagaatcgatcctttttaagtatcatttcgtatgtgtttgttttgctgaagtttgaatgctctataaagctttaatgttataactttaataacagttggtgaatgcttcgttagagaacacatatggaacttaggttggtagatcatccctgattcgttga

SEQ ID NO: 977 - DNA, 482 bp, Brassica juncea
cgcggggcttctacatcatttttgccgccgccttcatcttcctcgcaggtaagtcgacagttaaactataactgaaagatggggcgtgtccgaaccaagacggtgaagaaatcatcacgtcaagtgatagagaagtactactctcgcatgacacttgacttccacactaacaagaagatcctcgaagaagtagccatcatcccttcgaagagactccgcaacaagattgctggattctcaacccatttgatgaaacgtatccagaagggacctgtgtcgtggtatctcgttcaagcttcaagaggaagagcgtgagcgccacatggactttgtgcccgacgagtctgccatcaagaccgatgtgatcaaggtcgacaaagagactcttgagatgcttgcttcccttggcatggccgacactcccggcgtctctgaagtcgagactcaggctgcacctacttttaacaggccacccagaaggt

SEQ ID NO: 978 - DNA, 815 bp, Tropaeolum majus
cggccccggggggaataaaccctaatagaatttcctcttcgcttctccaattgcgtttgtctttcggctgttccttttgctctccaagctacttatttcataatgggtcgagttcgcaccaaaaccgtgaagaagtcatcacgccaggtgattgagaagtactactctaaaatgacattggacttccacaccaacaagaagatattggaagaagttgccatcattccttcaaagaggctccgtaataagattgctgggttctcaacccatttgatgaagcgtatccagaagggtcctgttcgtggcatttcactgaaacttcaggaagaagaacgtgagcgtagaatggactttgtgccagacgagtcagctattagaaccgatgaaattaaggttgacaaggaaaccctcgacatgcttgctgctcttggtatgtctgatctcccaggcctttcagaagttgatcttcaagcctcaatccctgctcccatcttcggtagggcaggtgctggtggacctaggaggtactaatgtgctttacaagcatattttgggatacttattcgtgcattttcttgctgctatttacttttagtttatgtgttaagacataccacaactggtcttgttacatttttgagcttaagataaggattagttgaagttttgtcctttgaatcttttcttgtgtgttagttaatatgttttgctttgatgtttgtatgatatacattgtatgtgtctttatccttatgtaaactcaaaccagatatcatttttttgctccatactcactgcttgttgtatgtttgaat

SEQ ID NO: 979 - DNA, 735 bp, Tropaeolum majus
tctccgtactcagcggccggggatatacctttttattggctcaattactcattctatctcttctctgtttcagccgcaagctctcattctcagggtgcatctgctcagcaatctgaatctccccaaggatcagagtattattccagaatgggtcgagttcgcaccaagacagtgaagaagtcttctcgccaggtgattgagaagtactactccaagatgacattagacttccacaccaacaagaaaatcttggaagaggttgccatcatcccatcaaagagactccgcaacaagattgctggattctccactcatttgatgaagaggattcaaaagggtcccgtccgtggcatctcattgaaacttcaagaagaggagcgtgaacgcagaatggactttgtaccagatgagtctgcaataaggaccgatgagattaaggttgacaaggaaacccttgagatgcttgctgctcttggtatgtctgatattcccgggctttctgaagtcgaccctttggcttcaatgcccgccactggttattctaggcccggtcctggtcccaggaggtactaacccatgtgagtcttagcagccaactctcttaggagttgtaatttagttgcttgttttacaatttattgttgttttagactcttatcatgaatggttttgttagattttgatctaaattttgaacttaagaatggtacttcatttattttcaaagaatggaat

SEQ ID NO: 980 - DNA, 622 bp, Tropaeolum majus
cggccggggtaaataaaccctaatagaatttcctcttcgcttctccaagtacctccgtctttcggctgttcttgctggtttctaagctacttatttcaaaatgggtagagttcgcaccaaaaccgtgaagaagtcatcacgtcaggtgattgagaagtactactcaaaaatgaccttggacttccacactaacaagaagatattggaagaggttgccattattccttcaaagaggcttcgtaataagattgctgggttctcaacccatttgatgaagcgtatccagaagggtcctgttcgtggcatttcactgaaacttcaggaagaagaacgtgagcgcagaatggactttgtgccagacgagtcagctattagaactgatgaaatcaaggttgataaggaaacccttgacatgcttgctgcacttggcatgtctgatctcccaggcctttccgaagtcgatcttcaagcctcaaaccctgctcccatcttcggtagggcaggtgctggtggacctaggaggtactgatgtgctttacaagcatatttcggaatacctattcttagtacctatttacttgtttcagacgatgttatatatgttttgttgcccttggattta

SEQ ID NO: 981 - DNA, 767 bp, Tropaeolum majus
ttacggccgggggtaataaaccctaatagaatttcctcttcgcttctccaattgcgtttgtctttgggctgttccttttgctctccaagctacttatttcataatgggtcgagttcgcacaaaaaccgtgaagaagtcatcacgccaggtgattgagaagtactactctaaaatgacattggacttccacaccaacaagaagatattggaagaagttgccatcattccttcaaagaggctccgtaataagattgctgggttctcaacccatttgatgaagcgtatccagaagggtcctgttcgtggcatttcactgaaacttcaggaagaagaacgtgagcgtagaatggattttgtgccagacgagtcagctattagaaccgatgaaattaaggttgataaggaaaccctcgacatgcttgctgcacttggtatgtctgatctcccaggcctttccgaagttgatcttcaagcctcaatccctgctcctatcttcggtagggcaggtgctggtggacctaggcggtactaatgtgctttacaagcatattttgggatacctattcgtgcattttcttgctgctatttacttttagtttatgtgttaagacataccacaactggtcttgttacatttttgagcttaagataaggattagttgaagttttgtcctttgaatcttttcttgtgtgttagttaatatgtttttgctttgatgtttgtatgatatacattgtatgtgtctttatccttatgttaactcaaa

SEQ ID NO: 982 - DNA, 892 bp, Eucalyptus grandis
gtcgccgtcgccgtcgccgggtactgctcttccgctgttccaccgtcgtcttcgctcttcatctcctcccgacagcctgagcataatctagcaatatcgtgagccgccgccatgggccgcgtccgcaccaagaccgtgaagaagtcctcccgccaggtgatcgagcggtactactcccgcatgaccctggacttccacacgaacaagaaggtcctggaggaagtcgccatcatcccctccaagaggctccggaacaagatcgccgggttctccacccacctgatgaagcgcatccagaagggccccgtccgcgggatctcgctgaagctgcaggaggaggagcgcgagcgccgcatggacttcgtccccgacgtgtcggccatcaagaccgaggagatcaacgtcgacaaggagaccctcgacatgctcgcctccctcggcatgtccgacattccggggctcgtcgaggtccagccgcaggtcatgatgcccgcccaggctttcggccgcggtggacccggaaggaggtactgattgaggccatgccattgctctgaggatggagagctttttcgtggtcatttgatttttgtttcgatagttaggttagtatttcctctttatttctattactatggtgagtttgtatagatgcgggatcctgccatacgaactcatagaattttaggagtctcgatccatgtttacaaatgaaaaggtttagagctcaatggctcactccctggtcaagattttgcaatgccgaaaaccgtggctgaccaaagatcaaatcattactttctaatctgagaatttgctcaatgtcaaaaagggtttgaggatatcttatgctactatttaaattagaagttctggtcgatttttccaccag

SEQ ID NO: 983 - DNA, 404 bp, Brassica juncea
gcgaaaagatgggacgcgtccgcacgaagacggtgaagaagtcctcacgccaggtgatcgagaagtactactcgcgcatgacgctcgatttccacacgaacaagaagatcctcgaggaagtcgcgatcatcccttcgaagcgcctccgcaacaagatcgccggattctccacgcatctcatgaagaggatccagaagggacccgtccgcgggatctccctcaagctccaggaggaagagcgcgagcgccgcatggacttcgtccccgacgaatccgccatcaagaccgatcacatcgaggtcgacaaggagacgctcgacatgctcgcgtcgttgggaatgggcgatatgccgggggttgtcaaggtggatcccgtctccgccgctccggttgctgcatttggc

SEQ ID NO: 984 - DNA, 679 bp, Cucurbita pepo
tcgcggcagcagcagaacttcgctctctttctggtgctcgtcctttttcgtcctccttccaggtaaagttcggtagaagatgggtcgtgttcgcaccaagactgtgaagaaatcttcacgccaggtgattgagaggtattactctaaaatgacactggatttccacacaaacaagaagatcttggaagaggttgccatcatcccctcgaaaaggctacgaaacaagattgctggtttctcaacccacttgatgaagagaattcagaagggtccagtcaggggcatctcattgaagttgcaagaagaagagcgcgaacgccgtatggacttcgtgccagacgaatcagccattaagattaacgaaatcaaggttgacaaggagacacttgatatgcttgctgcttttggcatgtcagacattcctggacttgtggaggttgagccacaggctatgaatctgccccaagctttcggtaggggtgcaggtggcccaaggagatactaaggtaattgagatcacgcaacaggttttgggaattagaagttttttgttattcaatatcataagaccatggacgttcttgttgctagttattttcagattggtccttattttggttcttgtcttttagttttgattttgaatggatgataattttgtttcatgtattggagatct

SEQ ID NO: 985 - DNA, 1078 bp, Populus trichocarpa
ccctatcccttatatatgcacgctcccttctcctcacccccccatcaagcagccgctcctcgctctcacctgtgctctcctcttgaagcagcagcagaagcttatctgtgaagatgggtcgtgttcgtactaagacagtgaagaagtcctcacgccaggttattgagaggtactactctaaaatgacattggatttccacaccaacaagaagattttggaagaggttgctatcatcccctcaaagaggctccgcaacaagattgctgggttctctacccatctaatgaagcgtattcagaagggaccagtccgtggcatctcactgaaacttcaagaggaagagcgcgagcgtcgtatggactttgtgcctgaagagtctgccattaagatccaagagattaaagttgacaaagagaccattgacatgcttgctgcccttggtatgtcagactttcctgggattgttgaagttgaacctcagcctatggttcctacccagggctttggcagaggaggtggtgctaggaggtactagagttaaataacctcatcgcgatgttcaagtgcgagccagaactttaaattttgtgtctgaatgtcttttatttagtgctcactttcagagtttttatttatattatcctcaatggtattggtgcttgatgttttaaactggagaattagttgattttgctgttaaaagactgatattttagttgattcaatcctgtcatctaataccttttttgtcatgtgttcaattacatgaacaacttgaactataaatcatgtgtgatatcataagtcggaaaaaagttgtattgttttttctcccatggattcggcgaaggactgtagcaagcgcaggctgtatggccctagaactcgtatgccgtttttcactgcaagcttgtgttgctgctgtgaaaaataatttttataatataaaatgaaaaatattttaaaaattaactacactataatcacatctttttatgatgtttcagaaggtagcatcatcctgcctggcattaatgtcctcaagcaactcttcttgttagatttatctcaacgtat

SEQ ID NO: 986 - DNA, 660 bp, Linum usitatissimum
aactctccattgcagcaaagaactcgcagccgccggcgaagaagaagaagtgagtagcagccatgggacgcgtccgaaccaagaccgtgaagaagtcctcccgccaggtgatcgagcgctactactcgaaaatgacgctggatttccacaccaacaagaagatcctcgaggaagtggccatcatcccatcgaagcgcctccgcaacaagatcgccggattctccactcacctgatgaagcggatccagaagggccctgtccgcgggatctccctcaagctccaggaggaagagcgcgagcgccgcatggacttcgtccccgaggagtcagcaatcaggaccgacgagatcaaggtcgacaaggagactaaggagatgcttgctgctcttggcatggccgatatcggaggtatagtcgaggtcgatcctattgccgtctctgcccctccgttcgggtttgggagaggcgctggccgtgggaggtactgaatggttgttatagcttagtttgaagggaaatggtattggactgatgtctctgcttattactgctgaatagtattctggttaagtttgctgaatgtttttttgggtttgtttaatgattcatgcctgaattttggaagctgtttacaaagtctaatgcttgaatctaaatgtc

SEQ ID NO: 987 - DNA, 829 bp, Linum usitatissimum
cctcaactctccatcgcagcaaagaactcgcggccgccggcgaagaagaagaagtgagtagcagccatgggacgcgtccgaaccaagaccgtgaagaagtcctcccgccaggtgatcgagcgctactactcgaaaatgacgctggatttccacaccaacaagaagatcctcgaggaagtggccatcatcccgtcgaagcgcctccgcaataagatcgccggattctccactcacctgatgaagcggatccagaagggccccgtccgcgggatctccctcaagctccaggaggaagagcgtgagcgccgcatggacttcgtccccgaggagtcagcaatcaggactgacgagatcaaggtcgacaaggagactaaggagatgcttgctgctcttggcatggccgatatcggaggtatagtcgaggtcgaccctattgccgtctctgcccctccgttcgggtttgggagaggtgctggccgtgggaggtactgaaagggtcattggtgtcatagcttagtttgaagggaaatggttttggactgatgtctctgcttactactgctgaatagtatcttggttaagttgctggatgtttttctagttttgcttaatgattcatgcttgaattttggaagctgtttacgaagtctaatgcttgaatctaaatgtcttatctgtcttttgatttggctcgttgataattaagcctttagcagcctgccagatctttagctttggaatagatgtgaatcgtcggttttgtagtgtggcaaatcaacaatggtgatcctatttgcaggggttgctcccttgtagaaatgggcagctg

SEQ ID NO: 988 - DNA, 475 bp, Brassica napus
aatcatctcgccaagtcatcgagaagtactactctcgcatgacactcgacttccacaccaacaagaagatcctcgaagaagtcgccatcatcccttcgaagcgtctccgcaacaagatcgctggattctccacccacttgatgaagcgtatccagaagggaccggtccgtggcatctctctcaagcttcaagaggaagagcgcgagcgccgcatggactttgtccccgacgagtctgctatcaagaccgatgtgatcaaggtcgacaaggagactctggagatgcttgcctcccttggcatgtctgacactagtggcatctctgaagtcgagccacaggctgcacctactttcagcaggccaccaagaaggttctgaggagtttattgttattattatcagttgaatcaaaagagaaatctttagatttggctgtttttgttttgaagttagggacaaaagacttgctgttcttg

SEQ ID NO: 989 - DNA, 666 bp, Tamarix hispida
  misc_feature (615)..(615): n is a, c, g, or t
gggggtgccgcagccgatttcagtgtccttctacctctagtgcctccttccacccggagcaggtgagttatactttaagctgagatggggcgtgttcgtactaagaccgtgaagaagtcttctcgccaagtcattgagaagtattattctcgtatgacattggacttccacacaaacaagaagatcctggaggaagttgccattattccttccaagcgtcttcgcaacaagattgctgggttctccacccaccttatgaagaggattcagaaggggcctgttcgtggaatctcgctcaaattgcaggaggaagagcgtgaacgccgcatggactttgtccctgctgagtctgcgattaagaccgactcaattggagttgaccaggagacgattgatatgcttgcaactcttggcatgtctgagattcctggggtttacaaagccgagccagatgttgcggctcctttacctgctttcggtcgtggaaggaggttctagggtgtctttgggtgcttttaactatttgtaactttgtcatgctagctccgtatttttctgtttgataactagggttggatgaaatttttgataattaagactttgtagttctcaaanagttctgcgattggtattaccctcttaagtactgttgttttgatgcttcca

SEQ ID NO: 990 - DNA, 871 bp, Humulus lupulus
catccctctctcccactccttcaccttcagtccggcgctcccattctgcacttcattctctcacctcgtttgattttgcaggggttgcttataactctctagaatgggtcgtgttcgtaccaagaccgtgaagaagtcctctcgccaagtgattgagaggtactactctcgcatgaccttggatttccacacaaacaaaaagatcttggaagaggttgccctcatccccacaaagaggctgaggaataagatagccgggttctctactcacttaatgaagaggatccagaagggtccagtcaggggcatctcattgaagctgcaagaagaggagcgtgagaggcgtatggactttgtccccgacgagtcagcaatcaaaactgatgaaatcaaggttgacaaagagaccattgacatgcttgctgcccttggcatgtctgacctccccgggcttactgaagttgagccccaggttgtcattcccacccaaggttttggccgaggcagtggtggtggccctggaaggaggtactgaaagggtatctgagttttttgtttgcatttttaatttgtacctgaagattgtttgtttgcattttggtagttttacttttgatatctgttctagtaatatggtaagtggaacttttttggtttagttgggatgcttgatctgaagacagtagattattgaatcgatcttcctacagatattaaagttttgtcatctaattggcctttgttattatgcacttaaacctgttcgtctaattcttgaattgtgcaatctctgtgaagagtaggaaaaatgattatcatagtcgatgtttgtttaacccaagtgattctgtcattttttttatcaaaccac

SEQ ID NO: 991 - DNA, 766 bp, Humulus lupulus
ttctgcacttcattctctcacctcgtttgattttgcaggggttgcttataactctctagaatgggtcgtgttcgtaccaagaccgtgaagaagtcctctcgccaagtgattgagaggtactactctcgcatgaccttggatttccacacaaacaaaaagatcttggaagaggttgccctcatccccacaaagaggctgaggaataagatagccgggttctctactcacttaatgaagaggatccagaagggtccagtcaggggcatctcattgaagctgcaagaagaggagcgtgagaggcgtatggactttgtccccgacgagtcagcaatcaaaactgatgaaatcaaggttgacaaagagaccattgacatgcttgctgcccttggcatgtctgacctccccgggcttactgaagttgagccccaggttgtcattcccacccaaggttttggccgaggcagtggtggtggccctggaaggaggtactgaaagggtatctgtagtttttgtttgcatttttaatttgtacctgaagattgtttgtttgcattttggtagttttacttttgatatctgttctagtaatatggtaagtggaacttttttggtttagttgggatgcttgatctgaagacagtagattattgaatcgatcttcctacagatattaaagttttgtcatctaattggcctttgttattatgcacttaaacctgttcgtctaattcttgaattgtgctaatctctgtgaagagtaggaaaa

SEQ ID NO: 992 - DNA, 593 bp, Scabiosa columbaria
agcttgcatatctctgccgagtcttccttcgtagctgccattttctctcagagctcttcgctttcaaggttgaaatcaggtaagtggagatagtgaatcatgggtcgagttagaaccaaaacagtgaagaaatcctctcgtcaggttattgagaggtactactcgaagatgactctggacttccacactaacaagaaaatcttggaggaagtggctattattccatccaagcgtcttcgcaacaagattgcagggttctcgacccatctaatgaagcgtatacaaaagggtccggttagaggcatatcattgaagctccaagaagaagaaagagagaggcgcatggactttgtacctgatgaatcggccatcaagaccgataatattgaagttgataaggagacacttgagatgcttgcttctcttgggatgagtgaaatgcctggggttacaaagcaggctgaagatcagggcactgctgctcctccagcagcttatggtcgtggtggtcctgggttcaataggaggtactaagggggtttcctttaagattgttcttagatggatgaatggttactttttgttcttttcaa

SEQ ID NO: 993 - DNA, 830 bp, Malus domestica
caatatatatccaaaaccctagcctcttatatctcttaccctctcctcgcctcacacacacattcaccagccgccgtctcctcccaaccccaccgcgcaaatccgccagcatgggccgcgttcgcacaaagacggtgaagaagtcatctcgccaggttatcgagcgatactactcgcgcatgaccctggacttccacaccaacaagaagatcctggaagaagtcgccatcatcccctccaagcgcctccgcaacaagatcgccggattctctacccacctcatgaagcggatccagaagggcccggttcgcggtatctccctaaagctgcaggaggaggagcgcgagcgccgtatggacttcgtccccgaagagtccgctatcaagacggacgagatctccgtggacaaggaaactctcgacatgctctcctctctcggcatggctgacatgcctggggtcaagcgggtcgacccggaagctcagactcagaatctcggcgggttcgggcgtggcggtcccaggaggtactaatcagggtttagagaatgatgggttttgtttaaaatcccaagttatcgttcccttaattttctggaagatttttaatgttatagtacatttgaagtaggaaggaaactattgctaattttctatgcttttcgggttttctatggaacgaatgcggatgcaatgttttattatgtgattttgtttaagtttggatttagaatcgaaagcgatgcgcattacttcttttggttaattaatcgttttggtgaagattgttggtatgaactgatagtattgcagtagtattcttgctgctta

SEQ ID NO: 994 - DNA, 686 bp, Brassica juncea
ggtgaagaaatcatctcgtcaggtcatagagaagtactactctcgcatgacactcgacttccacaccaacaagaagatcctcgaagaagtcgccatcatcccttcgaagcgtctccgcaacaagatcgctggattctccacccacttgatgaagcgtatccagaagggaccggtccgtggcatctctctcaagcttcaagaggaagagcgcgagcgccgcatggactttgtccccgacgagtctgctatcaagaccgatgtgatcaaggtcgacaaggagacgctggagatgcttgcttcccttgggatgtctgacgctcatggcttctctgaagtcgaggcgcaggcggcaccttcttttgctaggccaccgagaaggttctgaggaggttgtttgttgttgtttatcagtcgaatcaagggaggaatctttagatttggctgttgttgtttcgaagttagggacaaaaagacttgctgctgtttttgaaatgttattgtttctgtatactctctctttctattccatggtttctttaagttttgcatgatcgtttgtcttgtgaaacaacttgatccaggcctttggctttcggtgtcaaattcatttcacccataactttttgaaaccatggaatagaaagagagagtatacagaaacaataacatttcaaaaacagcccgcg

SEQ ID NO: 995 - DNA, 1044 bp, Castanea mollissima
cccgtctttggcagccgcagcctcttttcctcactctctccttctcagaggctccttcggctcttcatctctttccggaacagctaattttctaaaatgggtcgtgttcgcaccaagactgtgaagaagtcttcccgccaggtcatcgagaggtactactcgaaaatgaccctagacttccacactaacaagaagatcttggtggaggttgccatcataccctcaaagaggctccgtaacaagattgctggattctctacccacctgatgaagaggattcaaaagggtccagtgagaggcatctcattgaagctacaagaagaggagcgtgagcgccgtatggactttgtgccagaagagtctgccattaagactgacctgattaaggttgataaggagacccttgacatgcttgcttctcttggcatgtctgatatgcccgggcttgaagaagttgagctacagcctgttgttccagcccaggtgtttggtcggggtgctggtggtgctggtggccctaggagatactgaggtaactcagtggtggttttgataaccaaacattttagctgatattgaaatattgggtacgtttttttgttaatttttatattggtactaatgataaagtaagcagatcttattttacggttgtttgtgaactttgaatgtggtacctgtagtttatttaatggagattctgagtcttgttatgtttcatggatatgtgcaattgtgcttggctttgctatcaattggtatcattttgtgtatgcacatttgagataattaatgtggttcaatttgtgctttttccgaagtgagaggaatatagtatactttttcaccagtgctcatattacatacaattctgagggagtgacaatcatttggcctccctaactggttttctactagtttatatgaacttgtcggtttctatgtatatttatgttgatcctaagcttcttggaacttagaagagctccattattctttcataaaaaaaagaatagctccgttattctattacggacacatctg

SEQ ID NO: 996 - DNA, 901 bp, Cannabis sativa
taagtcttcatatttaacgcatccctctctcccaattcttcaccttcagtccggcgctcccattctgcgatttcatctcttccctcgtttgcttctgcagaggttgcttgtaattctctaaaatgggtcgtgttcgtactaagactgtgaagaagtcctctcgccaggtgatcgagagatactactctcgcatgaccttggattttcacacaaataaaaagatcttggaagaggttgcccttatccccacaaagaggctgaggaataagattgccgggttctccactcacttaatgaagaggatccagaagggtccagtcaggggcatctcactgaagcttcaagaagaggagcgtgagaggcgtatggactttgtccccgacgagtcagctatcaagactgatgaaatcaaggttgacaaagagaccattgatatgcttgccgctcttggtatgtcagaccttcctgggcttactgaagttgagccacaggttgtcattcccacccaaggttttggccgaggtggtggtggcggccctggaaggaaatactgaaatggtatttgagttttttgtttgcatttttaaagtgtacttgaagattgtttgtttgcaattcggtagttttccttttgatatctgctctagtaatatgttaagtggaactttttttttcgtttagtttggatgtttgatttgaagacagtagattattaaatcgatcctcctacagatattaaagttttgtcatttaattaacttttgttattatcaacttaaatcttttcgtctacttcttctagtatgcaatctcgattaatggtgcttctgtcctagtttttgtcataattattttaaactttggtgcaaggacagtggtatttggtttcaatataaatgct

SEQ ID NO: 997 - DNA, 511 bp, Euphorbia peplus
gcgtcttctccctcttcagctgtagtttgttctgctttatcaaagcagcagcagcagcagcttactatcgaagatgggtcgtgttcgcacaaagacagtgaaaaagtcctctcgccaggtcattgagaggtactactccaaaatgaccttggacttccataccaacaagaagatcttggaagaggttgccattatcccctcaaagaggttgcggaataagattgctgggttttccacccatcttatgaagcgtattcaaaagggtccagttcgtggcatttcattgaaactgcaggaggaggaacgtgaacgccgcatggactttgtgcctgaagagtctgccattaagattgatgagattaaggttgataaggagacaattgaaatgcttgctgctcttggcatgtcagatgttccagggcttgttgaagttgaaccacagccattgattgctccacagggctttggtcggggcctagccggtgggtttggaaggaggggttgaagatga

SEQ ID NO: 998 - DNA, 579 bp, Scabiosa columbaria
tacgactctaccattctcagttcgctgccatttttagatctgctcctctcttcttccttgcttttcgtttcgcctgcaagtgggaatcaggtaagtgtactctacaaactgaaacatgggtcgagttcgcaccaaaactgtgaagaaatcctctcgccaggtcatagagcgatactactccaagatgactctagacttccacaccaacaaaaagatcttggaggaagtggctataatcccctccaagcgtctccgcaacaagattgctggattctcaactcatctaatgaagcgtattcagaagggtcccgttagagggatttcactgaaactgcaggaagaagagagggagaggcgaatggactttgtgccagatgagtctgcaattaagactgatgtcattgaagtcgacaaggagacacttgagatgcttgcttctcttggaatgagtgaaattcctggtgttaggaagcagtctgatgagcagaccactgttgcccctgtagcagcatatggccgcggtggacctggattcaacaggaggtactaatgagtctttagctctttttgttatcgtta

SEQ ID NO: 999 - DNA, 762 bp, Cirsium arvense
cggggaaacgagggagagagcagcagagtgtaggccgttgttcatcgccggaacaaccactacagtttgagataaaccaaccaccaggaagggctaaagaatgggtcgtgttcgaaccaagactgttaaaaaatcctctagggtagtgatcgagaggtattacgggaagatgactcttgacttccacacgaacaaaaagattttggaagaagttgccatcattccatcgaagcgtcttaggaacaagattgcgggtttctctactcacctgatgaagcgcatccagaagggtccagtgaggggcatctccttgaagctccaagaagaagaaagggagcgtcgcatggactttgtgcccgatgaatctgccattaagacggatctgattgaggttgataaggagaccattgaaatgctttctgcccttggcatggctgatctccctggggttgttaaggcatctgttgaaccacaggctttgccatcactccctgcttttggtaggggtggtgctccaaggagatattgaagacctttttagggtaatctccattttgttcgatgatattctcgcattaattatcttagtcatgccttgttccttttcttttcggtagggattgagcttgagcttgatattttttgagttatcaagtcaagcttgatgctcgtttatgggttcagattggcgattgattgattcgtttaatggattgtggacttgtggttgatgatctataattttactgcatgatctatgaa

SEQ ID NO: 1000 - DNA, 740 bp, Mesembryanthemum crystallinum
cccggctgcaggtcggcgcgctgtctctcatcttcttcaccatcttcaacctctcactttctctctcctcccctcaccgccaccatcaccagcaaccatgggtcgagttcgtaccaaaacagtgaagaaatcctctcgccaagtaatcgagcgttactactccaaaatgaccctcgatttccacaccaacaagaaggttctagaagaggtcgccatcatcccatccaagcgtctccgcaacaagatcgctgggttctccacccatctcatgcgccgcatccagaagggtccagttcgtgggatctcgttgaagctccaggaggaggagagagagaggcgtatggactttgttccagaagaatccgccattaaaacgagtcacattgaggtcgataaggagactcttgagatgcttgctagtcttgggatgggtgatttgcctgggatttctgagatggctgctgctcctgctgcgatcgctgctcctaccgggttcggccgtggtggtcccaggaggtactgatttgcagatttggttcgtttagggtttgttcatcgatgatgatgatgatgatggccgatttttagtgtttttgtctgtctttggggtagatatggtaatttggaagtaatgttgaggatcggaggatggaattttggaatttggttgtgttgttgttttgttctttttgatgttttgaatatttagaaatgatgaaattttggttatctccaaccgg

SEQ ID NO: 1001 - DNA, 745 bp, Mesembryanthemum crystallinum
  misc_feature (18)..(20): n is a, c, g, or t
  misc_feature (23)..(23): n is a, c, g, or t
tcttagtgctatgattcnnncgngcttaatcggagaggcgtttttctcatccatcagcagcagcagcagccgcagactcgcagcgccactccctgcgcctctctctctctctcctccggcatcaggtaagttcctttaagcttgtgaaatgggtcgtgttcgcacaaagaccgtgaagaagtcttctcgccaagtcatcgagaggtactactctcgaatgacattggatttccacaccaacaagaaggccttggaggaggttgccatcattccttccaagcgtctgcgcaacaagattgctggtttttccactcatctcatgaggagaattcaaaagggtccggttcgtggaatctctttgaaattgcaagaggaagaacgtgaaaggcgtatggactttgtgcctgctgagtctgcaatcaggactgactcgatcccagttgatcccgaaaccattgaaatgcttgctgctcttggaatgtctgatctccctggtgttgtcaagactgaagcagaggctatggcacctgctccagctttcggtcgtggagctggtggtccaaggaggtactagggtatcgttttaatttattgtgcaagaaatagacagacttaagatgccctttataatgggttcattgctcagttttgatgcctgtttcttacatgttatccatgggtctttctatttgttggtttaggaccaaagtttatagttagcaagagttgcaccatctctcatacc

SEQ ID NO: 1002 - DNA, 451 bp, Eutrema halophilum
ttcttcttctcttatcaggtaagtcacaggtaactgaaagatggggtgtgttcgtaccaacaccttgaagaaatcttctcgtcaagtcatcgagaagtactactcttgcatgactcttgacttccacacaaacaagaagatccttaaagaagttgccatcattccttcaaaccgactccgcaacaagattgctggattctccacccacttgatgaaacatatccagaagggaccagtccgtgggatctcactcaagcttcaagaagaagagcgtgaacgccgcatggactttgttccggatgagtctgctattaagaccgatgaaatcaaggtcgacaaagagactctagagatgcttgcttcccttagaatttctgaaatccctggcttctctcaagtcgagccacaggctatggcacctgttcgtatcagtcgaccaagagaaaagatt

SEQ ID NO: 1003 - DNA, 655 bp, Aquilegia formosa
cttcactcttgcagaaccagaagcagcagcagcagcagcagagagagagagagagagagagagtgaagaaggaagaagaatgggtcgtgttcgaacaaagacagtgaagaagtcatcacgacaagtgattgaaaggtattactcacgaatgacattggatttccacactaacaaaaagatcttagaagaagttgcaatcattccatcaaagcgacttcgtaataagattgctggattttcaactcatcttatgaaaagaattcaacgtggacctgttcgtggtatttcattgaaacttcaagaagaagagagagaaaggcgtatggattttgttcctgaagaatcagctattaatattaatgaaattgaagttgataaagaaacaatggatatgcttgctgctcttggtatgagtgatcttcctggtgtttctagagttgttgaaactactgttgctgctgctcctgcttttgctcgtggtggtggtgctggaaggagactttaagaggttttattattagcctaatttgttttcagaaatcttgaaatgttatttttgaattttatttaggaattttgttttgaatttggggggtttcgatctagattggatattcaaatttgatcgattaatttttatgtttgatgattatta

SEQ ID NO: 1004 - DNA, 791 bp, Glycine max
ccctctcataacacttctacaaaaccctagtttccctccctcgcctaatcctcacccttaacctctctgttctcttctgtcattgcttctcctccacacacgcacagagacacacacttttgcagtcacattgagaatggggcgtgttcgcacgaagacggtgaagaaatcctcgcggcaagtgatagagaggtactactcccgcatgacgctggacttccacacgaacaagaaggttctggaagaggtggccatcattccctccaagaggctccgcaacaagatcgcggggttctccacccatctcatgaagcggatccagaagggtcccgtgcgtggaatctccctgaagctgcaggaggaggaacgcgagcgtcgcatggacttcgtccccgatgtctccgccatcaggaccgaccagatcgaggtcgacaaggagacgctcgacatgctcgccgccctcgggatgtccgaggttcctggcatcgttcaggtggatcctgttgccgtccaggcgcccctcggcttcggccgtggcggccctggaaggaggtactaactgtccgcctccttcgagcttccagtttttgtcgtgttgtcaactagagcactaatttgtcatgcgttgagttttggttttacattattttaaaatttctgtagctgagtttcggattgtttggacttgttaaagctgttaatggaattcattttgtctttgcttataattcatgtcgcatgatatggtcagaactgtttttagtaatggactaatggcatagtttgatttc

SEQ ID NO: 1005 - DNA, 702 bp, Fagopyrum esculentum
atcttttatacctgcggtctcctcttcctctgcaaccgttgtttggttggaggcgcctagtcttttatcagatcatcccttcaatctacggtaagttaaccaaatcaagatgggtcgtgttcgtacaaagttggttaagaagtcttctcgccaggttattgagaagtactattctcgtatgaccttggatttccacacgaacaagaaggtcttggaggaggttgccatcattccaaccaagcgtcttcgtaacaagattgccggattctccacccatctcatgaagaggatccagaagggacccgttcgtggcatctcattgaagcttcaagaggaagagcgtgagcgcagaatggactttgttcccgaggagtctgcaatcaagaccgactccattgcagttgaccctgaaaccattgagatgattgctgctctcggcatgtctgaccttcctggtattattgaggccaagcccgagaccatggctcctcccccattcgcttcacgtggacctaggaggtactagtcctgttgtttaagtagttttgtcaaccactgccgccggatttcaaatgctgatatattttgatgcatgtgttttgagatttattagctttgtttgatcgtttttgacaatgtgatctctagaattgaattttgttactaagagtttgctgcaagcatcatagaatcttaaatatt

SEQ ID NO: 1006 - DNA, 717 bp, Fagopyrum esculentum
ttttatacctagcggtctcctcttcccttcgaaccgttgtttgcttggaggcgcgctcatcgttatcaaatcacactcctcctcaatctacggtaagttaaccaatcaagatgggtcgtgttcgtacaaagttggttaagaagtcttctcgccaggttatcgagaagtactactctcgtatgaccttggatttccacacgaacaagaaggtcttggaggaggttgccatcattccaaccaagcgtcttcgtaacaagattgccggattctccacccatctcatgaagaggatccagaagggacccgttcgcggcatctcattgaagcttcaagaggaagagcgtgagcgcagaatggacttcgttcccgaggagtctgcaatcaagaccgactccatcgcagttgaccctgaaactattgagatgattgctgctctcggcatgtctgaccttcctggtattattgaggccaagcccgagaccatggctcctcctccattcgcttcacgtggacctaggaggtactagtcttgctgtttaagtagttttctcaaccattgacgctggaattcaaatgcggatatatttttgatgcatgtgttttgagacttattagctttgtttgatcgtttttgacaatgtgatatctagaattgaattttgttactaagagtttgttacaatcatcatacaatcttaaattttatgacccttttga

SEQ ID NO: 1007 - DNA, 728 bp, Malus domestica
ataaatatcccaaaaccctaacttcccttcccttaccctcttttcgcctctctcacgaacacacacactcacccgccgttcgtctccacccagctccgccgcacaattccaccaccaccatgggtcgcgtccgtacaaagacagtgaagaaatcctcccgccaggtgatcgagcgctactactcgcgcatgaccctggacttccacaccaacaagaagatcctcgaggaagtcgccatcatcccctccaagcgcctccgcaacaagattgccggattctccactcacctcatgaagcggatccagaagggcccggttcgtggcatttcgctgaagctgcaggaggaggagcgcgagcgccgcatggactttgtccccgaggagtccgccatcaagatcgacgagatctccgtggacaaggagaccctcgacatgctctccgctctcggtatggctgacatgcctggtgtcaagcgggtcgacccggaagctcagactcagaatctcgggtacgggcgtggtgcacccaggaggtactaaaacggagaatgaccgggttttgatgctataatacatttggtttttgaattaggaagaagtttgttgtgtgtttaattttactgtggaagtaatgcgtgtgacatttttgttatgggattatgtcaattttgcatttagaatggaaagcgttgcattttattgaactcgtcagatgaatcgtattggtga

SEQ ID NO: 1008 - DNA, 693 bp, Malus domestica
cctctctcacgaacacacacactcacccgccgttcgtctccacccagctccgccgcacaattccaccaccaccatgggtcgcgtccgtacaaagacagtgaagaaatcctcccgccaggtgatcgagcgctactactcgcgcatgaccctggacttccacaccaacaagaagatcctcgaggaagtcgccatcatcccctccaagcgcctccgcaacaagattgccggattctccactcacctcatgaagcggatccagaagggcccggttcgtggcatttcgctgaagctgcaggaggaggagcgcgagcgccgcatggactttgtccccgaggagtccgccatcaagatcgacgagatctccgtggacaaggagaccctcgacatgctctccgctctcggtatggctgacatgcctggtgtcaagcgggtcgacccggaagctcagactcagaatctcgggtacgggcgtggtgcacccaggaggtactaaaacggagaatgaccgggttttgatgctataatacatttggtttttgaattaggaagaagtttgttgtgtgtttaattttactgtggaagtaatgcgtgtgacatttttgttatgggattatgtcaaatttgcatttagaatggaaagcgttgcattttattgaattcgtcagatgaatcgtattggtgaaaaaaaaaaaa

SEQ ID NO: 1009 - DNA, 511 bp, Fagus grandifolia
gctctctcagcctcccttgctatcagaacctccctcgactccgactccttcatcttcggaacagctaattctttgaaatgggtcgtgttcgtaccaagactgtgaagaagtcctctcgccaggttatcgagaggtactactctcggatgaccttggacttccacaccaacaagaagatcttggaggaggttgcaatcatcccctcaaagcgtctccgtaacaagattgccgggttctctacccacttgatgaagcgtattcaaaagggtccagtgcgcggcatttcgctcaagctgcaagaggaggagcgtgagcgtcgtatggactttgtgccagatgagtctgccattaagattgatgagattaaggttgataaggagaccattgacatgcttgctgctcttggcatgtctgaaattcccgggcttgttgaagctgagctacagcctgtggttcctgcccaggcatttggtcggggtgcaggtggtcctggtggacctaggaggtacta

SEQ ID NO: 1010 - DNA, 714 bp, Solanum tuberosum
ccaagggccgaagtcaagtcctccgccgctccaaatcttcaagtttcatactaggaagcttcagcgaggatgggtcgtgtacgcaccaagaccgtgaagaagtcttccagacaggtaattgagaggtactactccaagatgaccttggatttccacaccaacaagaagatattggaggaagttgccattattccttcaaagcgtctgcgcaacaagattgccgggttctccacccaccttatgaagcgtattcagaagggacctgttagaggcatctccctgaaattgcaagaggaggaacgtgagagacgtatggactttgttcctgatgagtctgccattaagaccgatctgattgaggtcgacaaggagacccttgacatgctttcatcccttggcatgtctgaccttcccggtgttgtcaagcaggctgcagaaccacaagcagtagcagctctcccaacctttggtcgtggtgctggtggttttggcaggaaatactaagactacaatataagatgtgaacaaatttaaatcgagtttttggtagactacatgttttagatatatctccctaattttgttgaaggattgttatgccaaagttcatgttatttagttttgagagatgatggttaactcttgagtctttggttctaaatgcatgctatctatttccaattacatttttgcttcaaaaaaaaaaaaaaaaaa

SEQ ID NO: 1011 - DNA, 911 bp, Glycine max
acccttaacctctctgctgcgtttgcttctcctccacccatccacaaacgaacacacactttgattgagaatggggcgtgttcgcacaaagacagtgaagaagtcctcgcggcaagtgatcgagaggtactactctcgcatgacgctggacttccacacgaacaagaaggttctggaagaggtggccatcattccctccaagaggctccgcaacaagatcgcgggattctccacccacctcatgaagcggatccagaagggtcccgtacgtggaatctccctcaagctgcaggaggaggagcgcgagcgccgcatggacttcgtccccgatgtctccgccatcagaaccgaccagatcgaggtcgacaaggagacgctcgacatgctcgccgccctcggaatgtccgaggttcccggggttgttcaggtggatcctgttgctgtccaggcaccgctcggcttcggccgcggcgccggaaggaggtactagttgccgcctttgagagttttggccgtgttgtttactagagcactaatttgttatgcgttgaagtttggttttacattagttttggattgttggactcgttaaagttgttaatggaatttgttttgttttgcttataattcttgttgcgtgatatggttagaattgtttggagtaatggaactagtagcatagtttgattcctgcgctgtaacaccgtctaggatgtttaggatttggttgtgtcgtgcctattataatctatgatgagttttgcacatgtaagtttttgataaaatggtccgggaccgtgatttggtcctttttaagtgtttgcaaccacaattgggaccacattggttgtatttgtctgtgatttgccaccatatcaacaaacagttatcaacaaatgcgatgaaatcgc

SEQ ID NO: 1012 - DNA, 666 bp, Fragaria vesca
gatcactcttcagccgtcttaccctcacagagagccatgggacgcgtccgcaccaagaccgtgaagaagtcctcccggcaggtgatcgagcggtactactcccgcatgacccttgacttccacaccaacaagaaggtcctcgaagaggtggccatcatcccatcgaagcgcctccgcaacaagatcgccggattctcgacccatctcatgaagcgcatccagaagggccccgtccgcggcatctccctcaagcttcaggaggaggagcgcgagcgccgcatggacttcgtccccgacgagtccgccatcaagaccgacgacatcgccgtcgacaaggagactcttgacatgctcactgctctcggcatggctgatattcccggcctcagggagtccaccgaactgcaggctgctcctgtcgggtacggccgtggcgggcccaggaggtactaggcttttggttggtttcactcatgtgttatagtactactgttgtttttgagtttggattatgaactcctagtgctttgttctttatgcgaatttctgttcttgattgacaatttaaaacatgccgctttatatttatgttgctgcaaatgtgtagaaatggttgttgataatttgttaatttggttgatagatgctatatggggttatttattc

SEQ ID NO: 1013 - DNA, 672 bp, Acacia harpophylla
ggtcgcagccggttgtacccacagttttccaccttcttccttcgcgcgcagcaagcagtctctcggagtcacacagccgccgccatgggtagagttcgtaccaaaacggtgaagaagtcgtctcgacaagtcatcgagaagtactattctcgaatgaccttagatttccacactaacaagaagattcttgaggaggttgctctcatcccttccaagaggctccgtaacaagatcgccggattctctacgcatctcatgaagaggatccagaagggccctgttcgcggcatttccctcaagcttcaggaggaggagcgcgagcgtcgtatggatttcgttcctgatgtttccgccattaagactgatcaaattgaagttgacaaggagacgcttgacatgcttaatgctcttggcatgagtgatattcccggtgttgtccaggtcgatcctacgcctgtgccgcaggtcggatttggtcgcggcggtttcggtggcggtgctaggaggtactgagtattaggtttaaatgtcatttattgctaagttttgaacttctgtttcaaatctcatattatggtttagattatggttctgaaaattttcaaattgttgagttgatggaatggattttgtcttacttttcctgttatcggtatcgtatcttagtttgat

SEQ ID NO: 1014 - DNA, 837 bp, Lotus japonicus
gggcctctgcaaaaccctaatcccattgcgtgcgctctctccctctcctctccccaccgccgccgcagtctccgccacttccagatcggaaaatgggtcgcgtccgcacaaagacagtgaagaagtcctctcgtcaagttatcgagaggtactactctcgcatgacactggatttccacacgaacaagaagatcctcgaggaggttgctctcatcccatccaagaggctccgcaacaagatcgccggattctccacccatctcatgaagcgcatccagaagggtccagttcgtggaatctcgctcaagcttcaggaggaggagcgtgaacgccgcatggatttcgtccctgatgaatccgccatcaagactgatcatatcgcggttgataaggagactcttgaaatgcttgctgctctcggcatggcggagattccaggtgttgttcaggttgatccagttccggttcagcaaattgcctacggtcgcggtgccggcgccggtgcccctggccggaggtattgattaaatacctgtttttcgttctcgttttcatcatgtgcgagtactttatatcagttgaattttagtttttgatgggattatatattcagtaattgggattgttgaagattttgttatggaaattatgatgttttgctatgttgttgaacctttagattaatttttagtagtcaatgttgttatcgaactggcgtttgctttgctcgatggattctctttgtgggttgtcattttttgagaaattacttcgtgttcatcgtatcattgcaccatttgttcaacactttaacctgttttgcattaaaaaaaaaaa

SEQ ID NO: 1015 - DNA, 730 bp, Carica papaya
cttgtccagctgcgcgttcaatcactacacacaggcacaagcaccaactcttcgccgccgcaaccaccagcagcagcagaagcaatcatgggtcgcgttcgcacaaagacggtgaagaagtcctcccgccaggtgatcgagaagtactactctcgcatgacacttgacttccacaccaacaaaaagatcctcgaggaggtagcgatcattccttccaagcgcctgcgcaacaagatcgctggcttctccacccaccttatgaagcggatccagaagggtccagttcggggaatctctctgaagctccaagaggaggagcgcgagaggagaatggacttcgtccccgatgagtccgccattaagactgatcacatcgaggtcgacaaggagaccatggacatgcttgcggctctcggtatgtctgagattccaggtgttgttaaggtggatcccgttgccgctcctgttcaatcaatggggttcggccggggtgcaggtggagttggcaggaggtactaaaaagcctattttggtgttgtgggtctttataggattttggagaggattcttgcatgcttcgtttttcttttttttttttttgctttatgtttcgaaaatattttaatcttatgttaagcaaggatctttttagtcttaagtttatatttttgttggaactattttgatttctgataaatgggtattgttagtttaattttatgattgtttg

SEQ ID NO: 1016 - DNA, 922 bp, Populus trichocarpa
agactgcttatatacctgaagaagactctcttcctgctacccataacgccgcagcagtacctcggtattcgtcatcggggctctccttgcatcttgaagcagcagcagcttattagctaagatgggtcgtgttcgtaccaagacagtgaagaagtcttcacgccaggtcattgagaggtactactctaaaatgaccttggatttccacaccaacaagaagattttggaagaggttgctatcatcccctcgaagcgtctccgcaacaagattgctgggttctctacccatctaatgaagcgtattcagaagggaccagttcgtggcatctcactgaaactacaagaggaagagcgtgagcgtcgcatggatttcgtgcctgaggagtctgccattaagatccatgagattaaggttgacaaagagaccattgacatgcttgccgctcttgggatgtcagatgttcctgggcttgttgaagttgagcctcagcctatgcttcccactcagggattcggtagaggaggtggtgctaggaggttcttgagttaaattaacctccataggatgttcgagtgcaagaactttaaatatcttgtcttgtctttttttagtgctcgctttcagtgtctgttatggatattaccctcagtgggtattggtacttgattgttaaaaactggagatttagttgattttgctgttaaagaatgatatttttagttgatttaaacgcgtcttataatgccatttttgtcatgtgctcaagtatgtgaacaccttgcatttcaattttattaggcatcattactcgggagaaagtgtgatttgttcttccctgggcttcatgaagcaagctgcagaaccccccatgttaaatggtgactcgcatgctattgttcaatacaagcttgtgccgctgca

SEQ ID NO: 1017 - DNA, 893 bp, Primula obconica
tctctccgactcgaagccgttacgagtttactctagcttagcaaacatgggtcgtgtccgaacaaaaacagtgaagaagtcctctaggcaggtgatcgagaggtactactcgaagatgacgatggatttccatactaacaagaagattctggaagaggttgctatcatcccatccaagcgtctgcgcaacaagattgcagggttctccacccacctcatgaagaggatccagaaaggcccagtccgtggaatctctctcaagctgcaggaggaggagagagaaaggcgtatggactttgttcccgacgagtctgcaattaatatcgaaaaaatcgaggtcgataaggagactatggaaatgcttgctacacttggcatgggagatcttccaggggtttttaaggctgttgaggagcagcagcctgttgcttcttttaaccgtggtggtggaccaggtgccccgaggaggtactgagggacactttttgatttgttgttttcaaatgaatttataacaacggtagcagcttgggcaattttcttatggtttgttttaaaaatttgtagttgttggtacttggtgtttcttaattttggcactatgagatggtactctatgttaatttcacttcttaatgcctaaaatcttgttaagtcgtgtggttttacccattacggccgaaaacaaacgaggaaaggcttacggtggatacctaggcacccagagacgaggaagggcgtagtaagcgacgaaatgcttcggggagttgaaaataagcatagatccggagattcccgaataggtcaacctttcgaactgctgctgaatccatgggtagacaagagacaacctggcgaactgaaacatcttagtagccagaggcaactagagg

SEQ ID NO: 1018 - DNA, 927 bp, Theobroma cacao
caagctgttggcggtgggtttgctttctctcgtgtggcagccgcagcctcagtctcttagttgatctcaggcgtccctgcttcctcaccttcccctgttgcctttaccaaggaacagctaagatgggtcgtgttcgcaccaagacagtgaaaaagtcctcacgtcaggtcattgagaattactactctcgcatgaccttggacttccacaccaacaagaagattgttggggaggttgctctcattcctacaaagcgccttcgtaacaagattgctggcttctctacacacttgataaagcgcattcagaagggtccagttcgtggcatttcactcaagctacaagaagaagagcgtgagcgtcgcatggactttgttcctgacgagtcagctattaacactgatgaaatcaaggttgacaaggagactcttgacatgctttctgctcttggcatggctgatattcctggccttgttgaagttgaaccacaggctatgattgctcccccagtttttggtggcccgggtggtgctggtaggagatactgagattattgagctgtgcaggtcgatttgagactaaacaagttttgatggtgttacttaatattgttgctactagtgaatttttttttttttggataatatggcacattgggctttttttaatgttgaatttggatacaaatgttacttaaaagttcattgaattgatgatggcaatctctcatatgatttttggttttcaatcaagtaattggtttaatatcttgacgtggtttggtggacatcttaaggaagtttgctatggaaggattattgtgttgcttttgaacagatgaatgacttcacaactcattgttcttcaaccttgttcagccatactaatctttatgtaaatgacgagcaatgaacaacagaattttgg

SEQ ID NO: 1019 - DNA, 703 bp, Linum usitatissimum
gctccagctttgttatcctttcggaactcaggaggcggcagcagcagcggagtcaggcaaccatgggtcgcgttcgtaccaagaccgtgaagaaatcctcccgccaggtcatcgagcgttactactcgaagatgactctcgacttccacaccaacaagaagatccttgaggaagtggcaatcatcccttccaagcgcctccgcaacaagatcgccggattctccactcacctgatgaagcgtatccagaagggcccagtccgtggcatctccctcaagctccaggaggaagagcgcgagcgccgcatggacttcgtccccgaggagtccgccatcaggactgacaagatcgaggtcgacaaggagactatcgagatgcttactgcactggggatggccgactgtcctggaatcgttgaggtcgatcctgttgccgtcagcgctccgcagttcggctttggaaggggtgctggtcgtgggaggtactgaattgttaaaatgttaggggtttgagaaatgactatcttgtttggctcttagctttgttaatcgaagagtgcgaatttgatgctcctggtaatttttggttaatcgttttggatactggaatgcttttacagtttgttgttctgttggtaatgcttgaattgaattctgcaaactgtttgctctttttcctggttgatataagatgagtcctactt

SEQ ID NO: 1020 - DNA, 678 bp, Vigna unguiculata
tgccgctctgtatctgcgtctgtgtgtaggtggtgtggttgaggaagagaagcagttgaatcagcagaatggggcgtgtgaggacgaagacagtgaagaagtcgtcaaggcaagtgatagagaggtattactctcgcatgacgttggacttccacaccaacaagaaggttctggaagaggtggccatcattccgtcgaagaggctgcgcaacaaaatcgccggcttctccacgcatctcatgaagcgcatccagaagggaccggtgcgcggcatctccctgaagctgcaggaggaggagcgtgagcgccgcatggacttcgtccccgaagtctctgccatccggaccgaccagatcgaggtcgacaaggagaccatcgacatgctcgccgccctcggaatgtccgatgttcccggcgtcgtcaaggtcgatccagttcccgtacaagcaccgcttgccttcggtcgcggcgccggcggaaggaggtattaagcacctccgtcttgttttttgttttggtcgagttgttaattagtggactaattgttatgttttgtgatttggattattatatcttagggtttacatttttgtgactgagttttgaatggtcggatttgttaaactggttaatggaattgatttggtgttgcttatgatttatacgtttataatgtta

SEQ ID NO: 1021 - DNA, 745 bp, Vigna unguiculata
cgctctgtatctgcgtctgtgtgtaggtggtgtggttgacgaagagaagcagttgaatcagcagaatggggcgtgtgaggacgaagacagtgaagaagtcatcaaggcaagtgatagagaggtattactctcgcatgacgctggacttccacaccaataagaaggttctggaagaggtggccatcattccgtcgaagaggctgcgcaacaaaatcgccggcttctccacgcatctcatgaagcgcatccagaagggaccggtgcgcggcatctccctgaagctgcaggaggaggagcgcgagcgccgcatggacttcgtccccgaagtctctgccatccggaccgaccagatcgaggtcgacaaggagaccatcgacatgcttgccgccctcggaatgtccgatgtccccggcgtcgtcaaggtcgatccgattcctgtacaagcgccgctcgccttcggtcgtggcgccggcggaaggaggtattaaccaccgccgccttgtttttgattttggtcgtgttgttaattagaggaccaattgttatgttttgtgctttggattatgatatatcttagggtttacatttctggatggtcggatttgttaaactggttcatggaattgatttggtgttgcttatgatttatacgtttataatgttactcttgtttgaagtgatgggctaattacataattacatagtttgattactgcgctaaaaccatgttagttagattttgtca

SEQ ID NO: 1022 - DNA, 735 bp, Vigna unguiculata
atttttacaaaaccctaatctccctccgtttgccctacctccgtgcttgccgctctgtatctgcgtctgtgtgttgcgtggtgtggttgaggaagagaagcagttgaatcagcagaatggggcgtgtaaggacgaagacagtgaagaagtcgtcaaggcaagtgatagagaggtattactctcgcatgacgctggacttccacaccaacaagaaggttctggaagaggtggctatcattccgtcgaagaggctgcgcaacaaaatcgctggtttctccacgcatctcatgaagcgcatccagaagggaccggtgcgcggcatctccctgaagctgcaggaggaggagcgtgagcgccgcatggacttcgtccccgaagtctctgccatccggaccgaccagatcgaggtcgacaaggagaccatcgacatgctcgccgccctcggaatgtccgatgtccccggcgtcgttaaggtcgatccggttcccgtacaagcaccgctcgccttcggtcgcggcgccggcggaaggaggtattaaccaccgccgccttatttttgattttggtcgtgttgttaattagaggaccaattgttatgttttgtgatttggattattatatatcttagggtttacatttctggatggtcggatttgttaaactggttcatggaattgatttggtgttgcttatgatttatacgtttataatgttactcttgtttgaagtgatggg

SEQ ID NO: 1023 - DNA, 623 bp, Cyamopsis tetragonoloba
cacgaggctttctcttccttctcccgccgcattttcacagttacacaacagcggtttcaaccatgggacgagttcgcacgaagacggtgaagaaatcctcacgccaagtcatagagcgatactactctcgcatgacgctggatttccacaccaacaagaagattctcgaagaagtagctctcattccctccaagaggctccgtaacaagatcgccggattctccactcacctcatgaagcggatccagaaaggaccggtgcgtggaatctccctgaagctgcaagaagaagagagggaacgccgcatggatttcgtccccgaggtttccgccattaaaactgatcagatcgaggtcgataaggaaaccctagacatgctcgccgccctcggaatgtctgaaattcccggcgttgttcaggtggatcctgttcccgttcagccgcagctcggctttggtcgcggcgctcccggccggaggtattaatcgattccggtaggttcttagtgactgtttatttatgctttgagttttgtttttctaatttccttgactgagttttggattgttaagcttgttgaagtggttgttaatggaatttagttgatgtttattgaaaaaaaa

SEQ ID NO: 1024 - DNA, 511 bp, Nuphar advena
  misc_feature (349)..(349): n is a, c, g, or t
  misc_feature (370)..(370): n is a, c, g, or t
  misc_feature (428)..(428): n is a, c, g, or t
  misc_feature (486)..(486): n is a, c, g, or t
ctctttccctgagatctagggttcctctccgatcttctccgcaacaagagggatggggcgagtgaggacgaagacggtgaagaaatcgtcgaggcaggtgatcgagcggtactactcgaggatgaccctcgacttccacaccaacaagaagatcctggaggaggtggccatcatcccctccaaacgcctccgcaacaagatcgcggggttctccacccacctcatgaagcgcatccagcgcggtcccgtccgcggcatctccctcaagttacaggaggaggagcgcgagcgccgcatggacttcgtccccgaggagtccgccatcaagaccgaccccatcgaggtcganaaggagaccatcgaaatgctngctgccctcggcatggcagacctccccggcgtcgtcaagcaggctgatgcctccgctngcggcggcggcgggtacggcaagcccggtggtggataccagggtcggaggatctaggnttcttccccctatccccccttcggg

SEQ ID NO: 1025 - DNA, 607 bp, Elaeis guineensis
  misc_feature (582)..(582): n is a, c, g, or t
  misc_feature (586)..(586): n is a, c, g, or t
ccaagccaacgccaccggagacagagagaggcaagaggaggagatgggtcgcgttcggacgaagaccgtgaagaaatcttctcggcaggtgatcgagaggtactactcacggatgacgctggacttccacacgaacaagaagatcctggaggaggtggccatcatcccctcgaagcgtctccggaacaagatcgccggcttctccacccacctcatgcgccgcatccagcgcggccctgtgcgcggcatctccctcaagcttcaggaggaggagcgcgagcgccgcatggacttcgtccccgacgaatccgccatcaaggtcgaccacatcgaggtcgacaaggagaccatcgagatgctcgcatccctcggcatggccgacctccctggcgtcgagaagcaggccgattcccccgccatccccgtctactccggccgccctggcgggtacggaggcaggaggtcctaaatttccaagttttggtttcttctagatctaaatttatgttttagtgtaaaagtcttggtctttctttcttttccttctatatagttatatgtcgttgaagttttggacttggnttanatatttggattaatgatggag

SEQ ID NO: 1026 - DNA, 760 bp, Linum usitatissimum
aacttcaatcagctgcagcactttctccccttacaccggcggcaagctatccacagttcacgtaagctatcacttccttcttcttccgccgtcagctgcaatgggacgtgtccgtaccaagaccgtgaagaaatcctcgcgccaggtgatcgagcgctactactcgaagatgacactcgatttccacaccaacaagaagatcctggaagaggtggccatcatcccctcgaagcgcctccgcaacaagatcgccgggttctccacccacctgatgaagcggatccagaagggccccgttcgcggcatctccctcaagcttcaggaggaggagcgcgagcgccgcatggacttcgtccccgaacaatccgccatcaacaccgacaggattgaggtcgacaaggaaacccttgacatgctcagcgctctcggcatgagcggcgttgaaggcatcgtcgtcgtggaacccggcaccgtcgctccggtttacgggtttggcagaggcaggaggttttgaagtgcaattttttttggcattctctgtttaatgtgttgaagtttgagcttgtgcggttttttgttggataataattgaagaaacttttaccttagttgcgttctactgtcagagaaattttgttagacaatgctactgttggtgaattgttctaaagctgaatggataatagcttgtgaaatggtcgtcgtcttactggtttgatgcatttgcgtttttgctgatgataatggttactgaattgga

SEQ ID NO: 1027 - DNA, 730 bp, Linum usitatissimum
tttctccactcacaccggcggcaagcaatccacacttcacgtaagctctcacttccttcttcttccgccgtcagcgacaatgggacgtgttcgtaccaagaccgtgaagaaatcctcgcgccaggtgatcgagcgctactactcgaagatgacactcgacttccacaccaacaagaagatcctggaagaggtggccatcatcccctcgaagcgcctccgcaacaagatcgccgggttctccacccacctgatgaagcggatccagaagggccccgttcgcggcatctccctcaagcttcaggaggaggagcgcgaacgccgcatggacttcgtcccggaacaatccgccatcaacatcgacaggattgaggtcgacaaggaaacccttgagatgctcggcgcactcggcatgagcggcgttgaaggcatcgtcgtagtggaacccggcaccgtcgctccggtttacgggtttggcagaggcaggaggttttgaattgcttttttttggcagtctctgtttaatgttttgaagttaagcttgtgcggttttttgttggatggcaatttatgaaacttttactttagtttccttctactgtgagagaaattttgttagactatgctacggctggtgaatttgttcagctgaatggataatagtttccgaaatggttatcttcctggattgatgcctttgcattttgctgctgttaatctgcaaatttgtttc

SEQ ID NO: 1028 - DNA, 771 bp, Solanum lycopersicum
atttttttctgagtgatactaaaaccctaatctccttcacttatattttttccattgaaagcttacattttctcagttgccgcagtcgagtcctccgccgctccaattcttcaagtttccatactaagaagcttcagcgaggatgggtcgtgtacgtaccaagaccgtgaagaagtcatccagacaggtaattgagaggtactactccaagatgaccttggatttccacaccaacaagaagatattggaggaagttgccattattccttcaaagcgtctccgcaacaagattgctgggttctccacccaccttatgaagcgtattcagaagggacctgttagaggcatctccctgaaattgcaagaggaggaacgtgagagacgtatggactttgttcctgatgagtctgccattaagaccgatctgattgaggtcgacaaggagacccttgacatgctttcagctcttggcatgtctgaccttcccggcgttgtcaagcaggctgcagaaccacaagcagtagcagctctcccaacctttggtcgcggtgctggtggttttggcaggaaatactaagagagtacaatataagatgtgaacaaatttaaatcgagtttttggtagactacatgttttagatatatcttcttaattttgttcaaggattgttatgccaaagttcatgtttattttgttttgagagatgatggtgaactattgaatctttggttctaaatgcactctatctatttccaattacattttgcttc

SEQ ID NO: 1029 - DNA, 727 bp, Citrullus lanatus
tacgccttcttctctttaggtaagattctgcgctccgatttgccgcctcttcttccgccgtcgcctgaacacactttccgcctgcagactattcctacggcagcaacatgggtcgcgttcgaaccaaaacagtgaagaaatcttcccgtcaagttattgagcgctactactcgcgcatgaccctcgacttccatacgaacaagaagatcctcgaagaagttgccattattccctctaagagactacgaaataagatcgccggattctcaactcacctcatgaagcggatccagaagggacctgttcgcggcatttctctcaaacttcaagaggaagagcgcgagcgccgtatggatttcgtccccgacgtctccgccattaaaaccgatcaaatcgaagtcgacaaggagaccctcgatatgctttctgcgcttggaatgaacgatattcccgggcttgttcaggtcgatccgactgtgccgcagcaggttggatttggattgggaggtcgcggtaggaggtactgagcttatcggctagggttttgtttttttttttacttttcccctttttcttctgatcttctgttgggattcaatacaattttgtgatttagttttgtttacgagtattgttactttctgctaagccaaaggatatgaaattttcatattgatttcgagtaaccttctgcaatagagagatttggtttcaaagttttttagaa

SEQ ID NO: 1030 - DNA, 656 bp, Citrullus lanatus
ccgtcgcctgaacacactttccgcctgcagactattcctacggcagcaacatgggtcgcgttcgaaccaaaacagtgaagaaatcttcccgtcaagttattgagcgctactactcgcgcatgaccctcgacttccatacgaacaagaagatcctcgaagaagttgccattattccctctaagagactacgaaataagatcgccggattctcaactcacctcatgaagcggatccagaagggacctgttcgcggcatttctctcaaacttcaagaggaagagcgcgagcgccgtatggatttcgtccccgacgtctccgccattaaaaccgatcaaatcgaagtcgacaaggagaccctcgatatgctttctgcgcttggaatgaacgatattcccgggcttgttcaggtcgatccgactgtgccgcagcaggttggatttggattgggaggtcgcggtaggaggtactgagcttatcggctagggttttgtttttttttttacttttcccctttttcttctgatcttctgttgggattcaatacaattttgtgatttagttttgtttacgagtattgttactttctgctaagccaaaggatatgaaattttcatattgatttcgagtaaccttctgcaatagagagatttggtttc

SEQ ID NO: 1031 - DNA, 672 bp, Vigna unguiculata
gcagttagagaaggccagagaagagagaagagaagagaagccgcagagagaggaggaggaagaagaagagaagaagaagaagaatcagcatggggcgcgtgagaacgaagacggtgaagaaatcttcacggcaagtgatcgagcgttactactctcggatgaccttggactttcacacgaacaagaagcttctagaagaagtagccatcatcccctcgaagaggcttcggaacaagatcgcaggtttctccacccatctcatgaagcgtatccagaagggtcctgttcgcggcatctcgctcaagctgcaggaggaggagcgtgagcgccgcatggactttgtccccgacgtctccgccatcaacaccgaccacatcgaggtcgacaaggaaaccatggaaatgctccactccctcggaatcaacgacgtctccggcattgtccaggtcgaccctgtccctgtccaacccacctttgccttcaacaggaggtactgatccctcctctgtcatcacaccaaggttttcgctttttgccttttattcatgcttttcgcatcctatttttgctttatgttgttgctactgtcgatgctttaagtcagacctacttctagcttttcgattatatcaaattatataccatctgttcttcccaaaaaaaagaaaaaaa

SEQ ID NO: 1032 - DNA, 827 bp, Petunia hybrida
aatatcacacatagaatcagttgcggctcccattctctctattcctacaatctttgtttggtctaaggaagttctgcaaggatgggtcgtgtacgcaccaagaccgtgaagaagtcatctcgacaggtaattgagaggtattattccaagatgactttggatttccacacaaacaagaagatcctggaggaagttgccataatcccttccaagcgtctccgtaacaagattgctggcttctctacccacctgatgaaacgtatccagaagggacctgttcgaggtatatccctgaaactgcaggaggaggagcgtgagagacgcatggactttgttcctgacgagtccgccattaagactgatcttattgaagttgacaaggagacccttgacatgctttcagccctcggcatgtctgatcttcctggtgttgtcaagcaggctgctgagccacaggcagtagcagctctcccaacatttggtcgcggtgcagggggttttggcaggaaatactaataagtgtagtttcaaagatgttgtgtacaatttaagaatgtttttggttaagattaaatgagatgttaggtttccttaatgctctttgaggatttttataagctcattctattgttgagacatagataaacatctgttctggttctaccatgcatattataacatctcttcaatagcacagatctggctgctgatgagtcttctgtggtgcatcacccttcattatgtatacgtgatcactactaatcttcgataagtcgttgaccctcctcccctccagatcgtcatcatggcaagataatatggtagcc

SEQ ID NO: 1033 - DNA, 781 bp, Solanum phureja
atttttttctgagtgatactaaaaccctaatctctttctcttatattttttccattgaaagcatacattttatcagttgccgcagtcaagtcctccgccgctccaaatcttcaagtttcataaaaagaagcttcagcaaggatgggtcgtgtacgtaccaagaccgtgaagaagtcatccagacaggtaattgagaggtactactccaagatgaccttggatttccacaccaacaagaagatattggaggaagttgccattattccttcaaagcgtctgcgcaacaagattgctgggttctccacccaccttatgaagcgtattcagaagggacctgttagaggcatctccctgaaattgcaagaggaggaacgtgagagacgtatggactttgttcctgatgagtctgccattaagatcgatctgattgaggtcgacaaggagacccttgacatgctttcatcccttggcatgtctgaccttcccggtgttgtcaagcaggctgcagaaccacaagcagtagcagctctcccaacctttggtcgtggtgctggtggttttggcaggaaatactaaggctacaatataagatgtgaacaaatttaaatcgagtttttggtagactacatgttttagatatatctccctaatattgttcaaggattgttatgccaaagttcatgttatttagttttgagagatgttggtgaactcttgaatctttggttctaaatgcattctatctatttccaattacattttacttctggagagtgttaac

SEQ ID NO: 1034 - DNA, 771 bp, Solanum lycopersicum
atttttttctgagtgatactaaaaccctaatctccttcacttatattttttccattgaaagcttacattttctcagttgccgcagtcgagtcctccgccgctccaattcttcaagtttccatactaagaagcttcagcgaggatgggtcgtgtacgtaccaagaccgtgaagaagtcatccagacaggtaattgagaggtactactccaagatgaccttggatttccacaccaacaagaagatattggaggaagttgccattattccttcaaagcgtctccgcaacaagattgctgggttctccacccaccttatgaagcgtattcagaagggacctgttagaggcatctccctgaaattgcaagaggaggaacgtgagagacgtatggactttgttcctgatgagtctgccattaagaccgatctgattgaggtcgacaaggagacccttgacatgctttcagctcttggcatgtctgaccttcccggcgttgtcaagcaggctgcagaaccacaagcagtagcagctctcccaacctttggtcgcggtgctggtggttttggcaggaaatactaagagagtacaatataagatgtgaacaaatttaaatcgagtttttggtagactacatgttttagatatatcttcttaattttgttcaaggattgttatgccaaagttcaggtttattttgttttgagagatgatggtgaactattgaatctttggttctaaatgcactctatctatttccaattacattttgcttc

SEQ ID NO: 1035 - DNA, 690 bp, Silene vulgaris
aaaatgggacgcgtacgcacgaaaacagtgaagaaatcatcgcgacaagtaatagaaaagtactactcaaaaatgacactagatttccacacgaacaagaaagtccttgaagaagtagcaatcatcccttcaaagagactccgtaacaagatagcaggattctcaacccatctaatgaggcgaatccaaaagggtcctgttcgtgggatctcactcaagcttcaggaggaagagcgtgaaaggcgtatggactttgttcctgatgtttccgccattcgtactgatcttattgaggttgatcgtgagactcttgatatgttggctgcacttggtatgtctgatcttcctggtttatctgaggttgcacccgagtctgctgcttttgccattcctgctggtggctttggtcgtggtgctgctggtcctaggaggtactgagattgtcagtttgtttcgcggcggcttttcgacttgggtttatgttgcttattgttattactgttttcgtaattttagttttcagatatgctatgttttaaggatctatactactactcttttgaatcactgttgctctcgttattcactttcaatccattttgatagcctggttggaattacattgttgatatttgttgattatcgatcgatattgccaaatgttttactccctcaattccacttttgttt

SEQ ID NO: 1036 - DNA, 676 bp, Hevea brasiliensis
agcgtttcgcttcttcaagcaacagattattcttggagatgggtcgtgttcgcaccaagactgtgaagaagtcctctcgccaggtcattgagaggtactactctaaaatgaccttggacttccacaccaacaagaagatcttggaagaggttgctatcattccctcaaagcggcttcgtaataagattgctggattttccacccaccttatgaagcgtattcaaaagggttctgttcgtggtatctctttgaaactgcaagaggaagagcgtgaacgtcgcatggactttgtgccagaagagtctgccattaagattgatgagattaaagttgataaggagacaattgacatgcttgctgctcttggtatgtcagatattcccgggcttgttgaatttgaacctcagcctttggttcctccccaggtctttggtaggggtcaagctggtgcgcctggaaggaggttctgaggtcattgagctttagaggatgttcaagtatgagaacttcagatgtcattctgttagtagttactttctgtctttgtcctggatattatactaaatggatatcagtactcaatattttgaactggctatttttagttgacattgaagttaaaggatgatactgtggttgatttgatgcagataaggcctttcttgccattgttctt

SEQ ID NO: 1037 - DNA, 699 bp, Lotus japonicus
gacccaccttcttcaacccaaaccctagctctgtgagttgcagaaaccctaattctcagagttccagatcgccgttgaagaacaatggggcgcgttcgcacgaagacggtgaagaaatcctcacgccaagtcatagagcgatactactcacgcatgacactcgatttccacaccaacaagaagatcctcgaagaggtggctctcatcccatccaagcgtctccgcaacaagatcgccggattctccacccacctcatgaagcgcatccagaagggccctgttcgtggaatctcgctcaagcttcaggaggaggagcgtgagcgccgcatggatttcgttcctgatgaatctgctatcaagactgatcatattgctgttgataaggagactcttgaaatgcttgctgctcttgggatggctgagattcctggtgttgttcaggttgatcctgttgctgttcagcagattccgttcacccgcggcggcggcgctggtggcggcgctggccgtaggtattaagcttctcttttttgttttgtcgttttgctcatgtgttagaagttagaacttcgacttcttcatataagttttatgattaattttgttattgggatgagatattcagtaactgaatagtttaagtttttgttgtagtaattcgtatgcgatgttatcttgtgtttcgattaattttctgtg

SEQ ID NO: 1038 - DNA, 922 bp, Helianthus annuus
gggagagtgcgccgctgctagttaccggaaccaccagtatagtttgagattaatataaccactaggaggagctaaagaatgggtcgtgtacgaaccaaaaccgttaagaaatcctctagagtagttatcgagaggtactacgggaaaatgactctcgacttccataccaacaagaagattctggaagaagtggctatcattccatcgaaacgtcttagaaacaagattgccggcttctccactcatctcatgaagcgaatccagaaaggacccgtgaggggtatatcattgaagctacaggaagaagagagggagagacgcatggactttgtgcctgatgagtctgctatcaaaactgatctgattgaagttgataaagagaccattgaaatgcttaatgctctgggaatgggtgatcttcctggtgttgtcaaggcttctgttgagccacaggctttgccgtcagttcccgcttttggtcggggcggtggtgcaacaagaagatattaaaaatgcattgtttcttttgattaaagattcatgttttttgagatggtgattgtgacttggtaaaacagtttaattggatcaacaatgagcaggtcctcattgtgatattttgttgcttaaattccaacatggaaaaggtattacaaatttgattttttggttaactttcttattgacttttatgcgagttccatttacagacgcgcgcgtgcacccacacatatattgtattccagtttaattggatgatcaaatcacagaattacatacaaagattaaccagtcaatgtatgaaatctcgctactgaaaagcgcacataaggaaaacgaagacaactggaatactaatattgaaaggttgcaaacagaactaagggaaaaatgtaagtcagttgatgatttgaataaagat

SEQ ID NO: 1039 - DNA, 751 bp, Lippia dulcis
ctgctatacgactgtcgtcgctctcgccggaggaatttcgtctttcaagagtcattgtcagagtgaagttctaagtagctgttgccgagatgggtcgtgtgcgtaccaagacagtgaagaaatcctcccgtcaggtgatcgagaagtactactccaaaatgacattagatttccacacaaacaagaaaatcttggaggaagtttcaattatccctacaaagcgtctcagaaacaagatcgctggattctccacacatcttatgaagcgtatccaaaagggtcctgttcgtggcatttctctcaagctgcaggaggaggagcgtgagaggcgtatggactttgtgccggatgagtccgctattaagaccgacgtgattgaagttgacaaagagacaatcgacatgcttgcgtcacttggaatggctgatattcctggtgttgtgaagcagactattgagccacagggggctgtggcccctacttatggccggggtgctgctggttttggcaggagatattgattgttgacatggttttggttttttccctgggcggtgattatgaagtcttactggttttctgtcctgaactctaattgtgtttttctatatatgcagactagagctatgttaaaagtaaacaggcctatatgaattatgaatccttatttctttgcaatcctttcatattacctggtgctattctttactgtgggagctatgaactatgattatgttatggttaattatac

SEQ ID NO: 1040 - DNA, 749 bp, Platanus occidentalis
tatctcccttcctcctctaccctctccccctcttccgcggcagctgcaatcatgggtcgggttcgcaccaagacagtgaagaagtcctcacgacaggtgatcgagaggtactactcgcgaatgaccctggacttccacaccaacaagaagatcttggaggaggtcgccatcatcccctccaagcgcctccgcaacaagattgctgggttctctacccatctcatgaagcgcattcagaaaggcccagttcgtgggatctctctgaaactccaggaagaagagcgcgagcgtcgcatggacttcgtgcctgacgaatccgccatcaagaccgatctcattgaggttgataaggagaccatcgatatgcttaatgccctcggcatgtcggaccttcccggcgtcgtcaagcaggctgagccagctcttgcacctgcaccggctttcggtaggggctctggcggcatcggtggggggcctggacggagatattgaagtgttaagcgttcatgggttgaaggtggagaaggttagtggtagttatagtagtagtcgggggcttttttgttggttctgttttgatggttgtttcagttatggtaactgggttttatgagatttgctttaagaggaagaatatagttttatttggacttgtagtagatcgcttcggttgtctcgatgaagagatttgaatttttgctgactataattttgtttaagattcattgtgaatggaaaatgctgggtat

SEQ ID NO: 1041 - DNA, 1463 bp, Beta vulgaris
  misc_feature (654)..(654): n is a, c, g, or t
  misc_feature (657)..(657): n is a, c, g, or t
  misc_feature (660)..(660): n is a, c, g, or t
  misc_feature (665)..(668): n is a, c, g, or t
  misc_feature (1308)..(1308): n is a, c, g, or t
atattttattaaaaaaaaaaagcctgtttttttaagagaaaaatttttaaaaaggcttgtttttaaagggtctaaaaaaagtttttttaaattttcccaacaaccctttttgggaagctttgttatttatattttcaagacaatttttccccaagtttaaaaaacccaaattgtctaattcgctggaaaggcctttgggccttgatttcttaaatttccctttccttcagccagttggggaattttcctaaattagcacaaattccccttttaaaagcccatttccgggaataaaaaaggccatgggacagtttgctccttggccctttggatccaagatagggaaaacctatgggtatttccagccccccaactttttggcttgggccctatttcccagtttctccccgggggatcagaaagggctttatttcccgcttgggccggggagtcttgcccagaagaagggggggcagattccccatggcataagcagaatggtagagtaaatactttttttgatccatttggtaaggcccgaatgtaaaagttccaattccatctggaacgaggctctgcaattcgagctttgcgtatgacgtatgagaggtcccagatcccagaggttctaaaggaattcaatttgcttatganccncgngccgnnnncgcacgaggcgctgaagcagcagccgctcaaacctccctcgtcgctctctaccttctccttcttcaggtaagttgtttttaagcttctcaaaatgggtcgtgtccgaacaaagaccgttaagaagtcttctcgtcaagtcattgagaggtattactctcgaatgacgttggatttccacaccaacaagaaggtattggaggaagttgccatcattccctcaaagcgtttgcgcaacaagattgctgggttttccactcatctgatgaagagaattcaaaagggtcctgtccgtggaatttctctgaaattgcaagaggaagagcgtgagaggcgtatggactttgtgcctgctgagtctgctatcaaggttgactcaatccccgttgacccagagaccattgacatgcttgctgctcttgggatgtctgaacttcctggaattgtcaaagctgaaccagaggttatggcacctgccccagctttcggccgtggagctggtgggcttgggaggaggtactaggtttactattgaatttttctgtgctgtgcaagaactagtagatcgaaagctgccctttaccgggctcatttctctgtttcctagatggtccctgtggatcttttgattttgttctgtanaatagagtgctgatgttagtaagacttgcatcaatattgccatacagttttttttggtggattctcacggttgtgtaacttgagttaattttatattgtcaagtcgctctatgctcttgtgtttgggacgtgatgatgttttttatatgggtcaa

SEQ ID NO: 1042 - DNA, 861 bp, Manihot esculenta
aggtaacctaatcaggccgcttttttgcttcttctttcagctctagcttccgcggtcatctctccattgcatagctttgcgctgcgctttttcaagaaacaacttactgttgaagatgggtcgtgttcgcaccaagactgtgaagaagtcctctcgccaggtcattgagaggtactactctaaaatgaccttggacttccacaccaacaagaaaatcttggaagaggttgctatcatcccctcaaagcggcttcgtaataagattgctggattttccacccaccttatgaagcgtattcaaaagggttctgttcgtggtatctctttgaaacttcaagaggaagagcgtgagcgtcgcatggactttgtgccggaagagtctgccattaagattgatgagattaaggttgataaggagacaattgacatgcttgctgctcttggtatgtctgatattccggggcttgttgaatttgagcctcagccattggttcctcctcaagtctttggtaggggtccagctggtgcacctaggaggttctgaggtaattgagctttacaggatgttcagatatgagaacttagatgtcattttgttagtagttctttatgcgttttaatgtgcttgtctgtgaaattatcctaaatggatcattattagagagtttaaattggatatttttagttgacattgaagttaaaggatgacactggggttgatgtgatgcagacacctaaggcctttcctgccattgtccaattattttctccattctgtcttatatttaacgactgactctcatggatattgtttgttggtgtgcaataaatggtgatttgattgatcattgatacgttacc

SEQ ID NO: 1043 - DNA, 762 bp, Carthamus tinctorius
agaggatagtgtaggccgctgttcttcgccggaacaaccactacagtttgagataaaccaccaggaagggctaaagaatgggtcgtgttcgaaccaagactgttaaaaaatcctctagggtagtgatcgagaggtattatgggaagatgactctggacttccacacgaacaaaaagattttggaagaagttgccatcattccatcgaagcgtcttaggaacaagattgctggtttctctactcacttgatggagcgtatccagaaggatccggtgaggggcatctcgttgaagctccaagaggaagaaagggagcgtcgcatggactttgtgcccgatgaatccgccattaagacggatctgattgaggttgataaggagaccattgaaatgcttactgcccttggcatggctgatctccctggggttgttaaggcatctgttgaaccacaggctttgccatcactccctgcttttggtaggggtggtgctccaaggagatattgaagatctttttcgggtaatctccattttattcgatagttttctcgcatgattattttagtgatgtaagttattggtcttatgtagttggtccaagttttgatgtacaatctcctatttatagaggtttgaagtaatgttacgatgtcgagttgaggggtaggtttgcaagcgaattttataccaggctcgagtttgtataactttttcaatgtaaggatggagcttgagcttgaatatctttttgagccattgaatc

SEQ ID NO: 1044 - DNA, 615 bp, Helianthus annuus
aaacaaaccctagctacacacattatcctctaaccgtcgccggagcaggagcaggagcaggagcagttacacatcgccggagcagcaaaccatgggtcgagtccgcaccaaaaccgtgaagaaatcctctcgtcaagtaatcgaacgctactactcaaaaatgacactcgatttccacacaaacaagaagatcttagaagaagttgcaatcattccgtcgaagcggctccggaacaagatcgctggattctcaacgcatctgatgaagcggatccagaaaggtccggtgagagggatctcgttgaagctgcaggaggaggagagagagaggcgtatggactttgttccggatgaatccgcaattaaagtggataggattgaggttgataaggagacgattgagttgttggcttcacttgggatgagtgagatgccggggattgtgctcaaggaggatacgccggtggtttccgctgggattcctggtggttatggtggagcacgtggtggaaggaggtactgagaggttaatggtactgtttttttgttttgaattagggtttttatgttaaacatgttttgagttttgttatggattaaagtttaaaactttga

SEQ ID NO: 1045 - DNA, 733 bp, Catharanthus roseus
cttcccctcctcccttccgccgccgctgcagcagtcaccgccgttcggagcagagccatgggtcgtgttcgtacaaagacagtgaagaagtcctcccgacaagtgattgaacgctactactctaagatgactctggattttcacacaaacaagaaggttctcggagaagtagccatcattccttcaaagaggctccgcaacaagattgccggattctccactcacctcatgaagcgtatccaaaaaggtccggtgagaggaatctcgctcaaacttcaagaggaggagagagagcgccgtatggatttcgttcctgatgaatctgcaattaagactgataggattgaggtcgataaggaaaccattgatttgcttgctactttgggtatgagtgatttgcctggtattgttctcaaggaggatgaggctccagtcatggttgctccgcctatgggttttggtggccgtagaaggtattaaaatggttggaaagttaagtttttgttcagattgagatgaagttgtcctttttattagtaatgggttatttttagttttgctggaagtactgtggccgactcctttattgttatttttatatttcaaacttaattctggaacaattttgagcaatgtcatggaaatgtctgaagtttatagatgctattaccagttgagtttcattattaacttttaatacctaggaaaaaaaaactagaggcgtggtcggcgt

SEQ ID NO: 1046 - DNA, 682 bp, Tabernaemontana elegans
aatcctctcctccgcttcaagtgcctcttgcttctccccgcaccctcctcgcctatcgcctttcgcctctcggagcagagccatgggtcgcgtacgtaccaagaccgtgaagaagtcctctcggcaggtgattgaacgctactactcaaagatgaccttggacttccatacgaacaagaagattcttacagaggtagccatcattccctcgaagaggctccgcaacaagattgctggattctccactcaccttatgaagcgtattcaaaagggttcagtgaggggtatctcactgaagcttcaagaggaggagagagagcgccgcatggactttgtccctgatgaatccgccattaagaccgataggattgaggtcgataaggagaccattgacttgcttgctactttgggaatgagtgatttacccggtattgttctcaaggaggagcaggctcccgtcatggtggccccgcctatggcttatgggggtggccgtaggaggtattaaaatggtcggaaattaagttttgttgagactgattttgtccttttcaataatgggttgttaattttgctgaaagtgctatcgagacttctttaattttgtttttgtattttaaacttcatgttggaacagttttgagcattgtctatttaaatggaaatgtcggaaggatatata

SEQ ID NO: 1047 - DNA, 731 bp, Catharanthus roseus
  misc_feature (24)..(24): n is a, c, g, or t
ggcacgagggcttcaattgcctcntgcctctcccagaacttcccttcccctcctcccttccgccgccgctgcagcagtcaccgccgttcggagcagagccatgggtcgtgttcgtacaaagacagtgaagaagtcctcccgacaagtgattgaacgctactactctaagatgactctggattttcacacaaacaagaaggttctcggagaagtagccatcattccttcaaagaggctccgcaacaagattgccggattctccactcacctcatgaagcgtatccaaaaaggtccggtgagaggaatctcgctcaaacttcaagaggaggagagagagcgccgtatggatttcgttcctgatgaatctgcaattaagactgataggattgaggtcgataaggaaaccattgatttgcttgctactttgggtatgagtgatttgcctggtattgttctcaaggaggatgaggctccagtcatggttgctccgcctatgggttttggtggccgtagaaggtattaaaatggttggaaaagttaagtttttgttcagattgagatgaagttgtcctttttattagtaatgggttatttttagttttgctggaagtactgtggccgactcctttattgttatttttatatttcaaacttaattctggaacaattttgagcaatgtcatggaaatgtctgaagtttatagatgctattaccagttgagtttcatatt

SEQ ID NO: 1048 - DNA, 639 bp, Gossypium hirsutum
ccgccacagatccaagcaatgggccgcgtccgtaccaaaacagtgaagaaatcctcccgtcaggtcatcgagcgctactactctcgcatgaccctcgatttccacactaacaagaagatcatcgaagaagttgccattatcccatccaagaggctccgcaacaagatcgccggcttctcgacccatttgatgaaacggatccagaggggtccggttcgcggcatttccttgaagctccaagaggaagagcgtgagcgccgcatggatttcgtccccgatgaatcggccatcaaggtcgaccaaatcgaagttgataaggaaactcttgatatgctttcggttcttgggatgtctgatattccggggcttgttaaggttgatccagtcgccgttgttcctcaaatcgggttcggccgtggtggtggacccggaaggaggttttaattggttagtgtccgtctatttgatgggttcttaattttaagttcattatgttttattttttgggtagtatttaaattttgtggttcttgttggaacaatattagtttttatgttaaatggtactggaatttgttgagtttgatgtgcgctttctttttaaaagcatttgaaatgagaatctttttagtttctgcg

SEQ ID NO: 1049 - DNA, 829 bp, Quercus alba
atggggatctttaacccataatatataggctttcgttttccccacccgtctttggcagccgcagcctctcttcctcactctctccttcgcagaggcactctcggctcttcatctctttccggaacagctaattctctaaaatgggtcgtgttcgcaccaagactgtgaagaagtcttcccgccaggtcatcgagaggtactactcgaaaatgaccctagacttccacactaacaagaagatcttggtggaggttgccatcataccctcaaagaggctccgtaacaagattgctggattctctacccacctgatgaagaggattcaaaagggtccagtgcgaggcatctcattgaagctacaagaagaggagcgtgagcgccgaatggactttgtgccagaagagtctgccattaaaaccgacctgattaataaggagacccttgacatgcttgcttctcttggcatgtctgatatgcccgggcttgaagaagttgaactacagcctgttattccagcccaggtgtttggtcggggtgctggtggccctaggaggtactgaggtaactcggtgggggttttgataaccaaatatattagctgttattgaaatattgggtaccttttttttttgttaattttgatactggtactaatgataaagtaagcagatcttattttatggttgtttgtgaactttgagtgcgatacccctagcttatttaatggagattctgaatcttgttatggttcatggttatgtgcaattgtgcttggctttgctatcaagtggtatcattttgtgtatgcacatttgagataattaatgcg

SEQ ID NO: 1050 - DNA, 828 bp, Quercus alba
atggggatctttaacccataatatataggctctcgttttccccacccgtctttggcagccgcagcctctcttcctcactctctccttcgcagaggcactctcggctcttcatctctttccggaacagctaattctctaaaatgggtcgtgttcgcaccaagactgtgaagaagtcttcccgccaggtcatcgagaggtactactcgaaaatgaccctagacttccacactaacaagaagatcttggtggaggttgccatcataccctcaaagaggctccgtaacaagattgctggattctctacccacctgatgaagaggattcaaaagggtccagtgcgaggcatctcattgaagctacaagaagaggagcgtgagcgccgtatggactttgtgccagaagagtctgccattaaaaccgacctgattaataaggagacacttgacatgcttgcttctcttggcatgtctgatatgcccgggcttgaagaagttgaactacagcctgttattccagcccaggtgtttggtcggggtgctggtggccctaggaggtactgaggtaactcggtgggggttttgataaccaaatatattagctgttattgaaatattgggtacctttttttttgttaattttgatactggtactaatgataaagtaagcagatcttattttatggttgtttgtgaactttgagtgcgatacccctagcttatttaatggagattctgaatcttgttatggttcatggttatgtgcaattgtgcttggctttgctatcaattggtatcattttgtgtatgcacatttgagataattaatgcg

SEQ ID NO: 1051 - DNA, 828 bp, Quercus alba
atggggatctttaacccataatatataggctctcgttttccccacccgtctttggcagccgcagcctctcttcctcactctctccttcgcagaggcactctcggctcttcatctctttccggaacagctaattctctaaaatgggtcgtgttcgcaccaagactgtgaagaagtcttcccgccaggtcatcgagaggtactactcgaaaatgaccctagacttccacactaacaagaagatcttggtggaggttgccatcataccctcaaagaggctccgtaacaagattgctggattctctacccacctgatgaagaggattcaaaagggtccagtgcgaggcatctcattgaagctacaagaagaggagcgtgagcgccgtatggactttgtgccagaagagtctgccattaaaaccgacctgattaataaggagacacttgacatgcttgcttctcttggcatgtctgatatgcccgggcttgaagaagttgaactacagcctgttattccagcccaggtgtttggtcggggtactggtggccctaggaggtactgaggtaactcggtgggggttttaataaccaaatatattagctgttattgaaatattgggtacctttttttttgttaattttgatactggtactaatgataaagtaagcagatcttattttatggttgtttgtgaactttgagtgcgatacccctagcttatttaatggagattctgaatcttgttatggttcatggttatgtgcaattgtgcttggctttgctatcaattggtatcattttgtgtatgcacatttgagataattaatgcg

SEQ ID NO: 1052 - DNA, 703 bp, Linum usitatissimum
gctccagctttgttatcctttcggaactcaggaggcggcagcagcagtggagtcaggcaaccatgggtcgagttcgtaccaagaccgtgaagaaatcctcccgccaggtcatcgagcgttactactcgaagatgactctcgatttccacaccaacaagaagatccttgaggaagtggcaattattccttccaagcgcctccgcaacaagatcgccggattctccactcacctgatgaagcgtatccagaagggtccagtccgtggaatctccctcaagctccaggaggaagagcgcgagcgccgcatggacttcgtccccgaggagtccgccatcaggactgacaagatcgaggtcgacaaggagactatcgagatgcttactgcactggggatggccgactgtccgggaatcgttgaggtcgatcctattgccgtcagcgttccgcagttcggctttggaaggggtgctggtcgtgggaggtactgaaatgttaaaatggttgggttttcaggaatgactatcttgtttggctcttagctttgttaatcgaagaattcgaatttgatgctcgtggtaatttttggttaattgttttggatactgtaatgcttttatagtttgttgttctgttggtaatgcttgaattgaattccgcaaactgtttgctctttttcctggtcgatttaagatgagttctactt

SEQ ID NO: 1053 - DNA, 661 bp, Linum usitatissimum
gttatcctttcggaactcaggaggcggcagcagcagtggagtcaggcaaccatgggtcgcgttcgtaccaagaccgtgaagaaatcctcccgccaggtcatcgagcgttactactcgaagatgactctcgatttccacaccaacaagaagatccttgaggaagtggcaatcatcccttccaagcgcctccgcaacaagatcgccggattctccactcacctgatgaagcgtatccagaagggtccagtccgtggaatctccctcaagcttcaggaggaagagcgcgagcgccgcatggacttcgtccccgaggagtccgccatcaggactgacaagatcgaggtcgacaaggagactatcgagatgcttactgcactggggatggccgactgtcctggaatcgttgaggtcgatcctattgccgtcagcgttccgcagttcggctttggaaggggtgctggtcgtgggaggtactgaaatgttaaaatgttagggttttcaggaatgactatcttgtttggctcttagctttgttaatcgaagaattcgaacttgatgctcgtggtaatttttggttaattgttttggatactggaatgcttttatagtttgttgttctgttggtaatgcttgaattgaattccgcaaactgtttgctctt

SEQ ID NO: 1054 - DNA, 669 bp, Linum usitatissimum
gctccagctttgttatcctttcggaactcaggaggcggcagcagcagtggagtcaggcaaccatgggtcgcgttcgtaccaagaccgtgaagaaatcctcccgccaggtcatcgagcgttactactcgaagatgactctcgatttccacaccaacaagaagatccttgaggaagtggcaatcatcccttccaagcgcctccgcaacaagatcgccggattctccactcacctgatgaagcgtatccagaagggtccagtccgtggaatctccctcaagcttcaggaggaagagcgcgagcgccgcatggacttcgtccccgaggagtccgccatcaggactgacaagatcgaggtcgacaaggagactatcgagatgcttactgcactggggatggccgactgtcctggaatcgttgaggtcgatcctattgccgtcagcgttccgcagttcggctttggaaggggtgctggtcgtgggaggtactgaaatgttaaaatgttagggttttcaggaatgactatcttgtttggctcttagctttgttaatcgaagaattcgaatttgatgctcgtggtaatttttggttaattgttttggatactggaatgcttttatagtttgttgttctgttggtaatgcttgaattgaattccgcaaactgtttgct

SEQ ID NO: 1055 - DNA, 696 bp, Platanus occidentalis
ttccaatctctcccttcgccgtctcactccctcaggagctgcaatcatgggtcgtgtgcgcaccaagacagtgaagaagtcctctcgacaggtgatcgagaggtactactcgcgaatgacgctggatttccacacgaacaagaaaatcctggaggaggttgccatcatcccctcgaagcgcctccgcaacaagatcgccgggttctctacccatctcatgaagcgcatccaaaagggaccagttcgtgggatctctctgaaactccaggaagaagagcgcgagcgccgcatggacttcgtacctgacgaatccgccattaaaactgatctcatcgaggtcgataaggagactattgacatgctcagtgccctcggcatgagtgatcttcctggtgtcgtcaagcaggctgagcccactctcgctcctgcaccggctttcggtcggggcgctgctggcgtgggtggtggacctggacggagatactgagatgttaagctttgatgggctgagtgggaagaaggttagtggtaatcgtagtagtagtaatcaggctttttgttggttcagtttcgacggattttacagttttttaatggtacttgggtcttactagttttgctttaagctgaaaagtacttcataatttggacatgtgtaatgtctctttgattgttttaatgaagagattggaagtt

SEQ ID NO: 1056 - DNA, 711 bp, Nicotiana benthamiana
  misc_feature (7)..(7): n is a, c, g, or t
  misc_feature (10)..(10): n is a, c, g, or t
  misc_feature (12)..(13): n is a, c, g, or t
  misc_feature (16)..(18): n is a, c, g, or t
  misc_feature (22)..(24): n is a, c, g, or t
  misc_feature (28)..(29): n is a, c, g, or t
  misc_feature (31)..(31): n is a, c, g, or t
  misc_feature (37)..(38): n is a, c, g, or t
  misc_feature (40)..(40): n is a, c, g, or t
ccccggngcngnngtnnnattnnncacnngncgcacnngngtcgtctccgctccaaatcttcaaggttcgtagcaagaagaatcagtaaggatgggtcgtgtacgcaccaagaccgtgaagaagtcatctagacaggtaattgagaagtactactcaaaaatgaccttggatttccacaccaacaagaagatcttggaggaagttgccataattccttcaaagcgtctccgcaacaagattgctgggttctccacccaccttatgaagcgcattcagaagggacctgttagaggcatctccctgaaattgcaagaggaggagcgtgagagacgtatggactttgttcctgatgagtctgccattaagactgatttgattgaggtcgacaaggagacccttgacatgctttcagctcttggcatgtctgaccttcccggtgttgtcaagcaggctgcagaaccacaggcagtggcagccctcccaacctacggtcgtggtgctggtggttttggcggcaggaaatactaagaacagattttaagacatcatgagcaaatttaaacttttggtagattacatgtgttagatctccctattttgttcaaggattatttgaagtcaagctcattttgttttatgttttgagagatgataaactgactgttcttgaatagtggttctaaatgcatgtgatttattttcctttcccc

SEQ ID NO: 1057 - DNA, 645 bp, Senecio madagascariensis
cttcttcaaatctcccctcggcaatctccggcgtaaccatcagaaacaagcatgggtcgagtccgtaccaaaaccgtgaagaaatcctcacgccaagtaatcgagcgttactactccaaaatgacactcgatttccacaccaacaagaaaatcctggaagaagtcgccatcatcccatccaagcgtctccgtaacaagatcgccggattctccactcacttgatgaaacgtatccagaaaggccccgtcagaggcatctcgttgaagctgcaggaggaagaacgcgaacgccggatggattttgttccagatgagtccgccattaaggttgaccatattgaggttgataaggagaccattgacctgctcgcctcccttggaatgagtgatttacctgggattgtgcttaaggaggatacgccggcggtcgcggctaccattcccggagcttatggtggtgcacgtggtggtgctgctcggactaggtattgattcatgacgtgccctacctgtttttagggtttatggttttctgtgttttgtattttaattttaattttgaacaatttatgtttaatgggatactttttatgtgtttttaattatgaagtttatgttatatgatatctactctgttttgatgtg

SEQ ID NO: 1058 - DNA, 756 bp, Nicotiana tabacum
tatattttttccgctgcaagcataacattgctcacttgccgcactcaagtcgtctccgctccaaatcttcaaggttcgtagcaagaagaatcagcgaggatgggtcgtgtacgcaccaagaccgtgaagaagtcatctagacaggtaattgagaagtactactcaaaaatgaccttggatttccacaccaacaagaagatcttggaagaagttgccataattccttcaaagcgtctacgcaacaagattgctgggttctccacccaccttatgaagcgcattcagaagggacctgttagaggcatctccctgaaattgcaagaggaggagcgtgagagacgtatggactttgttcctgatgagtctgccattaagactgatttgattgaggtcgacaaggagacccttgacatgctttcagctcttggcatgtctgaccttcctggtgttgtcaagcaggctgcagaaccacaggcagtggcagccctcccaacctacggtcgtggtgctggtggttttggcggcaggaaatactaagaacagattttaagacatcatgaacaaatctaagccgaaactttttggtaggtttcaatcttaaaaaaactgaaacttttggtagattacgtgttagatctccctattttgttcaaggattatttgaagccaagctcattttgtttatgttttgagagatgataaactcactgttcttgaatattggttctaaatgcatgtgatttattttccttaatt

SEQ ID NO: 1059 - DNA, 599 bp, Malus domestica
catgggtcgcgtccgcacaaaaacagtgaagaaatcctcccgccaggtgatcgagcgctactactcgcgcatgaccctggacttccacaccaacaagaagatcctcgaggaagtcgccatcatcccctccaagcgcctccgcaacaagattgccggattctccacccacctgatgaagcggatccagaagggcccggtccgcggcatctccctgaagctgcaggaggaggagcgcgagcgccgcatggacttcgtccctgaggagtccgctatcaagatcgacgagatctccgtcgacaaggaaaccatcgacatgctctctgctctgggcatggctgacatgcccggcgtcaagcgggtcgacccggaagcacagtctcagaatctggggttcgtgcgtggtggacccagaaggtactgaaacgggttttgatgctatactacatttggtttttggattaggaagaagttagcttgttgctaaatttctatgtgtttaattttattgaggaagcaatgcggatgatgtcttttgttatgggattatgttatatttgcattgagaatcgaaagcgttgcagttgatttcgtttgttgaa

SEQ ID NO: 1060 - DNA, 753 bp, Cucurbita pepo
ttttttccccggcgcctccactcaccgtcccctgcggacgatttccccggcagcaacatgggacgcgttcgcacaaaaacagtcaagaaatcttcccgtcaagtcatcgagcgctactactcgcgcatgactcttgacttccatacgaacaagaaaattctggaagaggtcgccattatcccctccaagagactccgaaacaagatagccggattctccactcacctcatgaagcggatccaaaagggacctgttcgcggcatttctctgaagcttcaagaggaagagcgcgagcgccgaatggacttcgtccctgatgtctccgccattaaaaccgatcaaatcgaggtcgacagggagactctcgatatgctttctgctcttggaatgaccgatattccggggctagttcaggtcgatccgactgtgccgcagcaggttgcatttggattgggcggtcgtggtaggaggtactgagattattggctagggttttgatttttaatttttaatctcattttcggttgaggctcagttttgtttatgaggattgttagtttctggtatgctaaaggttatggaatttacatattaatttcgaattatcaaattcaatagagagattttgtttcttctgggtctggctcggttgattcgtacattgtttaaatctttgtttgttggagtttatgaactcgagtcactttgagagaataatttagaaataatcaacttgaataaacaacaactttg

SEQ ID NO: 1061 - DNA, 738 bp, Solanum lycopersicum
gatatccacaaacacaaaaaccctaatatagtcttcaccattgctgaaaaaaaatcacagagagcatcagttgccgcacacagacggtgattcttcgattttctgctgcaaatctctgtctcgtctaaggaaattctgcaaggatgggtcgtgtgcgcaccaagaccgtgaagaagtcatctcgacaggtaattgagaggtactactccaaaatgacattggatttccacaccaacaagaagattttggaggaagttgctataattccttccaagcgtctccgcaacaagattgctggattctccactcacctcatgaagcgtatccagaagggaccagtccgtggtatctccctgaaactgcaagaggaggaacgtgagagacgcatggactttgttcctgatgaatctgccatcaagactgatctcattgaagttgacaaggagacccttgacatgctttcagccctcggcatgtctgaccttccaggcgttgtcaagcaggccgctgagccacaagcagtggcagctctcccatcatatggccgcggtggaggtggttttggacggaaatactaataagagaacagttacaatgatctcttatgatctattgaagaaactttttggtagattatatgtttagttttccctaatttttcttttaaagagtctttgaaactcattccagtgtttttgaaacataaatgatgaacaaccccttttggtgttaaaatgc

SEQ ID NO: 1062 - DNA, 769 bp, Tripterygium wilfordii
accgagctacctttctgctccctgctttcttgtttcttccgcacacacaacacacagagaagccaagcaccatgggtcgcgtccgcacaaagacagtgaagaagtcttcccgccaggtgattgagcgttactatccgcgcatgactatggacttccacaccaacaagaagctgttagaggaggtcgcaatcatcccttcaaagcgtctccgcaacaagatcgccggtttctctactcacctcatgaagcggatccagaagggtccggttcgcggtatctctctcaagctccaggaagaggagcgcgagcgccgcatggatttcgtccctgatgttagcgctatcaagactgaacagatcgaggtggataaggagactattgacatgcttgccgctctgggaatgagtgatatccccggaattgttcaggtcgagcctgctgcagcacctgctgcgccgatgggcttcggtaggggcgctggtgggcccggaaggaggttttaaggatttcatgtttcgtttaaatttgcaagctttgttttgtagcgttttctactctaaagttgtgttggtttctggacaattttgaggttatgttgaatgccctgaactctgtttattaagactatgagcttcaaaatattgttggagaattttgcagttattctcatggatttcaaagtattgttgtttattctgcagttattcagcttcaaaatcagagagtattgtgattgcgcggagaatttcatatttagtataggaattat

SEQ ID NO: 1063 - DNA, 695 bp, Malus domestica
ttcccttaccctctcctcacgcacagacgcacataccagcgccgtcgcctcccaaccccaccgcgcaaatccgccagcatgggccgcgttcgcacaaagacagtgaagaaatcatctcgccaggttatcgagcgatactactcgcgcatgaccctggacttccacaccaacaagaagatcctggaagaagtcgccatcatcccctccaagcgcctccgcaacaagatcgccggattctccacccacctgatgaagcggatccagaagggcccggtccgcggcatctccctgaagctgcaggaggaggagcgcgagcgccgcatggacttcgtccctgaagagtccgctatcaagatcgacgagatctccgtcgacaaggaaaccatcgacatgctctctgctctgggcatggctgacatgcccggcgtcaagcgggtcgacccggaagcacagtctcagaatctggggttcgtgcgtggtggacccagaaggtactgaaacgggttttgatgctatactacatttggtttttggattaggaagaagttagcttgttgctaaatttctatgtgtttaattttattgaggaagcaatgcggatgatgtcttttgttatgggattatgttatatttgcattgagaatcgaaagcgttgcagttgatttcgtttgttgaattaattgttttggtgttta

SEQ ID NO: 1064 - DNA, 697 bp, Malus domestica
cgttgctgtcgcacgcacagacgcacataccagcgccgtcgcctgccatctcctccgcgcaaatccaccaccatgggtcgcgtccgcacaaaaacagtgaagaaatcctcccgccaggtgatcgagcgctactactcgcgcatgaccctggacttccacaccaacaagaagatcctcgaggaagtcgccatcatcccctccaagcgcctccgcaacaagattgccggattctccacccacctgatgaagcggatccagaagggcccggtccgcggcatctccctgaagctgcaggaggaggagcgcgagcgccgcatggacttcgtccctgaggagtccgctatcaagatcgacgagatctccgtcgacaaggaaaccatcgacatgctctctgctctgggcatggctgacatgcccggcgtcaagcgggtcgacccggaagcacagtctcagaatctggggttcgtgcgtggtggacccagaaggtactgaaacgggttttgatgctatactacatttggtttttggattaggaagaagttagcttgttgctaaatttctatgtgtttaattttattgaggaagcaatgcggatgatgtcttttgttatgggattatgttatatttgcattgagaatcgaaagcgttgcagttgatttcgtttgttgaattaattgtttttggtgtttaaaaaaaa

SEQ ID NO: 1065 - DNA, 699 bp, Solanum melongena
attgaaagcatacgtttgctcagttgccgcactcgagtcctccgccgctccaaatctccaagtttcatactaagaagcgtcagcaaggatgggtcgcgtacgcaccaagaccgtgaagaagtcatccagacaggtaattgagaggtattactcaaagatgaccttggatttccacaccaacaagaagatcttggaggaagttgccataattccttcaaagcgtctccgcaacaagattgccgggttctccacccaccttatgaagcgtattcagaagggacctgttagaggcatctccctgaaattgcaagaggaagaacgtgagagacgtatggactttgttccagatgagtctgccattaagatcgatcttattgaggtcgacaaggagacccttgacatgctttcagcccttggcatgtctgaccttcctggtgttgtcaagcaggctgcagaaccacaagcagtagcagctctccccacctttggtcgtggtgctggcggttttggcaggaaatactaagaccctacctataagatgtgaacaaatttaaatcgagtttttggtagactacatgttttagatttatcgctctaattttgttcaaggatagttgtgccaaaattcatgttatttagttttgagatgatggtgacactcttgaatctttggttctaaatggacgttatctatttccg

SEQ ID NO: 1066 - DNA, 842 bp, Solanum melongena
aatgtagtattcaccattgctgaaaaaggaaaaaatcacacggagcaatcagttgccgcatacacgacggtggttcttcgtctttctacttccaaatctttgtcttgcctaaggaaattctgcaaggatgggtcgtgtgcgcaccaagaccgtgaagaagtcatctcgacaggtaattgagaggtattactccaaaatgactttggatttccacacaaacaagaagatcctggaggaagttgccataattccttccaagcgtctccgcaacaagattgctggattctccacccacctcatgaaacgtatccagaagggaccagttcgtggtatctccctgaaactgcaggaggaggagcgtgagaggcgcatggactttgttcctgatgagtctgccatcaagaccgatctcattgaagttgacaaggagacccttgacatgctttcagccctcggcatgtctgaccttcctggcgttgtcaagcaggctgctgagccacaggcagtggcagctctcccaacatatggtcgcggtgcagggggttttgggcgaaaatactaaaaagagaacagtttttggtagattatatgttagttttacctaatttgctttaagggagagtctttggaactcatttcattgttgacacatgatgaacaacccccttttggtgttaaaatgcatttgatacatttcctcaattacaatcattttgctgctggcaaatcttccttgtgttatgggaatatttgctcgaatacttgtgagtgatgcttatttggatcgtgttataaatgctcttaatggatcgtggaaatcatcaaagatttgaccttagtat

SEQ ID NO: 1067 - DNA, 880 bp, Arachis hypogaea
caacgcagagtacggggggcctcccccgactctcctctctcgtgttgagaagaagaaaaagaagaagaagaagaaagaaaaaacagagagagaatggggcgcgtgagaaccaagacagtgaagaaatcttcacggcaagtgatcgagaggtactactctcgcatgactcttgacttccacaccaacaagaaggttctagaagaagttgccctcatcccttccaagaggctccgcaacaagatcgcaggcttctccactcacctcatgaagcggatccagaagggacccgtcagaggcatctccctcaagcttcaagaagaggagagggagcgtcgcatggacttcgttcctgatgtgtccgctattgacactcaacacatcgaggtcgacaaggaaaccattgacatgcttcagtctctaggtatgtccgacatccctggaatcactcaggtcgatcccgttcctgttcagcagatcccctttggtcgccctggcgctggattcggtggtgctcagaggaggtactgagaaaacagacaaattttctatgttttggaattgtattatcgatattagggtttttaatttgggggaaaagtaatgttatcttatatgtttgaacttaatactggtttagtggaaatgaagaatttctgcgaattaggtttttgaggataaatttgtgtggcttgattttagttaatatttgttatgaacttataattagaggcaatatattggtgaaattgtgatgaaactgaaatatatgccgattaggttttgttacttaaatttgtgcatgcttcacgaattctgtggggtgtgttatgcttgaaacttataatcggtggatgttgtgatgccaaacttaaagtataat

SEQ ID NO: 1068 - DNA, 864 bp, Arachis hypogaea
gcctcccccgactctccgctctcgtgttgagcagaagaagaagaagaagaaagaaagaaaaaacagagagagaatgggccgcgtgagaaccaagacagtgaagaaatcttcacgccaagtgattgagaggtactactctcgcatgactcttgacttccacaccaacaagaaggttctagaagaagttgccctcatcccttccaagaggctccgcaacaagatcgcaggcttctccactcacctcatgaagcggatccagaagggacccgtcagaggcatctccctcaagcttcaagaggaggagagggagcgtcgcatggacttcgttcctgatgtgtccgccattgacactcaacacatcgaggtcgacaaggaaaccattgacatgcttcagtctctaggtatgtctgacatccctggaatcactcaggtcgatcccgttcctgttcagcagatcccgtttggtcgccctggcgctggattcggtggtgctcagaggaggtactgagaaaacagacagtttttctctgttttggaattgtattatcgatattagggtttttaatttgggggaaaagtaatgttatcttatgtttgaacttaatactggtttagtggaactgaagaatttctgcgaattaggtttttgaggataaatttgtgtggcttgattttagttaagatttgttatgaacttataattagaggcaatatattggtgaaattgtgatgaaactgaaatatatgccgattaggttttgttacttaaatttgtgcatgcttcacgaattttgtggggtgtgttatgcttgaaacttatcattggtggatgttgtgatgccaaacttaaagtataataatttt

SEQ ID NO: 1069 - DNA, 497 bp, Petunia hybrida
aaatctttgtttggtttaaggaggaggttctgcaaagatgggtcgtgttcgcactaagaccgtgaagaagtcgtctagacaggtaatggagaggtattactccaaaatgactctggatttccacacaaacaagaagatcctagaggaagttgccataatcccatccaagcgtctccgcaacaagattgctggcttctccacccacctgatgaagcgtatccagaagggacctgttcgaggtatctccctgaaactacaggaggaggagcgtgagagacgcatggactttgttcctgacgagtctgccatcaagactgatcttattgaagttgacaaggagacccttgacatgctttctgccctcggcatgtctgatcttcctggtgttgtcaagcaggctgctgagccacaggcagtagcagctcttccaacatttggtcgcggtgcagggggttttggcaggaaatactgataagtgtagtttcgcagatgttgtg

SEQ ID NO: 1070 - DNA, 616 bp, Cajanus cajan
gagtacgggggggcctcaaagtcggtaagctgtgtttctcctgcaagcaatatggggcgcgttcgcacgaagacggtgaagaagtcgtcgcggcaagtgatagagaggtactattcgcgcatgacacttgatttccacacgaacaagaaggttctggaagaggtggcaatcattccctccaagaggctgcggaacaagatcgcgggattctccacgcacctcatgaagcggattcagaagggtcccgttagaggaatatcgctcaagctgcaggaggaggagagggagcgtcgcatggacttcgtccccgatgtctccgccatcgccaccgaccacatcgaggtcgacaaggagaccctcgacatgctcgccgccctcggaatgtccgagattcccggcgttgtccaggtcgatcccgtccccgttgccgcgccgctccccttcgcccgtggcgccgggaggaggttttaatgcctgaattctcggttttggtcgtgttgtgttttagagaactaattattatgctgagttttgtattacttttttgttttctgtagcagggattcggttgttggacttgtgaaagtggttaatggaatttatttttgttctgctg

SEQ ID NO: 1071 - DNA, 672 bp, Solanum tuberosum
agttgccgcacgcacgaaggtgattcttcgtctttttgctgcaaatctctgtttcgtctaaggaaattctgcaaggatgggtcgtgtgcgcaccaagaccgtgaagaagtcatctcgacaggtaattgagaggtactactccaaaatgactttggatttccacacaaacaagaagatcctggaggaagttgccataattccttccaagcgtctccgcaacaagattgctggattctccactcacctcatgaagcgtatccagaagggaccagttcgtggcatctccctgaaactgcaagaggaggaacgtgagagacgcatggactttgttcctgatgaatctgccatcaagactgatctcattgaagttgacaaggagacccttgacatgctttcagccctcggcatgtctgaccttccaggcgttgtcaagcaggcagctgagccccaagcagtggcagctctcccaacatatggtcgcggtgcaggaggttttggacggaaatactaataagagaacagttacagtgatcttatggtctattgaagtaactttttggtagattatatgttagttttccctattttttcttttaaggagtctttgaaactcattccagtgttttgagacataaatgatgaacaacccccttttggtgttaaaatgcattt

SEQ ID NO: 1072 - DNA, 745 bp, Solanum phureja
gatatccacaaacacaaaaaccctaatatagtcttcaccattgctgaaaaaaatcacagagtatcagttgcctcacacacgaaggtgattcttcgtctttttgctgcaattctctgtttcgtctaaggaaattctgcaaggatgggtcgtgtgcgcaccaagaccgtgaagaagtcatctcgacaggtaattgagaggtactactccaaaatgactttggatttccacacaaacaagaagatcctggaggaagttgccataattccttccaagcgtctccgcaacaagattgctggattctccactcacctcatgaaacgtatccaaaagggacccgttcgtggcatctccctgaaactgcaagaggaggaacgtgagagacgcatggactttgttccggatgagtctgccatcaagactgatctcattgaagttgacaaggagacccttgacatgctttcagccctcggcatgtctgaccttccaggcgttgtcaagcaagccgctgagccacaagcagtggcagctctcccaacatatggtcgcggtgcaggaggttttggacggaaatactaataagagaacagttgcaatgatcttatggtctattgaagaaactttttggtagattatatgttagttttccctaatttttcttttaaggagtctttgaaactcattccagtgttttgagacataaatgatgaacaaccccctttttgtgttaaaatgcatttcatacatt

SEQ ID NO: 1073 - DNA, 956 bp, Fragaria vesca
ctcaagccgtctcctcccaaaccccaaccctcacacacacagggagctccaccgccgccgcagcagccatgggacgcgtccgcaccaaaaccgtgaagaagtcctcccgccaagtcatcgagcggtactactcccgcatgaccctcgacttccacactaacaagaaggtcctggaagaagtcgccatcatcccatcgaagcgcctccgcaacaagatcgccggattctcgacccatctcatgaagcgcatccagaagggccccgtccgcggcatctccctcaagcttcaggaggaggagcgcgagcgccgcatggacttcgtccccgatgagtctgccatcaagactgacgacatcgccgtcgacaaggagactcttgacatgctcactgctctcggcatgggtgatattcccggtgtcagggtcgaatccactgatctgcaggctgctccggtcgggtacggccgcggcgggcccaggaggtactaggaactggaccggagagttgtgtctttggtttttttttttttgatgttatagtacatttggttttcggattaggaactgttgtctaatttgctatgcttttttgagtttggattatgaactggtgctttgttgtttatgcgaatttctgttctggattaagattttgaagcatgcggatttatatttatggtgctgcgaatctgtgctaatgtttcttataatttgttaattttggttgacagatgctatatggggttaattgttgatgttatcagtctatttaggaatcattatattagggtttagatttgagtttccttggttccacaaatgatattgtggcttcagtggtgttcacatgaaatgatgtgaacactactgtactggcttttaagttccatgagatgatattgtgtctttaagttccaggaaatggagcgatcagcaatgaaatgggctgttagtttg

SEQ ID NO: 1074 - DNA, 760 bp, Nicotiana tabacum
gcaagcataacattgctcacttgccgcactcgagtcgtctccgctccaaatcttcaaggttcgtagcaagaagaatcagcaaggatgggtcgtgtacgcaccaagaccgtgaagaagtcttctagacaggtaattgagaggtactactcaaagatgaccttggatttccacaccaacaaaaagatcttggaggaagttgccataattccttcaaagcgtctccgcaacaagattgctgggttctccacccaccttatgaagcgcattcagaaggggcctgttagaggcatctccctgaaattgcaagaggaggagcgtgagagacgtatggactttgttcctgatgagtctgccattaagactgatttgattgaggtcgacaaggagacccttgacatgctttcagctcttggcatgtctgaccttcccggtgttgtcaagcaggctgcagaaccacaggtagtggcagctctcccaacctatggtcgtggtgctggtggttttggcggcaggaaatactaagaacagattataagacctcatgaacaattctaagctgaacctttttggtaggtttcaatctttaaaaaacgctgaaacttttggtagattacatgtgttagatctccctattctgttcaaggattattagaagccaacctcattttgtttatgttttgagagatgataaactcactgttcctgaatcttggttctaaatgcatgtgatttattttccttaattacatttgctgctgcc

SEQ ID NO: 1075 - DNA, 852 bp, Nicotiana tabacum
  misc_feature (89)..(89): n is a, c, g, or t
  misc_feature (91)..(91): n is a, c, g, or t
  misc_feature (96)..(96): n is a, c, g, or t
  misc_feature (118)..(118): n is a, c, g, or t
  misc_feature (156)..(156): n is a, c, g, or t
  misc_feature (268)..(268): n is a, c, g, or t
  misc_feature (280)..(280): n is a, c, g, or t
  misc_feature (283)..(283): n is a, c, g, or t
  misc_feature (295)..(295): n is a, c, g, or t
  misc_feature (373)..(373): n is a, c, g, or t
  misc_feature (419)..(419): n is a, c, g, or t
  misc_feature (460)..(460): n is a, c, g, or t
  misc_feature (478)..(478): n is a, c, g, or t
  misc_feature (485)..(485): n is a, c, g, or t
  misc_feature (490)..(490): n is a, c, g, or t
  misc_feature (496)..(496): n is a, c, g, or t
  misc_feature (540)..(540): n is a, c, g, or t
  misc_feature (556)..(556): n is a, c, g, or t
  misc_feature (622)..(622): n is a, c, g, or t
  misc_feature (627)..(628): n is a, c, g, or t
  misc_feature (630)..(630): n is a, c, g, or t
  misc_feature (633)..(633): n is a, c, g, or t
  misc_feature (651)..(651): n is a, c, g, or t
  misc_feature (659)..(659): n is a, c, g, or t
  misc_feature (665)..(666): n is a, c, g, or t
  misc_feature (668)..(668): n is a, c, g, or t
  misc_feature (673)..(673): n is a, c, g, or t
gctggaattacactttgctcagttggcgccgcacacgactgtggttcattctcttcagaaatcttgaaaagcaggtttggtccaagganantctgnaaggatgggtcgtgtacgcacnaagacagtgaagaagtcatctcgacaggtaattgagangtattactccaaaatgactttggatttccacacaaacaagaagatcctggaggaagttgccataattccttccaagcgtctccgcaacaagattgctggtttctccacccanctcatgaaacgnatncagaagggaccngttcgaggtatctccctgaaactgcaggaggaggagcgtgagagacgtatggactttgttcctgatgagtctgccatnaaaactgacctcattgaagttgacaaggagacccttgacatgcttncagccctcggcatgtctgatcttcctggtgttgtcaagcangctgctgagccacaggcngtagcanctctnccaacntatggtcgcggtgcaggaggttttgggaggaaatactaataggngagtattttcaaaganttgatggacaattgaagaagtttttggtagattaaatgtgttgttaggtttccctgatgttctttnagganncntanaagcttataattccgttnttgagacntaatgnnanacatntcctcaattacatacattttgctgcaggagaatgtgatcgctaccttatccttagattttaatttcatattgttgcaggtaggggtgtacatggaccgggttgatttggtttttatcaaaaccaaaccaaaccaactgtatcggtttgaattggttgggttttgtcggttttttttgtt

SEQ ID NO: 1076 - DNA, 739 bp, Solanum lycopersicum
gatatccacaaacacaaaaaccctaatatagtcttcaccattgctgaaaaaaaaatcacagagagtatcagttgccgcacacagacggtgattcttcgactttctgctgcaaatctctgtctcgtctaaggaaattctgcaaggatgggtcgtgtgcgcaccaagaccgtgaagaagtcatctcgacaggtaattgagaggtactactccaaaatgacattggatttccacaccaacaagaagattttggaggaagttgctataattccttccaagcgtctccgcaacaagattgctggattctccactcacctcatgaagcgtatccagaagggaccagtccgtggtatctccctgaaactgcaagaggaggaacgtgagagacgcatggactttgttcctgatgaatctgccatcaagactgatctcattgaagttgacaaggagacccttgacatgctttcagccctcggcatgtctgaccttccaggcgttgtcaagcaggccgctgagccacaagcagtggcagctctcccatcatatggccgcggtggaggtggttttggacggaaatactaataagagaacagttacaatgatctcttatgatctattgaagaaactttttggtagattatatgtttagttttccctaatttttcttttaaagagtctttgaaactcattccagtgtttttgaaacataaatgatgaacaaccccttttggtgttaaaatgc

SEQ ID NO: 1077 - DNA, 690 bp, Zostera marina
ggaagcagcagctgaaagaaatcgaaaacaacataaaacataatgggacgcgttcgcactaagaccgtgaagaagtcttcacgtcaggtaatcgagcgttattactcccgcatgacgcttgattttcacaccaacaagaaggtgttggaagaggtagcgataatcccatcgaagcgtctccgaaacaagatcgctgggttttcgactcatctgatgaagcggatccagcgtggtcctgttcgtgggatctctttgaaattacaagaagaggagagggagaggagaatggatttcgtacctgatgagtcggctatcaagtctgacggaatcgaggttgataaggaaaccattgagatgctggcgtcacttggaatgccagatcttcctggtgtcatcaagcaagccgatgctactcaggcgattggtgctcctttcggcgctggaggtgtacgtggtggtcgtggaggcggcaggtattagggttttttcaaaggattactactttatcattttttttgtttattactcggtaatgaaattaagtacaaggattacctatttatttttttaaagtatcccgttcattttcgcgaatcctatctttatatatttcttataaaaaaaccttatcagttgtcacgtttcttttttaatatgttgttgtttaataatatgtttatgctgttcttt

SEQ ID NO: 1078 - DNA, 676 bp, Euphorbia peplus
cagcagcttataattcaagatgggtcgtgttcgcaccaagacagtgaagaaatcctctcgccaggtcattgagaggtactactcaaaaatgactttggacttccataccaacaagaagatcttggaagaggttgccattatcccttcaaaaaggttgcgtaataagattgctggattctccacccatctgatgaagcgtattcaaaagggtccagttcgtggaatttctttgaaattgcaggaggaagagcgtgagcgtcgtatggacttcgtacctgaagagtctgccattaagattgatgagattaaggttgataaggagacaattgacatgcttgctgctcttggcatgtccgattttcccgggcttgttgaagttgaaccaacacctatgattgcccctcagggatttggtaggggtggtccagctggtggatttcagaggaggggttgattttgaggtaattataataggcacaagttgggatattatcattttgttacaagtttattcctgtctttgttctagataatatgctaaacggttttgagttatttgtctttaaattggaaacttctttgacattgaaaaggagatgaaggatgataatgtgttttagttgttttgatgtacatctttgagacatttcttgctctatttcaaatggtttcaagt

SEQ ID NO: 1079 - DNA, 785 bp, Euphorbia esula
  misc_feature (8)..(12): n is a, c, g, or t
cgagcgcnnnnntctccaactctctaactctactggttttcctaagaagcagaagcagcagcttataattcaagatgggtcgtgttcgcaccaagacagtgaagaaatcgtctcgccaggtcattgagaggtactactcaaaaatgactttggacttccataccaacaagaagatcttggaagaggttgccattatcccgtcaaagaggttgcgcaataagattgctgggttctctacacatcttatgaagcgtattcaaaagggtccagttcgtggaatttctttgaaattgcaggaggaggagcgtgagcgtcggatggactttgtaccagaagagtctgccattaagattgatgagattaaggttgataaggagacaattgatatgcttgctgctcttggcatgtccgattttccggggcttgttgaagttgaaccaacacctatgattgcccctcagggatttggtaggggtggtcctgctggtgggtttcagaggagaggttgatttggaggtaattacaatataatactcaagttgagagatattatcattttgttacaagttaattcttgtgtttgttctagataatatgctaagtggtgttttgttagactgttgagtgattttattcgtcttttaaactggaaatttctttgacgtcgaaaacgagatgaaggattatgatgggttttagatacttttttttatgtagatttttgagacactttatgctctcttaccttttgttttaaatatccggattgatttgcttgttgctag

SEQ ID NO: 1080 - DNA, 774 bp, Chelidonium majus
ctctctctctctagttgcaggaagctttccatactctcttcagggagcggcagcggcagcgagaatgggacgagtaagaaccaaaaccgtgaagaagtcctctcgacaggtgatcgagcggtactactcacggatgaccttagatttccacaccaacaagaagatcttggaagaggttgcaatcatcccttcaaagcgtctccgaaacaagattgctgggttctcaacccatctcatgaaacgaatccaaagaggtccagttcgtgggatctcactgaaacttcaagaagaagagcgtgagcgtcgtatggatttcgtaccagaggaatctgccattaaaactgatgttattgaagtcgacaaggagaccattgacatgcttgctgctctcggaatgtctgatcttcctggtgttgttaaggctgaaaccgctcttgctcctcccccaccttttgctcgtggtggtgctggtggtcaaggaaggagatactgagaacccccccaaaaggttttatgggttagtaatgattttagtagtttgttattgtaagatcttagtaccctaaaggtctttaattttttttaaattctcgttttaagatggagattgcattttgatttggacttgcagataattgctttagtttgtttttaatgggaattatgaaattttgctggttataattatggtaagcttggttttcatttggtttctgtagttgtgagaattattaagttttagggttgtgtattttgtcgcattttgtttatttc

SEQ ID NO: 1081 - DNA, 786 bp, Silene vulgaris
ctcgcactcgtctccatcctctctctcaaagcgcagccgcacacacagagccgccatctccaaaatcaaacatgggtcgcgtccgcacaaaaacagtgaagaaatcctcccgacaagtaatcgaaaagtactactccaaaatgacactagatttccacaccaacaagaaggttctagaagaagtcgccatcatcccatccaagaggctccgaaacaagatagccgggttttcgacccatttaatgaggcgtatccagaagggtccggttcgtgggatttcactcaagcttcaggaagaagaaagagaaaggcgtatggactttgtacctgatgtttctgctattaggactgatctaattgaggttgaccgtgagactattgagatgttggctgctcttggtatgtctgatttgcctggtttgtctgaggttgctcctgaaacttctctttctgctttgcctgctggtggatttggtcgtggtgccggtgctcctaggaggtattgagatggaccgattcgagtcgggttttgttttgtttaaggacatgttttagactgttgttttttaaaagttgagactttgttatggtttatgcaaatgttatcattttggttgactcagctacctcttgattattggctagacttattatggtgaaattccatctgtgttgtttatttgttaatgctttagtttgcactttgtttttatgctgatagattgataggatgtggcattattgttaacaaatgcatctaaccttgttagctgcattggtataact

SEQ ID NO: 1082 - DNA, 681 bp, Silene vulgaris
atcgcctttctcttccccatttccctgcatctcacagcacaactgcaaatctcaagctcgaaacattcgcaaaaatggggcgagtccgcacaaaaacagtgaagaaatcatcccgtcaagtaatcgaaaaatactactcaaaaatgaccttagatttccacaccaacaaaaaagtcctcgaagaagtcgccataatcccatcaaaacgtctccgtaacaagatcgcaggattctcaacccatctgatgaggcgtatccagaagggcccagttcgtggaatctccctcaagctccaggaagaagaaagagagcgtaggatggactttgtacctgatgtttccgccattaatactgaactcattgctgttgatagagagactattgagatgcttgctgctttgggtatgtctgatttgcctggtttgtctgaggttgctcctgaaactgtcaatcttgctgttcctggtgctggcttcggccgtggtgctggtggtcctcgtaggtactgatgatcattttggttttgattcgatgtcgggtttcgtatttttagggtttgatatgtcaaaggattgttttgatgttatgatgttttttttaatgtttttgagataatgagtagttgtctgttggattttgatggataatgttattatgttatgtcatggaatttcgattgtc

SEQ ID NO: 1083 - DNA, 840 bp, Manihot esculenta
ggttttgcttccacttaccaactccagcggcagcgtccatctctctcgtgccttagcttgcgcttctctttttcaagcaacagcttattattggagatgggtcgtgttcgcactaagacagtgaagaagtcctctcgtcaggtcattgagaggtactactctaaaatgaccttggacttccacaccaacaagaagatcttggaagaggttgctatcatcccctcaaagcggcttcgtaacaagattgctggattttctacccaccttatgaagcgaattcaaaagggttctgttcgtggtatctctttgaaactgcaagaggaagagcgtgaacgccgcatggactttgtgccggaagagtccgctattaagattgatgagattaaggttgataaggagacaattgacatgcttgctgcccttggtatgtcagatatccctgggcttgttgagtttgaacctcagcctttggttccatcccaggtctttggcaggggtccggctggtgcacctggaaggaggttctgaggtaattgaactttccaggatgttcaagtataagaacttttttaagtcatgttttagtagttactttctgtgtttgtccttgaaattatcctaaatgtatgagtgcttgatagtttaaaatggacatttttagttgatattgaaatcaaaggataacgcactagttcatttgatgcagatatccaaggcttttcttgccaatttttccattctgtctaatgttatcgacttcgtttttcatagtaattgtttattggatgtgctataaattgtggtttgattgatcggttggtagtaatggtgtttcccttc

SEQ ID NO: 1084 - DNA, 638 bp, Flaveria ramosissima
ctagctaccagcatcctctcctcatcatcaccggagcaaacagccactcgccgccgtgaaccatgggccgcgtccgtacaaaaacagtgaagaaatcctcaaggcaagtaatcgggaacgctactactcaaaaatgacgctcgatttccacacaaacaagaagattctagaagaagtagccatcatcccctcaaagcgcctccgcaacaagatcgccggattctccactcacctgatgaagcggatccagaaaggtccggtgagaggcatctcgctgaagctgcaggaggaagaacgagagcgtcgtatggactttgtgcccgatgaatccgccattaaaacggatcggattgaggtcgataaggagaccattgagctactggcgtcgttggggagtgagtgagctgcctggggtcgtgttgaaggaggatacgccgttggtggcgacggggatccctggtggttatggtggtggtcgtggtggaagaaggtattgatggattgaaggtaatttgttgtttacggtttttttggttagggttttggttgaacatgttatgattatatgctttatgttggattgaaggttaaagttagaagtttctgttatatgctactctatgctatgataatgtgtt

SEQ ID NO: 1085 - DNA, 615 bp, Amsonia hubrichtii
ccctcagccccctcccggagcagagccatgggtcgcgttcgtaccaagaccgtgaagaagtcctcacggcaagtgatcgaacgctactactcaaagatgacactggacttccatacaaacaagaagatccttacagaggtagccatcatcccctccaagagactccgcaacaagattgctgggttctcaacccaccttatgaagcgtatccaaaaaggtccagtgaggggtatctcactcaagcttcaggaagaggagagagagcgccgcatggactttgtccccgatgagtccgccattaaaaccgataggattgaggtcgataaggagaccattgacttgcttgctactttgggtatgaatgaattgcctgggattgttctcaaggagcaggaggcccccctcatggcggcgccgcctatggcttttggtggtggccgtaggaggtattaaaatggtcgggaattttaaattttgttgagatttatgttgtcccttttagtaatgagttgtttttagttttgctgaaagtgttactaagacgactcctttattgttacttttttaaacttaatgttggaacagttttgagcattggctatctaaatggaaatg

SEQ ID NO: 1086 - DNA, 453 bp, Primula obconica
acatgggtcgcgtgcgaaccaagacagtgaagaaatcttctcgccaggtcatcgagaggtactactccaagatgacaatggatttccacacgaacaagaaaatcttggaagaggttgctatcatcccctccaagcgtctccggaacaagattgcagggttctcgacccaccttatgaagaggattcagaagggtcccgtccgtggaatctccctgaagcttcaagaggaggagagagagaggcgtatggactttgtgcctgacgagtctgcaattaacatcgaaaaaatcgaagtggataaagagactatggaaatgcttgctaccctcggcatgggcgatcttcctggggtttttaaggctgtcgaggagcagcagtcggtacagcctgttgggtttggtcgtggtggaccaggtggcccaaggaggtactgagaggctcgtttgtttggtg

SEQ ID NO: 1087 - DNA, 597 bp, Acacia harpophylla
ggcgcagtggccggttttgcgcctgtgattgtttatcgttttcatctcagcgcctgacggagccaccatgggtcgcgtccgcaccaaaaccgtcaagaagtcttcccgccaggtgatagagaagtactactctcgaatgacattggacttccacaccaacaagaagattcttgaggaggttgctctcattccatccaagagactccgcaacaagatttccggattctcgactcatctcatgaagaggatccagaagggacctgttcgtggaatttctctcaagcttcaggaggaggagcgtgagcgtcgcatggatttcgtccctgacgtctccgccatcaagacagacctgatcgaggtagataaggagactctagacatgctcaatgctcttggtatgaatgatattctggggatcgtcaaagttgatcccgtcccagtgcagcagactttggggttcggtcgttgttttggcggagctaggaggtagtattaggttttggtcttcatcttcgcggttttggcatttgagtttatcgttagtcacttatatttatgtaatttaagttttacttctcaatccaatatttgaacttc

SEQ ID NO: 1088 - DNA, 784 bp, Lactuca sativa
  misc_feature (748)..(748): n is a, c, g, or t
cggggatgacacatacccagacaccctacttgtcactagagaaagggagttccccgccgttcttcaccggaacaaccgccacagcccacagaaggagctgaaagatgggtcgtgttcgtacgaagacagtgaagaaatcatctagggtcgtgatcgagaggtattacgggaaaatgactctggatttccatacaaacaagaagattttggaggaagttgcaatcatcccttcgaagcgtctgaggaacaagattgcaggtttttcaactcatctcatgaagcgtatccaaaagggaccagtgaggggtatatcgttgaagctccaggaggaagaaagggaacgccgtatggactttgtgcctgatgaatctgccattaaaaccgatctgattgaggttgataaggagacgattgagatgctggttgcccttgggatgggtgaccttcctggggttgtgaaggcggtggttgagccacaggctgtgccggctggccctggttttggtaggggtggtggttttactaggaggtattgagaagtgagaagaattgcttagtagagtaatttggttacttgattatttttagtgttatttgttttgatttacttttttttattttttgagatgtagaagaattattgattagtaaatttggattagtagaatctgcttggagatttccaattgattgtttaagttgttacaaaacattttaattactcaagttgtatgtcggctttgagttntgttgttgtctatgcgatttatcatttatgtgtaaa

SEQ ID NO: 1089 - DNA, 718 bp, Prunus persica
atctcttcagctgccgcactctatttgctccctgcgcctcctctctacttcctcgttcttaaccttcgctgttcggcactcattgcagaaagagctagttctgcaaaatgggtcgtgttcgtaccaagactgtgaagaagtcctcacgccaggtgatcgagaggtactactcaaagatgaccttggacttccacacaaacaagaagatcttggaagaggttgcaatcatcccctcaaaacgtctccggaacaagattgctgggttctccactcacctgatgaagcggattcaaaagggtccagtcaggggtatctcactgaaactgcaggaagaagagcgcgagcgtcgcatggactatgtacctgaacaatctgccatcaggactgaagaaatcaaggtcgataaggagacccttgacatgcttgctgctcttggcatggctgatcttcctggggtatctgaagctgagccacaggttatgatccctagccaaggttatggacggggtccacagggtggaaggaggttctgaggcaatggaagctttgtgttgtttatgagaatctggaatttagttatttaagtttgcattcggtagtagtgatatggcaaacatggatcttatttttgtattttaattgaatgttcgcttgacgttgagtttggaaaatggtacttttgtttattaaatggagttaacatgcttgtgtttatgca

SEQ ID NO: 1090 - DNA, 1575 bp, Theobroma cacao
gtccaagcaaaatcaaagcaaattattcttataatcacctcaatgagtttgcaattaagttttgaaaatatacaatccatttctattatgggttttactttacatgaaaagcaaaaagaaaaagaaaaaaaatatttcacgtatgcaaattttttttaactcgtacacatgacttgtttcagtaaacaggcctggtttaactctcgaggaatcacgctagaatgaaattgccccgcaaagctcagcccataagcatccttaacattggtatgggccaaaaattcccaattggactgtccataaatctcaggcccgaccggaaagatcctctcagagtataaaacccctacttccacaaaccaaaaaaccctaaccctaattttgtcttcccatctgcaaagcaccagcgagccacccagcctcccaaagaaccaaccatgggccgcgtccgcacgaagacagtgaagaaatcgtcccgccaagtgatcgagcggtactactcccgcatgaccctcgatttccacaccaacaagaagatcatcgaagaagtggctataatcccatccaagaggctccgcaacaagatcgccggtttctcgacccatctcatgaaacgtatccagaagggtcccgtgcgtggcatttctctgaagctgcaagaagaagagcgcgagcgccgcatggatttcgtccccgatgaatctgcaatcaaggtcgaccaaatcgaagttgataaggaaactcttgatatgctttcagttcttgggatggctgatattcctgggcttgttaaggttgatccggttgctgttccggttcctcaaatcgggttcggccgaggtggtggaccggggaggaggttttaagtggtggggccccatggacttgatgggttcttaagtttgttatgtttcttttctttctgggtagtgtttaattttgtgtttttttgatggaacagttttagttgttatgttaaatggtactgaaatttattaagtttgatgtgtactttttttgaagatattcgaaatgggtaatttttagtttttggcatggttgattcccattgatttggtttattcttaattttattttagatattgagctagtatatggccttccaattcaagttgcattcaatcataatgctgagtaatgctgaataaggtaaagaattccaattctgtttatagggagtctgttttctatcgcaagcttttgttctgcaattttcattgacaatttttgcaggcaagaaactaaaaggattatctttgctttattacgttcatgacttaaagtgaagtatggttattagaatttggtttcaagaagtcttttgtaacccgttttgcgtccttaaagcagcttgtaggtttgtcacttattacattagtgttacgagcttgtaccattgaaagtaaactggaatgtgtgtttagcactcgtgcctaaaagctactaacttcctttcattatcaaacaattttgtatatatgtgattatagcatgttcagagagacagaaatattggaacttcttaatatttaacaatcaaataactctccaagt

SEQ ID NO: 1091 - DNA, 785 bp, Gossypium hirsutum
accctatcagtttctcattttcaagtctgcaaaacccctagccagccacttccccgccgccgctccgaaccatgggccgagtccgcaccaagacggtaaagaaatcctctcgccaagtgattgagaggtactactctcgcatgacccttgatttccacaccaacaagaagatcatcgaagaagtggctatcatcccttccaagcgtctccgcaacaagatcgccggcttttccacccatctcatgaagcggatccagaagggtcccgttcgtggcatctctttgaagctccaagaagaagagcgtgagcgtcgcatggatttcgttcccgacgaatccgccatcaaggttgatcaaatcgaagtcgataaggaaactctcgatatgctttcggttctcgggatggctgatattcccggccttgttaaggtcgatccggttgctgttgcggttccccaaatcgggttcggtcgcggtggtggacccggaaggagattttaagtggtgggtatccatggatttgatgggttcttaaatcttaagtttgttatgcttatttttggtagtttttttctctataattttatgttccatttttgaaccattatagttgtttcaaccttaattggtgcccaaacttattaagctttatgtgaacttgtttatgaaggtatttgaagggggtaattttcagtttttcccctctgaatatcatatttgactgatttgaatggttcttgttctgcaatcaattataaccaagaaattagaaagctggatcttagg

SEQ ID NO: 1092 - DNA, 980 bp, Gossypium hirsutum
atttttaagcttctgcaaaacaacagccaattactcttcagtctcagccgatcttaaaccatgggtcgcgttcgcacaaagacggtgaagaaatcgtcccgtcaggtaatcgagcggtactattctcgaatgaccctcgattttcacaccaacaaaaagattatcgaagaagtagctataatcccatccaagaggctccgtaacaagattgccggtttctcgacccatcttatgaaacgtatccagaaaggaccagttcgcgggatttctcttaagcttcaagaagaagagcgcgagcgtcgcatggattttgtccccgatgaatcggccatcaaggtcgaccaaatcgaagttgataaggaaacacttgatatgctttcggttcttggaatgggtgatattcccggccttgttaaggttgatccggttgctgtttcggttcctcaagttgggttcggtcgcggtggtggacccgggaggaggttttgagtggtgggtcttcatggatttcatgggttttttttaagcttctatgtttttttctctgttttggggtagtttctaattttgtgttttttatggaacagtactagttaagtggaactgaaattttatcaagtgtgatgtgtactttatttttgaagaaatctgaaatgggtaattttagtttctggtatggtcgactccattaatttttgtttttgaatttcattttagattctgagctaagagtttagttgtttgattgatgcccccatttgcattccaattggagtaatgaatgccaattctggttctgcagaaatttcaagcaagacgtgaaaaagatgtttgctttattaggtttatgtgtggtttaattccaaatttgtatgctttggtgctgtatcaatgcaaaattttcaatggaaattgtaagcaagaatttgataaggtgatctttgttgagctttaattaaaaagaaaaagtaccgactgcg

SEQ ID NO: 1093 - DNA, 756 bp, Taraxacum officinale
cgggacttgcgccatctgtgcaaaccccagcaaccctccggccgccgtcgcattatcgtctgcctccctcactccgacgtgaaatatgggtcgtgttcgtaccaaaaccgtcaaaaaatcgtcccggctagtaatcgagcgttactactccaaaatgacactcgatttccacaccaacaagaaaatcctcgaagaggtggccatcatcccatcaaagcgtctccgcaacaagatcgccggattctcaactcacttgatgaagcgcatccagaaaggacctgtcagaggcatctctctcaagctacaagaggaagagagagaacgtcgtatggactttgtccctgatgaatccgccattaaaaccgatcgcatcgaggttgataaggagactattgacttgcttgcatctcttggaatgagcgatcttcctggtattgtcgtcaaagaggacactccattggctgccacgatcccgggcgcttacggtggtggtcgtggtggatttggtggtggtgctagaaggtactgagtttgaaaattgtaggtcgattttaagtactttgaattacgtttggtttaagacagattatatgcactttgttcttcagattttgcctatggatgtttttgtttgatcaaattatatttcagtttcctaattgtctcctacatacttgtggattgcttttgagcatttgatagagttgaatgtttgtgcattgtgggcaaaaaaaaaaaaaaaggccgcctccgcct

SEQ ID NO: 1094 - DNA, 588 bp, Heritiera littoralis
gaactctagcatttgtctttcaactctgcagatctccagccacccactcagcctccaccgcccgaagccatgagccgcgtccgcacgaagacagttaagaaatcgtcccgtcaggtaatcgagaagtactactctcgcatgaccctcgatttccacacaaacaaaaagatcatcgaggaagttgctataatcccatccaagaggctccgcaacaagatcgccggcttctcgacccatctgatgaaacgcatccagaagggttccgtgcgtgggatttccctgaagctccaagaagaagagcgagagcgtcgcatggatttcgtccccgatgaatcggcaatcaaggtcgaccaaatcgaagttgatgaggaaactcttgatatgctttcggttcttgggatgtctgatattcctgggcttgttaaagttgatccggttgctgttccggctcctcaactcggcttcggccgcggtggtggacccgggaggaggttttaagcggtggatctccatggatttgatgggttcttaatcttaaatctgctttgttttttctgggtagttttccaattttgtgcgtgtgttttt

SEQ ID NO: 1095 - DNA, 3442 bp, Jatropha curcas
cttttctgttattaaaacgaataaaagataccttggaaggcctaaatatagaatagatcccggaatgtctcttagtaatgacgaatgacctctcacctgatttggtatagagttatagtaatatgttctatgtaaagtaacacataagttttacataaagtagtctccgttagatacttttatattttaattaagataggaatacactaggttgcaaggttgcacaaaaaattgtttttgcgttaattcaaagcctagaaaggtccgttaagcgcctcgtgcctatgtcataatagatccgaacacttgccctggatcgacttccagatcataattgctctagtgaataactaaagaaactagataaatgggagatagaagagaaagaaactaattataagcatctctcataggttcactaattacttgacttgactgttggcgggtctctttatatgtgttgtccggaaagaggaggactcaatgattattcgttcgccggaaccagaagtcaaattttggtagatagggatcccatcaatacttctttcgaggaatgggccagacccggtcatttctcaagtacaatagctaagggacctgatactaccacttggatctggaacctacatgctgatgctcacgatttcgatagccataccagtgatttggaggagatttctcgaaaagtatttagtgctcatttcggccaactctccatcatctttctttggctgagtggcatgtatttccacggtgctcgtttttccaattatgaagcatggctaagtgatcctactcacattggacctagcgcccaagtggtttggccgatagtgggtcaagaaatattgaatggtgatgtggggggggggttccgaggaatacaaataacctccggtttttttcagctttggagagcatctggaataactagtgaattacaactgtattgtactgcaattggtgcattggtctttgcaactttaatgctttttgctggttggttccattatcacaaagctgctccaaaattggcttggttccaagatgtagaatctatgttgaatcaccatttagcgggactactaggacttgggtctctttcttgggcgggacatcaagtacatgtatctttaccaattaaccaatttctaaacgctggggtggatcctaaggaaatcccacttcctcatgaatttatcttgaatcgggatcttttggctcaactttatcccagttttgctgagggagcaaccccatttttcaccttgaattggtcaaaatattcggaatttcttacttttcgtggaggattagatccagtgactgggggtctatggctgaccgatattgcacaccatcatttagctattgcaattcttttcctgatagcgggtcacatgtataagactaactggggcattggtcatggtataaaagatattttagaggctcataaaggtccatttacaggtcagggccataagggcctatatgagatcctaacaacgtcatggcatgctcaattatctcttaacctagctatgttaggttctttaaccattgttgtagctcaccatatgtattccatgcccccttatccatatttagctactgactatggtacacaactgtcattgttcacacatcacatgtggattggtggatttctcatagttggtgctgctgcacatgcagccatttttatggtaagagactatgatccaactactcgatacaacgatctattagatcgtgttcttaggcatcgcgatgcaatcatatcacatctcaactgggtatgtatttttttaggttttcatagttttggtttatatattcataatgataccatgagcgctttagggcgccctcaagatatgttttccgatactgctatacaattacaacccgtctttgctcaatggatacaaaacacccatgctttagcacctggggcaacagcaagcactagtttgacttgggggggtggtgatttagtggcagtgggtggcaaggttgctttgttaccgattccattaggaaccgcggattttttggtacatcacattcatgcatttacgattcatgtgacggtattgatacttctgaaaggagttctatttgcccgtagctctcgtttgataccggataaagcaaatcttggttttcgtttcccttgtgatgggcctggaagagggggaacatgtcaagtatccgcttgggatcatgtcttcttagggttattttggatgtacaattccatttcggttgtaatattccatttcagttggaaaatgcagtcagatgtttggggtagtataagtgatcaaggggtggtaactcatatcacgggaggaaactttgcacagagttccattactattaatggatggctccgcgatttcttatgggcacaggcatcccaggtaattcagtcttatggttcttcattatctgcatatggcctttttttcctaggtgctcattttgtatgggcttttagtttaatgtttctattcagtggtcgtggttattggcaagaacttattgaatcaatcgtttgggctcataataaattaaaagttgctcctgctactcagcctagagccttgagcattatacaaggacgtgctgtaggagtaacccattaccttctgggtggaattgccacaacatgggcgttcttcttagcaagaattattgcagtaggataatggctacgaggatttgaaaggcattatggcattaagatttccaaggtttagccaaggcttagctcaggaccccactactcgtcgttttttttttttaactaaaatcatcacaattacttatagattgcatagcaacaaaatatttccaacatgattaaaaatccagtcaaacaaaaacaacataaaacgaaataaaaacaaaaatttttctaataagtttttaaaaccttccaccaggtctgccaccagcaccacctctcccaaacacgaactgggtcgcaggcgctgcagccggttcgacttggagaatcccaggaatatcagtcatacccaaagcagcaagcatgtcaatagtctccttatcgacctcaatctgatcagtcttgatggcagagacatcaggtacaaagtccatgcgccgctcgcgctcttcctcttgaagcttgagtgagatcccgcgaaccggacccttttggatccgtttcattagatgggtagaaaaccctgcaatcttatttcggagacgttttgaagggatgatagccacctcttcaagaatcttcttgttggtatgaaaatcaagtgtcatgcgcgagtagtagcgctctatcacttggcgagaggatttcttcactgtctttgtacgtacgcgacccattttcctgaatcagagagcgctctgttaggtttgggtgtgtgagtgtgtgtgcaaggagaagccg

SEQ ID NO: 1096 - DNA, 925 bp, Elaeis guineensis
  misc_feature (651)..(651): n is a, c, g, or t
cggcgggggagtgcgaacgagctcggcagcacaaacctaaccctagctcatcgtcgtcggagagatcggagatggggcgcgtcaggacgaagaccgtgaagaaatcctctcgccaggtgatcgagaggtactactcgcggatgaccctggacttccacaccaacaagaagattcttgaggaggtggcgatcatcccctcgaagcggctccggaacaagatcgccgggttttcaacccacctgatgcgccggatccagcgtggacccgtgcgcggcatctccctcaagctccaggaggaggagcgcgagcgccgcatggacttcgtccccgacgagtccgctatcaaggtcgatcacatcgaggtggacaaggagaccatggagatgctcacctctctcggtatggccgacctccccggcgtcgagaagcaagccgatgcccccgccgtccccatttactccggccgccccggcggctacggtggccggaggctctaaatttccgagttttaatagtagatttaggtggagagggtaggagggacggaggtcttggtaaaagtctctctttttctcttttccttcagcatatcttcgaaagttccgaacttggtattgatatttcctttatcggttttgctttaagttttcnctggaattgaatgatggacagataacagtttgatgactgttttgattaatttggatttgctgttattgtgaaaaaaaaaaaaaaaaactgagggggcccgcccaatgccttaggacgatacatactgcgggttaccgttgctggaacctgggtcaataatcttggcatcctttcagtggtatcgaaggcgcctcgctcacattcactatggaaggatgagcaattgtaaatctattttaacgttttatcagcgacgaacttataagaacgagtg

SEQ ID NO: 1097 - DNA, 692 bp, Glycine max
gtgcttcgtctcagatcattctgcgcaggtaagacagagagaaagaactgacctcagcggcggcggcggcggcaacagaagaacaaccaccaccacacacaatgggtcgcgtgagaacaaaaacggtgaagaaatcctcccgccaggtgattgagcgttactactcgcgcatgaccctcgacttccacacaaacaaaaagcttctcgaagaagtggccatcatcccttccaagaggctgcggaacaagatcgcgggtttctccacgcatctcatgaagcgcatccagaagggtcccgttcgcggcatctccctcaagctccaggaggaggagcgcgagcgccgcatggacttcgtccccgacgtctccgccatcaacaccgaccacatcgaagtcgacaaagaaacccttgacatgcttcattccctcggaatcaacgacatccccggcatcacacaggttgaccctgttcctgttcaacaggccttccccttcaccaggaggtactgatgttgatgttgttcatggagactcttttggcttcagatgtaagactttgttttattctcttctcgtttcgtgttttggtgctttttatttatttcgtaagcctttaatttttgctgctgctgctactgctgctttaaattagactgagtatgtttttcaagtaaaattagggtttttggatta

SEQ ID NO: 1098 - DNA, 629 bp, Fagopyrum esculentum
ctccctcgccattttcttgctcggaggcgatagacgctcaggtaagttagtccaacaagatgggtcgtgttcgtacaaagctcgttaagaagtcatccaggcaagtgattgagaagtactactcgaggatgacattagatttccacaccaacaagaagttgttggaggaggttgccattattcctacaaagcgtctccgcaacaagattgctggtttctccacccacttgatgaagagaatccagaagggcccagttcgtggaatctccctcaagctgcaagaggaagagcgtgagcgtcgcatggactatgtgcccgaggagtctgccatcaagactgatatcatttctgttgacgcagaaactatcgagatgattgcagctcttggtatggctgatattcccggcattgttaaggctgaacctgagtccatggcacctcctccctttgctcgtggtggtggaggaagaagatactagaacttcaattactgcaatgttcttctttgtggggactagtattatcaacattttgatcagtccttaatgttttgacaatggattttagtctattatttttgctttttatcttgttttgaagtttaatgtctaggaatgtgtttggtgtta

SEQ ID NO: 1099 - DNA, 686 bp, Fagopyrum esculentum
gactcttttaattcctagtgcgcatactcctcctcccacactatttgcttgctaggaggcgacagacggtaagttaagttagtccaacaagatgggtcgtgtgcgtacaaagctcgtgaagaagtcatctaggcaagtgattgagaagtactactccaggatgacattagatttccacaccaacaagaaattgttggaggaggttgctataattccgacaaagcgtctgcgcaacaagattgctggtttctccacccacttgatgaagagaatccagaagggcccagttcgcggaatctctctcaagctgcaagaggaagagcgtgagcgtcgtatggactatgtgcctgaggagtcggccattaagactgatctcatttcagttgatgcagaaactattgagatgattgcagctcttggcatggctgatatccccggcattgtcaaggctgaacccgagtccatggcgcctcctccatttgcccgtggtggaggaagaagatactaaagtaacgctctctatcactgttttcgtggtatatcactgcttttaggttttatttgcttacagttaagtgttgcatttagaagatttcatggattattgggatgatgaaacattgagcaacttaccaaccttatctgttgttgactgttctgataataataataatgaactctcaact

SEQ ID NO: 1100 - DNA, 509 bp, Flaveria ramosissima
attggggtactaaacccttaggcaccctttcgtcatcatcgccggagcaagcacacgccgccgtgaaccatgggtcgcgtccgcaccaaaaccgtgaagaagtcatctcgacaagtaatcgagcgatactactcgaagatgactctcgatttccacaccaacaagaagattctggaagaagtcgccatcatcccctcaaagcgtctccgcaacaagatcgccggattctccactcacctgatgaagcggatccagaaaggtccggtgagaggcatctcgctgaagctgcaggaggaggagcgagagcgccgtatggactttgttcctgatgaatccgctattaaaacggatcggattgaggtcgataaggagacgattgatctgcttgcgtcgttggggatgagtgagctccctgggatcgtgcttaaggaggatactccggcgatgtcgagctccagttcccggggttatggtggtggccgtggtggtatttggtggtggtggaaggt

SEQ ID NO: 1101 - DNA, 783 bp, Ricinus communis
gcccgtaggaaaatcaaacatttacctgatgtagaccaatataaaacctaaccctaaaatctcccatcttcttctccatctttgtggccgcctctccttccacacacaagcacacacatacttgcacagagatttcctctcttaccttgttcaataagaaaaaatgggtcgtgtccgtacaaaaacagtgaagaaatcatcacgacaagtgatagaacggtactattcaaagatgacactcgattttcacacaaacaagaaaatcttggaagaagtagcaataatcccatcaaagcgtcttcgtaacaagattgctgggttttccacccatttgatgaaacggatccagaagggtccggtcagaggtatttcgctgaaacttcaagaggaagagagagagcgccgcatggactttgtgcctgaagtttcagccatcaaaactgatcagatcgaggttgataaggagactattgacatgcttgctgctcttggtatgggtgatatgcctggcctcgttcaggtggaccctgttgctgctgtgcccgtcgcccagtttgggtttggtagaggtgccggtggacctggcaggaggttttgaatgagtttaggacttctattctgagtatggtgacactgctaatgtcttaaattttagtttcttcaagtattttgggaacttgctatagctgttgaagcatgatggaaactgtttttgatgatatgcaatttataaattttgaatattatggttattgagtattaaaatttttgatgatttgctga

SEQ ID NO: 1102 - DNA, 883 bp, Ricinus communis
gaaaaatactatattttaacatgagctggatcacattattttgcccaattgatgttgggctcgaaactagaagtaaccgaaaacaaagtgatattgaagcccgtaggaaaatcaaacatttacctgatgtagaccaatataaaacctaaccctaaaatctcccatcttcttctccatctttgtggccgcctctccttccacacacaagcacacacatacttgcacagagatttcctctcttaccttgttcaataagaaaaaatgggtcgtgtccgtacaaaaacagtgaagaaatcatcacgacaagtgatagaacggtactattcaaagatgacactcgattttcacacaaacaagaaaatcttggaagaagtagcaataatcccatcaaagcgtcttcgtaacaagattgctgggttttccacccatttgatgaaacggatccagaagggtccggtcagaggtatttcgctgaaacttcaagaggaagagagagagcgccgcatggactttgtgcctgaagtttcagccatcaaaactgatcagatcgaggttgataaggagactattgacatgcttgctgctcttggtatgggtgatatgcctggcctcgttcaggtggaccctgttgctgctgtgcccgtcgcccagtttgggtttggtagaggtgccggtggacctggcaggaggttttgaatgagtttaggacttctattctgagtatggtgacactgctaatgtcttaaattttagtttcttcaagtattttgggaacttgctatagctgttgaagcatgatggaaactgtttttgatgatatgcaatttataaattttgaatattatggttattgagtattaaaatttttgatgatttgctgatt

SEQ ID NO: 1103 - DNA, 810 bp, Cryptomeria japonica
  misc_feature (91)..(91): n is a, c, g, or t
  misc_feature (621)..(621): n is a, c, g, or t
  misc_feature (658)..(658): n is a, c, g, or t
tgcaggatttgagggttttacttctgcttcagatattgtctgtcaattgtggagggagaacttcaaaagtaaattgaagcaggacaactanattgcaacttcacttcaaaatgggacgtgtgagaacaaaaactgttaagaaatcctctcgtcaggtgatagagaggtactattcccgaatgacacttgactttcataccaacaagaagattgttgaagaagttgccattattccctccaagcgtctgaggaataagattgctgggttttcaacacatttgatgaaacgcattcaaagaggtccagtgagaggaatatcactgaaacttcaagaggaggaacgtgaaaggcgcatggattttgttcccgaagagtctgccattaaaacagatgtgattgaggttgataaagaaaccattgatatgcttgcttcattgggcatgtctgacttgcctggagttgtgaagcaggcggatcccccagttggtggtggtttcaggccaggtggttttcaggcaggaggtgctcctggcaggagactgtaggaaaagactttagctttataatgtttcaggcggatacctcagtgggttggtgtaattctatgttgggcagactccntttttgggggttgtcttggcgggatacttaatacgantcttttgtaatgcttgtgcagagtttgaggcattgagatcgggaacatgtcatttttcaaaaaatatttctgagttatttaattgttatttgggtatccggcttatttaagaattttttaaaaaaagtgctgaatattatgggtatccggct

SEQ ID NO: 1104 - DNA, 687 bp, Cucumis sativus
aggtgaaattctgcgctccgatttgccgcctcttcttccgccgtcgcccgagcgcaatttcatcctgcaccttattcatccggcagcaagatgggtcgcgtacgcaccaaaacagtgaagaaatcttcccggcaagttattgagcgctactactcgcgcatgaccatcgacttccacaccaacaagaagatcctcgaagaagttgccattattccctccaagagactacggaataagatcgccggattctccactcacctcatgaagcgaatccagaagggacctgttcgcggcatctctctgaagctccaagaggaagagcgcgagcgccgaatggacttcgttccagacgtctccgccattaaaaccgagcaaatcgaagtggataaggagactctcgatatgctttctgcgcttggaatgaacgatattccggggcttgttcaggtcgatccgactgtgccgcagcaggttggatttggattaggtggtcgcggtaggaggtattaagattattggctaggttttttttttttttcttcctcctctgattttctgttgtggctcaatacaattttgtcatttagttttgtttatgagcattgttactttctgctaagctagagaatatgaaattttcatattgatttcaagtaacattcttcaatagagagatttgattacaaa

SEQ ID NO: 1105 - DNA, 909 bp, Vitis vinifera
ccaccgtatgaaagggtagtgccttctgcagaggaaccgggctcgagggctttccgaaaccctaatccccattttataagttgcctcctcttcctttcactcctcccttgccgcagtttcgccgttgcgctcctcatctccatctccatcttcgtcttcgatccagcaacagcagcgacatgggaagagtgcggacaaaaacggtgaagaagtcctctcgccaagtgatcgagaggtactattctcgaatgaccctcgattttcatactaacaagaaaatccttgaggaggtcgccatcatcccctcgaagcgcctccgcaacaagatcgccggattctccacccacctcatgaagcggatccaaaagggccctgttcgcggaatctctctaaagcttcaagaggaagagcgggagcgccgcatggacttcgtgccagatgagtcggccatcaagaccgatgtgattaaggttgataaggagaccatagacatgctgtcggcgcttggaatggctgagcttccgggtgttgttgagactgagccggaggtggtggctccggccatggtgttcggccgcggtggtgcaggcggtgccggtggaaggaggtactgagaacgttgagcctttgatgagctgttcgataatgagaaggtgagcagtttttgttttggtgttgttactagtagtttacttttgaatttgaactgtggagaaatgttagtctggttgattttatgggtaatgtttgggaccccatttgaatgggatataatttagctctcaatatgatttggattcaatttcttggatttgcatttctggctgaattatcataatattgctcttctggactttattataatttcaacgaacgtttggagtgtttgcaccataaacttttgggcgg

SEQ ID NO: 1106 - DNA, 862 bp, Vitis vinifera
ccaccgtatgaaagggtagtgccttctgcagaggaaccgggctcgagggctttccgaaaccctaatccccattttataagttgcctcctcttcctttcactcctcccttgccgcagtttcgccgttgcgctcctcatctccatctccatcttcgtcttcgatccagcaacagcagcgacatgggaagagtgcggacaaaaacggtgaagaagtcctctcgccaagtgatcgagaggtactattctcgaatgaccctcgattttcatactaacaagaaaatccttgaggaggtcgccatcatcccctcgaagcgcctccgcaacaagatcgccggattctccacccacctcatgaagcggatccaaaagggccctgttcgcggaatctctctaaagcttcaagaggaagagcgggagcgccgcatggacttcgtgccagatgagtcggccatcaagaccgatgtgattaaggttgataaggagaccatagacatgctgtcggcgcttggaatggctgagcttccgggtgttgttgagactgagccggaggtggtggctccggccatggtgttcggccgcggtggtgcaggcggtgccggtggaaggaggtactgagaacgttgagcctttgatgagctgttcgataatgagaaggtgagcagtttttgttttggtgttgttactagtagtttacttttgaatttgaactgtggagaaatgttagtctggttgattttatgggtaatgtttgggaccccatttgaatgggatataatttagctctcaatatgatttggattcaatttcttggatttgcatttctggctgaattatcataatattgctcttctggactttattat

SEQ ID NO: 1107 - DNA, 788 bp, Arachis hypogaea
ttacggccggggacccccactcttccttctcgtgttgttctcagagtctacctctccgaagaagaaagaaaaaacagagaaagaatggggcgcgtgagaaccaagacggtgaaaaaatcttctcgccaggttatcgagaggtactactctcgcatgacccttgacttccataccaacaagaaggttctagaagaagtcgcactcattccttccaagaggctccgcaacaagatcgcaggcttctccactcacctcatgaagcggattcagaagggaccggtcagaggcatctccctcaagcttcaagaagaggagagggagcgtcgcatggacttcgttcctgatgtgtccgccattgacattcaacacatcgaggtcgataaggagacaatcgacatgcttcagtctctaggtatgtctgacgtccctggaatcactcaggtcgatcctgttcctgttcagcagatcccgtttggccgccctggcgctggattcggcggtgctcagaggaggtactgagaaaaagaaattttcaatgtgttggaatcttgttatcgatattagggtttttaatttggggaaaaaggattatgttttgcttgaacagttttgtttttcttgtttctaattattgtcttttgaaattgatactctggtgacttgttagttaaattctgcgatgtatttttatattggattattatgattttgttatgtggtctttgattcgagaggccgaatatatttacgcgtggcgatgaatctctgcctaattaggtttttgagga

SEQ ID NO: 1108 - DNA, 9383 bp, Arabidopsis lyrata
ctcctacacggattagtctagtttttccccgaatcgaaagccagtgccggctaatgagacatgccatctatcctaatccaattgctattcttgctaaaaaggatcccatagactgctttcttagttatcaaagctgctttatctttctggctgttagatgtctaaacagtgtcaaaaagttgacaaaacccgtcttttttcgtctcttttttgcatgattccacaacgggcgaagagtacttgtgttatgctgaccacattaattctacaactgttcagctattagtacgagggaacaaagccccccttttttcattttataaaaaaaatataatccggagaaaaaccttcaaatagaatccgaatagaaagaagcattaggggtgagaatgacgccaagtgccccgagtagctatggtatccatagttcactttctttcctgcatatgtagggtaagtactttgtgctttcttcgtctagctcacacaaggtgcagagtggcgtgttgactcgagttctttgaacaagctctccacatcaattgtgaattgacgatgcaatgctactattctgcagaagaccgaaagtgccaagaagaaagattagtgaaagagttttctcgctagacgattctgtagaaaatagagatcatagatctggtgcgtcttagcatgtaacggactttccccaatcgagaagaagaatttaatacaatcgaagcactcattgctgacgtttaccgctttctaggcccaacgcataaactttactggagtccgagaagatcaagaaaaatgcatccggtggtggtgatcagagctgaatctcattctttttctttctagaagcatacgtcaagtgtactgactcaatcaacctatcggcctacaaaggctctccattctatacccctagccctacattaccactcttaccattatcttaaagataagataaggaccaatggcaagcagattcaagtcagtcggtcataaaagtatttaacaaagacaattgtaaggtctgcaagcctccctattacttcaaactgaaacagaatcaagggagatatgaaagaaatgaaaagaagatgtcagtccctctcacttgaacaagattactaataagaaagagaagagaaggaccaacggccagtaagttcatcctatccaccacttgaaaatgaacacaggaaagggaataagaaagaagaaactgctgacgcagctgaaatgcactaaaaaggagaatgtactctcgctttttcgttccgaggaatgagagaaggtatccaagtagttagcgagacttcaagaccagcagccgataagaaggtcagagtcacaatcgctttctcaattgacactgcgccagaatctaccaccccattcattgactatctcacctcacctcccatgggtctgggcgcttagcagcccctactttcacatttcttcctatgaaactacttggtctacttccatttagactgagagatggcgtctctttcgacggattgatccggacttccccacttcaacactcgcaggaaagaaagaaaagaccagaatcctactgaagctgctaacagagactgagcagatatagacctatgagatttgtacacttcggcttggcaccttcctttggttcgtgctcgcacgggccgtttctctgccaatctcgaattagaatctttgcttacccgtgggccttccaggatcactttttgagctcgcaacgttgagtttgattcctcccacccagtggatccttactaatccataatatgaagttaggttagctacttccctcagtggggataaggacagaatagaaaacccgaatgaaatgggatttttcctattatctaaaatagggctttgaaccagcctgagagaccatttttctttaaagaaagtcccgttttaatgatttacagaaatttcagttttttttgttcaattcttcaaaaaaaatacttcctgccaaagcgagcaagtcgcctatttcagggaagctaaaagcatgtcgtcccgcctatagtcgtagccagttcccttgcaggccttgattagcaaggaatagagagagcattgaaagtactgacgtaactctcgaacttgtttctcgagaggttgtgaacacaaactcgactgataaaggagaggtccggaggtattaactagttgatgaggtctcgacgagcgactaaaaggagaggtactgacgtgactcgagtgaaactatattgaggagagggaaggggacttatgtaactatattccgaatccttctccccgtcaaaatctgcctcccttgcccataaggagagagtctccctagtggtggaatcctttagaactgatgacgtcctagctgtgagctgacccaagagctacactgattaggaagcagattccgcacagaagaccaagcaaatctcctcttctagtcttacccccaggctgtggtgctacgagatggcaatttctcgtatagaagaatagatccgtgggcctattgattgaccatagatgcgaaccgatcgactgctatctaagagaagataagtagttcttctatcgttcaagggcaagggggagaacatgtagcggcttgcctagatctcgtatttcccacgtagtccgtaggtcaaaccaaggattctcttcacagtcttaaaggatgtatctctcctttgcgctgacttatgctctgcgagctaggagcgcatcatcggggcagggcgaaaacgaacataggatcatcatcatggcccttttcttctttcttttgctgctgatctcacatcgagagcagctccttcttgttcagggtcatcagatgagagatcttcttccgactccgagaaatcggtcaaacgggaggctaccctctccttttagtcgagtaatcaatccctcgactcatctctctatccataaaaaagcccttcccagaggagagcggaagctccaggatgagtatgccctggattcccggattcattctcgtcctgatccactctggaattttcggaatctacaaaaacattctaggaaagggctcgtaatgatcttctcaaagatcacaaggtgctgaagtggcaggataggagggggatccgtaggtttttgtgaaagggatgctcttacttatcatgtctgaaaagaaaaaccgaattcctcgatttcattcgattcatccacatttccatttcttgtagaggaaggctaactgtgcttgctggctgggagctgtatgagcggtaacgtccacgtacggttccgtgagaagggcggtggacagaaatggccttgttgtaccttactctcgtcttcaatggggtctgctcttttttttttgggagagtatgccaatatgatcttaatgaggtgcggaactttgcatctgacattcgttgggcttccctcttcgggagcctgcgtcccggccgtttttgtgcaataaacccctccggccgaagactagtggtaggtggtcccgcgtagctttcggagaagggtagccttgtgtgtaagcacagcaatgaaccgcggcgaaccctcagacgacctatctaagattagggggggagatcctcagtagtggtgaccctttcacctcttcccacggactgatacatgtaccgaatgctcatacgggaaagttgactcctgggtctggaacctggggggttgctccgagaaatcctttctttctcgtccactcaggggggtgcggacacacccgcgcggattacaggtgacggttacaagaatggcggggaagtgaacagtacccgacgacattcagggatggatgtagacccatcgggcagggataatcattccggtcctgggagaggtattgattactcgatgaaagaagaggagaggtggcgaccattttcaagaaccaaaaagactgaactgagggaagccctatgagtcactgaaacgacggcaggagggcctttgattataaaaaaggggagcaaaaaacgagcttttcccccctttacaatatgaagaaagaaagaagggttgaagtttagaccgctcacagtagttctacctatagaaaagatcatgaaagaggcgatcagaatggtactcgaatccatttacgatcccgagtttccagacacatcgcatttccgctcgggtcaaggctgccactcggtcctaagacggatcaaagaagagtggggaatctctcgctggtttttagaattcgacatcaggaagtgttttcacaccatcgaccgacatcgactcatccaaattttgaaggaagagatcgacgatcccaagttcttttactccattcagaaagtcttttccgccggacgactcgtaggagttgagaggggcccttactccgtcccacacagtgtactactatcggccctaccaggcaacatctacctacacaagctcgatcaggagatagggaggatccgacagaagtacgaaattccgattgttcagagagtcagatcggttctattaaggacaggtcgtcgtattgatgaccaagaaaaccctggagaagaagcaagcttcaacgctccccaagacaacagagccatcattgtggggagcgttaagagcatgcaacgcaaagcggcctttcattcccttgtttcgtcgtggcacaccccccccacaagcaccctccggctcaggggggaccagaaaaggcctttcgttttccccccttcgtcggcccttgccgtcttccttaacaagccctcgagccttctttgcgccgccttcctcatagaagccgccgggttgaccccgaaggccgaattctatggtggagaacgctgtaataataattgggccatgagagaccttcttaagtattgcaaaagaaagggcctgctgatagagctgggcggggaggcgatactagttatcaggtcagagagaggcctggcccgtaagcaggcccccttaaaaacccattacttaataaggatttgttacgcgcgatatgccgacgacttactactgggaatcgtgggtgccgtagagcttctcatagaaatacaaaaacgtatcgcccatttcctacaatctggcctgaacctttgggtaggctccgcaggatcaacaacaatagctgcacggagtacggtagaattccttggtacggtcattcgggaagtccctccgaggacgactcccatacaatttttgcgagagctggaaaagcgtctacgggtaaagcaccgtatccatataactgcttgccacctacgctccgccatccattcaaagtttaggaacctaggtgatagtatcccgatcaaacagctgacgaaggggatgagcaaaacagggagtctacaggacggggttcaactagcggagactcttggaacagctggagtcagaagtccccaagttagcgtattatgggggaccgtcaagcacatccggcaaggatcaagggggatctcgttcttgcatagctcaggtcggagcaacgcgtcatcggacgttcaacaggtagtctcacgatcgggcactcatgcccgtaagttgtcattgtatactcccccgggtcggaaggcggcgggggagggaggaggacactgggcgggatctatcagcagcgaattccccataaagatagaggcacctataaaaaagatactccgaaggcttcgggatcgaggtatcattagccgaagaagaccctggccaatccacgtggcctgtttgacgaacgtcagcgacgaagacatcgtaaattggtccgcgggcatcgcgataagtcctctgtcctactacaggtgccgcgacaacctttatcaagtccgaacgattgtcgaccaccagattcgctggtctgcaatattcaccctagcccacaagcacaaatcctcggcgccgaatataatcctcaagtactccaaagactcaaatattgtaaatcaagaaggtggcaagatccttgcagagttccccaacagcatagagcttgggaagctcggacccggtcaagacctgaacaagaaggaacactcaactactagtctagtctagtagtcgtttttttctattagttgcgatgcgaacaggcgtttacttatgagattagttgagtagacttgcctgagttgtctgctataagatagagctagttttggggtagggcttttgacataaaaaagccggataggcttggcttcgctatcgctcatgacttgtattgtagtcggcccggaatgcctcggtagtctttctaatgccttcttccttcattcattttcttttagttgcggtagcttccgcgccagcaagatacggacagcgaagccaaagcaatactaaacaagcgagaaaagtcctggttattagtaaagcgctaacgatcaagaaaaggccccttactatagataggctaacacgccttgtactaattatatataataaggtatttctcaaagtcaagtttctcgcttgtttctttagaaagattgcgggggcgctcacgttttttggccccttcccggcccggaagttcgcttccggcgactagcttttaccgctatcgcttggacttgtcacttcgtaccttgaatcaatcaatgaatgaatgaaaacgcctgactaggaatagaaaggaaggacaggttggttcgaggaccccttggtcaaaggaaaggtacaaaggaactcgaccacttgttgggagaggttgtgaaacaaactcgactaaaaggagaggtataaaatgattccggggcggagccgtatgacgcgagagtgtcacgtacggtttctttgagaagggtgtgataccaccacctatcaggcccgacgagcggtccacggagctgcatccttactcacctggtccatgcacattgttctttccaggaggttggccgcctatcctagatcttcccattttcaagaagatcccgggctcgatctggtttagtatcaaggttcttctctttctgttcctatatatatgggtccgtgcagcatttccacgatatcgttatgatcaattaatgggacttggccggaaagtgttcttgcctctatcattagctcgggtagtccctgtttctggtcttttagtcacctttcaatggcttccttaatttgattatgtgcgagaaattgccctcttgagtaatgggaagcgggctagtccccgaaaatgcccgttaataaagcaagttggggaaaaaatcttccttgttagttactcatttcttcggtcgagcgttctccggacgtcgagaaatctatcactcaatcactggccgctctgtcattgtctgattttaggtttctgatcacactcgaaattatgtatctacttatcgtatttttgcccctgctcggttccgtagcaggtagttttttcggacgttttctaggatcagaaggaagcgctattctgaccactacgtgtgtttcattcttcgcgctgggaggcttcctatctatctataggatttattactttcgtttgaaaggaccactgagggggattatctatctctttttggtcttttccatggggttcgtgggatctttgatccggatcgaagtcatccacctagtggggggtctggctttgcccgtgttgggactttttgtcttgaatgccataggggggcaagcacttccttctaccggcccttccgggtcgggcagttcttccatgtgggaggaagattcctttgaactgggagttctcgaggaatccgactcccccccggcaggggggtcccgaacggaagagggggaaccctcggtaaatcagggcagtcccctcccgtcccaaacggaagagggggaaccctcggtaaatcaagtgccccaggaagctgggcctgcgcttccagctaatccagtccctcccgggggggaggaagctgggccagtagtcccctatccatacaggagggatgaaatgattgggggggatagcgtagaggcgatagaacgccgccttctggcgaaataccccgaaggctctccctctgcggagatcatagagatggcccgaatagaggccgaagatctattcgagatcaaagcccaaatcatccaacggatggctctatatgacccaaccggcgattggatggcgcgtggggctcgggccctcgataatccgaggaccactagtggggaagagtccttggagcgtctttatgatatatggaaggacctccaagaaaccgggcccctctcggacgagttttctcgtttacaagagaaagtattcctcaagaaaggcggccctgggggggaccctatcgcataaggtctgcaagcctttcgggatgggcttttgcttctttctttatttttcgatatgccgcttcttcgccagcaaggagcgagaaaacaaagtgggctgtaatgatgtcagaatttgcaccaatttctatctatttagtgattagtctgctagtttctttgatcctactcggtgttccttttccatttgcttccaatagttctacctacccagaaaaattgtcggcctacgaatgtggtttcgatccttccggtgatgccagaagtcgtttcgatatacgattttatcttgtttcaattttatttttaatccctgatctggaagtaacctttttctttccttgggcagtacctcccaacaagattgatctgtttggattttggtccatgatggcctttttatttattttgacgattggatttctctatgaatggaaaaggggtgcttcggatcgggagtaaagtgatagggcacaaaatggggggaaaaagaaaggaaagagaataatgcccacgtttaatcaattgattcgtcatggtagagaagaaaaacggcgcacggaccgtactcgagctttggataaatgtccccagaaaacaggagtatgcccgcgtgtttcaacgagaacaccgaaaaaacctaattccgctccacgtaagatagccaaagtacggttgagcaatcgacatgatatatttgctcacattccgggcgaaggtcataattcgcaggaacattctacggtgttaataagaggaggtagagttaaagattcgccaggtgtaaaatcccattgtattcgaggagtaaaggatttgatgggaattccgggtcgaagaagaggcagatcaaaatatggtgcagaaaaacccaaatcgatatgaatggaagatgcctctggaactagtatcggtcagtcttttagtaagcgtatataaacagctgtttagtgtataagcaattctttagtggctgcactgaaaggtacgtacggtggaggttggttgaagatgatgttacgcggcgttcagaaccagccttgaagtgaatgaattagaaagaagaagtaagg

SEQ ID NO: 1109 - DNA, 526 bp, Ricinus communis
gggatgggctttttcttctttttttccggtatgccgctccgcgagcaaggagcgatagaaccaagtgggctgtggtgatgtcagaattttcacctatttgtatctatttagtgatcagtccgctagtttctttgatcccactcggtgttccttttccatttgcttccaatagttcgacctatccagaaaaattgtcggcctacgaatgtggtttcgatccttccggcgatgccagaagtcgtttcgatatacgattttatcttgtttcaattttatttattatccttgatccggaagtaacctttttctttccttgggcagtacctcccaacaagattgatctgtttggattttggtccatgatggcctttttattgattttgacgattggatctctctatgaatggaaaaggggtgcttcggatcgggagtaatcactagtgatagggaaaaaagaggggggaaggacaaaggaaagagcgatgcctacattaaatcaattgattcgtcatggtagagaagaaaa

SEQ ID NO: 1110 - DNA, 360 bp, Ricinus communis
atgtcagaattttcacctatttgtatctatttagtgatcagtccgctagtttctttgatcccactcggtgttccttttccatttgcttccaatagttcgacctatccagaaaaattgtcggcctacgaatgtggtttcgatccttccggcgatgccagaagtcgtttcgatatacgattttatcttgtttcaattttatttattatccttgatccggaagtaacctttttctttccttgggcagtacctcccaacaagattgatctgtttggattttggtccatgatggcctttttattgattttgacgattggatctctctatgaatggaaaaggggtgcttcggatcgggagtaatca

SEQ ID NO: 1111 - DNA, 1738 bp, Ricinus communis
tgggctgtggtgatgtcagaattttcacctatttgtatctatttagtgatcagtccgctagtttctttgatcccactcggtgttccttttccatttgcttccaatagttcgacctatccagaaaaattgtcggcctacgaatgtggtttcgatccttccggcgatgccagaagtcgtttcgatatacgattttatcttgtttcaattttatttattatccttgatccggaagtaacctttttctttccttgggcagtacctcccaacaagattgatctgtttggattttggtccatgatggcctttttattgattttgacgattggatctctctatgaatggaaaaggggtgcttcggatcgggagtaatcactagtgatagggaaaaaagaggggggaaggacaaaggaaagagcgatgcctacattaaatcaattgattcgtcatggtagagaagaaaaacggcgcacggaccgtactcgagcttcggatcaatgtccccagaagcaaggagtacgcccgcgtgtttcaacgagaacaccgaaaaaacctaattcagctctacgtaagatagccaaagtacggttgagcaatcgacatgatatatttgctcacattccaggcgaaggtcataatttgcaggaacattctatggtcttaataagaggaggtagagtaaaagattcgccaggtgtgaaatcccattgtattcgaggagtcaaggatttgctgggaattccggatcgaagaagaggcagatcaaaatatggtgcggaaaaaccaaaatcgatatgaatggaagatgcctctggaacttgtttttctcggtcaggagaggtacgacaacggaaaagaaggaagaaaagggagcagaatgccactcgacaagagggaaagtcctctgaaagcccttgttccagcttagagggaaaagcaccgcactataagaaaaagaaagggaagagaaagagaagtcagggacttgtcctcatggtctcctaagggtcttcccctaggcataaccaatagacaaagagttccaactatcgaatcaaagaggaacggagccgctttccccagttgacgagagaaagaaaggaaatgagcccatcacctatctgaagctgaaggaatgaaagcattagagtcttgatcccctgcttaacctgaaacctctcaagccagggaaagatttcaagttcagactatgatgactggcatcctcacttacgcaacgaaattgagttgatggagtagccagtgcccttgagttattctcttcggtatcgccttgaaaaacagaatagaagaaaggttaacagaaagtctcacaaagaagaagagaagatgaagtctaacagcaggtcttggggataacagtagattgatgagtgatcccctctgaatcagggaaggtaggacattctgaaccttaacctctattggatgaagcaaccatataactgacgatattgatttagtagcgagatcagttacactagcccgggcatcatcgctgtcttagcgcgaacagtctgtagccaaaacagagtagagattcaaatggagggatgtgaagagaaatgaagtcaatgacaccacaccagaccgaccggaaagggaagaagtagctaccatttcacttttccgttacatgctttcccctgtcaccaactctgatgtcactgtcaacaagaaagagagagagggggaagtcagggtgagggaggagaagaaa

SEQ ID NO: 1112 - DNA, 8797 bp, Ricinus communis
gaccaaagacttcaagcccggcccgggcaagctagattatggaactgatctgaccgaactgggtctaatggaacaaaatctcgatctcaattgagctccaaaatactctctctacataggcagtatttggatgaactaaaagatgattcattcaatcaatatattctcatgaaatgtacgattcgccccagggaaccccctctttctaaaatctaaaaaaggttgcgggatgggctttttcttctttttttccggtatgccgctccgcgagcaaggagcgatagaaccaagtgggctgtggtgatgtcagaattttcacctatttgtatctatttagtgatcagtccgctagtttctttgatcccactcggtgttccttttccatttgcttccaatagttcgacctatccagaaaaattgtcggcctacgaatgtggtttcgatccttccggcgatgccagaagtcgtttcgatatacgattttatcttgtttcaattttatttattatccttgatccggaagtaacctttttctttccttgggcagtacctcccaacaagattgatctgtttggattttggtccatgatggcctttttattgattttgacgattggatctctctatgaatggaaaaggggtgcttcggatcgggagtaatcactagtgatagggaaaaaagaggggggaaggacaaaggaaagagcgatgcctacattaaatcaattgattcgtcatggtagagaagaaaaacggcgcacggaccgtactcgagcttcggatcaatgtccccagaagcaaggagtacgcccgcgtgtttcaacgagaacaccgaaaaaacctaattcagctctacgtaagatagccaaagtacggttgagcaatcgacatgatatatttgctcacattccaggcgaaggtcataatttgcaggaacattctatggtcttaataagaggaggtagagtaaaagattcgccaggtgtgaaatcccattgtattcgaggagtcaaggatttgctgggaattccggatcgaagaagaggcagatcaaaatatggtgcggaaaaaccaaaatcgatatgaatggaagatgcctctggaacttgtttttctcggtcaggagaggtacgacaacggaaaagaaggaagaaaagggagcagaatgccactcgacaagagggaaagtcctctgaaagcccttgttccagcttagagggaaaagcaccgcactataagaaaaagaaagggaagagaaagagaagtcagggacttgtcctcatggtctcctaagggtcttcccctaggcataaccaatagacaaagagttccaactatcgaatcaaagaggaacggagccgctttccccagttgacgagagaaagaaaggaaatgagcccatcacctatctgaagctgaaggaatgaaagcattagagtcttgatcccctgcttaacctgaaacctctcaagccagggaaagatttcaagttcagactatgatgactggcatcctcacttacgcaacgaaattgagttgatggagtagccagtgcccttgagttattctcttcggtatcgccttgaaaaacagaatagaagaaaggttaacagaaagtctcacaaagaagaagagaagatgaagtctaacagcaggtcttggggataacagtagattgatgagtgatcccctctgaatcagggaaggtaggacattctgaaccttaacctctattggatgaagcaaccatataactgacgatattgatttagtagcgagatcagttacactagcccgggcatcatcgctgtcttagcgcgaacagtctgtagccaaaacagagtagagattcaaatggagggatgtgaagagaaatgaagtcaatgacaccacaccagaccgaccggaaagggaagaagtagctaccatttcacttttccgttacatgctttcccctgtcaccaactctgatgtcactgtcaacaagaaagagagagagggggaagtcagggtgagggaggagaagaaagggtgtcagggacgaaagaaaaagtacccaatagagacaatagatcacgtagtccccggagtaaaataccgaaccttaatatacctcttcttcatcctttgccctgactaaatcatcccactaggaaataaatcttccagccgtcgttccagctgagcttcgaacagagaaagcaaatagcaatgaaagggcactcgaagcaggtccttctgttagactaaatttacgaggaaggtctgaggcacgaagtcttaacgagccactcttgatcttagaggagaccctattgagaagatagggtttttgaacagctcctaacctaccaaccaaccaaaaagggaaacacatcccaggcataataatatgaagaagagcgtttcctagccgtcttgtccttggggaaggaagtaccactcttgaatcaaagcaaatagaaaaacagccactatcttagcagctgaaaaagggctttcataggggagaaaagtaaactccttgcccgttccgctacttcacttcttggcttgaagcgccttttcactttgttggctaaaagtggaagaacactgtccgagtgctcccccgagaggatgctttgagattggcttgaggctccgcttccttctattcagattccctgcgatgcctcgtatcagagacacttttcgttttcagttcattgtctttttctcgagtttaggggagaactaaagcaggtgatcactctaaatagcgtaaatagagtgtttggtggatccccaacccctctttgaaattcgaaggagatcaaaagtatgcttatgaagacgtaggtagatttggcgatatggccataaatagggaaagaaagaaccatactcgctcgaacttttaccattgtacagaagccaaccaaaaggagtttatacatcttgggaaagagcacgctacaaagcgaaactgggcctcaacggaaagatgactcctgaagttcagcagcgtgctcgatcggcgacagaataaggaagtttcccctgatcaagaaagaaggtcagcgactagtcgtattgtcatcagatgaatgactagccttggaaggccttttgaagtggaaagcaaaagaaaaggcatctcgttgcatttattggcgaaagagctggacttgaccttctattctagccgttccgttagaggggaatggaatgaaaaagagaggtgaaagcaaggaagagaagtttctttgtagagaaatattatacttcggatccttggctttctcggaagctcttactctttactaagcgatgcgagaaaagaagctgggacaggaagggatgttggaacatcactccgcagaactataacagcacctcattaggggatatcacataccagaacagggacgccggccagctaggaagttggaactggtgaggatgctggttattaagaaactctattttgcgccttgaatcggatttgcttgaacaggctctggttctcaattaacgaggtcaactaaaggtgccgactttaccctttttgctcctggaactcaatcccctgcctctatgtacttgagtcctgatttcgtaattaagtagtatagaaagagaaagagattcgtcttgcttatttgtttgcttgatcattgaattgagtgcgtggtaaatgcttttgactcaacctcccattgctctatctccgatagcatgcagccgataatgaagacagatatatagaaagtgtgcagcgttaatagttgataggtagtcagtctttcctttactcggcccaagcaatgcccaaagactcccatgtttttcttggttggaccaacccaaccggtgattgtagtcttccggagagcaagaattagtctctcttttttttggggggggagcagagctgtcaaagaatgaagcaaaccaaatgattgttctagaatggttattcctcacaatttctccttgtgatgcagcggaaccatggcaattaggatctcaagacgcagcaagccctatgatgcaaggaataatggacttacatcacgatatctttttctttctcattctgattttggttttcgtattacggatcttggttcgcgctttatggcatttccactatcaaaaaaatccaatcccgcaaaggattgttcatggaactactatcgagattcttcggaccatatttcctagtatcatccctatgttcattgctataccatcatttgctctgttatactcaatggacgaggtaatagtagatccagccattactatcaaagctattggacatcaatggtatcggacttatgagtattccgactataacagttccgatgaacagtcactcacttttgacagttatacgattccagaagatgatctagaatttggtcaatcacgtttattagaagtggacaatagagtggttgtaccagccaaaactcatctacgtattattgtaacatctgctgatgtacctcatagttgggctgtaccttcctcaggtgtcaaatgtgatgctgtacctggtcgtttaaatcagatctctatttcggtacaacgagaaggagtttactatggtcagtgcagtgagatttgtggaactaatcatgcctttatgcctatcgtcgtagaagctgttcctgggaaagattatggtgattgggtatccaatcaattaattccccaaaccgggggggcagaatcctaccactctccccctagtggtagtggggattaaattaggggggatgcaattatgattcaatcccctttagaaccccccctccactccaccccctccgatccttaccgctccgctgctttaatggaggagaggacccccgtggcccagccccctattcaagagcggcctgttaaccagccgtctctcgaagattttgccaaccttctggaaagccacgaaagaatttcggagcgcatcaaggacctgttcagggacctgcacacgcgtgttccagggggcttccaggcggagcgtctcaccgagattttggaagaaagacacggaggagaaaagatgaatgagatcctccagagtctacaaactgagggactccatagcccctactttcgggaagtccaaacggacttctggaacttccgacactccggagttactgaaatgagactccgacgcgagtggcaaggtaaaggggaagactcatcaataatgagatagggggttcgttcgctctcaatgtaaatttatccgttactatattaagtggaactaatcatgcctttacgcgtgcgcccggaaacataggccgactgctgagcccactctggctcagccgcaccacctcgggtgcgagccacccgagaagcaagacagcgagcggctggagctgtagggagccaaggagcaaggcagtagataagatagaagaaggggccaggctcccggtagagcagaggagacggttaggataacgaacttgaaacgcggagcccaagcggccggcgagcgagtggttagtggccaatagcgccctagtggatggcatttctctctgcggctggcactcgaggaaccacggggcactccatacagagcaagcaagtcttagggatgagacgcccgcgcaaggacctcaattctcattaggaggtcgaaccaaggacctatggaagtcggggctaccccagttcccatgggcaaggcaacagtgtcctgagggaggagtttagaggccttatagtagcacggacttttttttctttctaggtcatgcgaagggggccagtccaagatcgtactgttcctctacacaacagacgctctcaacggctaggcgccactatctttctgagttattccagcttcttcatgagcggtgaacaaacaaaacaaaaaaaagagggccgtcctccttggttccttaggcggctatacctaagcccggttcactcaggatgatatcccaagagagctcaaccaagataaaagagatcaggaatcgctacttcgggagaaaggaggaaaacgtccaacctgacggagaccgagggggactgccgaaaaagaggcatcaggtaggcagacaaagcatcctcgaccacatgcgggccatctgagaaggaagaagacgcatcttcaaacaaataataagtaaccacaggcaaagaaagtaactcaaaatagcaccgaataagtagctcactcccagccagaaagtactaggaaataaattaagtagttaactccgaaacatatggtactattcttataaaagaagagtagagttcatatgcaactcatcccacacgaaggagagaggaagggtaatcgaacactaagacgaggagtaggatggtatgaaatgtgccagcagtctggagctaagcgatacttcaaaactccgagtccagagagcggtaaggctatgaagcccttccttcagctggttttggcttgccccggttggagctatgaagcttaccttattattatgaaaaggagaaagggctttttcagcttgctgctcgctttctcgcttccgagaggcgaagggagcctgacttacggtttccaagcctggcgcaaagcgaagggattggatttcacctatgatcagatcagtggacaaccatagtttactttttttgtggtgttgttgacgttgttgaaagcgaatttttaagtaggcctcgcttttcggagctgctcccagctcacactatggtggaggaggtgccgtgaaaatctaggagtgtgagcagtacgagctgaaaggctcccatactgtttggagggggggcatagatgccaaacaaacctgacccctatctatcgtcgtagaagctgttcctaggaaagattatggttctcgggtatccaatcaattaattccccaaaccggggaagcttaagtggaaatgaaagaatagggtgagggaaaaggggggaagccactaaattgaagacttcactcgctcgctctaacgctcgtttagtagacagcgactcgtaagtcaagtacggaacgagccttgtctacgaagcagagcgacctcgtcttgcttgcttctggcgaagcttctagattagataataggcatttctttatggtaggaatactactttttaggccgactactacataggagcgatagcgaagccaagccgtataaaggcgagcagcccttatagcaatagcaaacggcctacttatagccctccccggggacttcaacgggtcttacaagctcataaaaaaaatggcaattcttcacgttttcttcatagagtgggaatgaattctattacttgattgacattgacagatatgtgtaccacaccgaacaagcaatatgccgatatgcttgatataccagccaagccagctcgaccgtatacagtataagggattcgcctttgcctcagacaaaataaaaacggattgaacaggacaaccgggaagggaagcatagatattgatttgaacaaaggaactgaaaccggtaccagaaaccaaacaagagatggaattccagattgaacagatgaccgacctacaagaagacgcaaattttattcctaattccattctctaagacgaattaaagggatgtctctaagcagccaaggccaagagcaagcaagagtagtcctatccgcctagaaggattcgataaagagaatgtgagtggtgagtgggcaggagatcaatagacacggaaagagaagaccaaaaagagcagaaggcactcagttgtttatgtgaaatcaaggagcagcaggttcaacttttacactttcccgaagagagctcaaagcaataagatgaaagatgggatgagatgctagccttagcgcagaagatcaatcattgagccttaggccactaccgagcagcaacggaggatcataaactgcctgtactgtcgagatgatccctacttgaaaaggcggagacaatacctcttgttgcgacaaattgagtttcaaaaccaccacccagtcaacaaggcatacttgctcactgcgatctctagcacagtctcattcgtaccgaccctctacggacggggtcaagagtgccttgccgttgctgtcgcgtatccaaccaccctatcggtatcacctacgctactcatttctgacccccaccttcttggtttcgatatcctatatggaactatcagtcagagctccgaaattactttccctcataaaccttcacttcatcctcatcgtccgttagctagccctacttgtcttttgactcggaaaaggcagtgaaatcccttttatactatatggaacaactaggccaactacttgacttggccattcttcggatcaaacaccccttctcctgccgaagtgacgtgcccaactacgggaactggttcacctcactctgctcgcccaccatggagttatgaatgaagctctttcccgcgcaggcaatagcactactttgtccccagcttctcaatgccaacaagaataggtaacttgctgagcggaacaaacgaatgaatgggtaaaagctctcgcctgaccggggtaaagaagggcctacctattttgaactccacccctcggactactttccttccatacccataggaccaagggctcgtaccaacctcactatttgaagacaccgggctcttcacgaaaacagagcaaaggggctccttaacaacctgagccacatccgcccatggtgcagtgtcaattccatctgttctcggttctgtggatgaaattccatccaaaagatagggccctggtagcccaaca

SEQ ID NO: 1113 - DNA, 5040 bp, Oryza sativa
gggttcgaacggatggacacaactggttttggaaaatatgttataaaaagttgtagagctggtcgtctttcatatcgagccattgaagcagcgcgtcgggctataatcgggcaattccatcgtgctatgagcggacaattccgaagaaattgtaagatatgggtaagagttttcgcagatcttcctattacggggaaacccgcagaagttcgaatgggaagaggaaaaggaaatcctacgggttggattgctcgtgtgtccacgggacaaatcctatttgaaatggatggtgtgagtttgtcaaatgctcgacaagccgctagattagcggcgcataaactatgtttgtcaaccaagtttgttcagtggtcgtaacgtaattggttagtggggaaaaaccgggccgggactcaaaagaatttggcgaagtgtttgttcctgaacgagggaagtggaaagacaaagagggatagggagctcgcctccttctttttttgaatcgccgaaattgtacgacgacccttcttgttccaggcatacgactctgagacgtgacggtgtcacttttccggcccggtaaagtgacagttatataaataagaataagaaagagaagcgtgatgttgtcagcaatcaaattatcgtaaatagatagtacggttgcgttgtttcaatttctgttcgtcggtccttgggttacgaaggtgtgggcttactaatacggagagggttccgaatgataaagtgtcatgaaagttcgtgaaagaatgttcttgtttttcgttggaaaacccaacgccacggccacaaaacgaaaaagtctcccgtttgttttgggagcagagctttaaaaggatatagttaccctatgatgagatttagttcaacggataagaaggatagaagaaatatgctatttgctgctattccatctatttgtgcattcagtgctgccgttcccccggccccaaaggacaagattgagtcgccgctatcactttttttggggggccaatcccgcgaagagttatggaaagattttatagctcaattgaatgaagaaagtgaattcatggacaacattttttttggtgtttacaacgcgagaaacggctatgaaagcgccacagttcttcagggaatacggatagatttagcgataaacggctatgaaagtgcatttttgtcggaatttgcacctatttgtatctatttagtgatcagtccgctagtttctttgattccactcggtgttccttttccatttgcttccaatagttcgacctatccagaaaaattgtcggcctacgaatgtggtttcgatccctccggtgatgccagaagtcgtttcgatatacgattttatccggttcctattttatttattatccctgatctggaagtcacctttttttttccttgggcagtacctcctaacaagattgatctgtttggatcttggtccatgatggcctttttattgattttgacgattggatttctctatgaatggaaaaggggtgcttcggatcgggagtaaccactagtgaaagggcaaaggggggaaggacataggaaagagggatgcctacaaaaaatcaattgattcgtcatggtagagaagaaaaacagcgcacggaccgtactcgagcttcggatcaatgtccccaaaagcaaggagtatgcctgcgtgtttcgacgagaacaccgaaaaaacctaattcagctctacgtaagatagcaaaagtacggttgagcaatcgacatgatatatttgctcacattccaggcgaaggtcataattcgcaggaacattctatagtcttagtcagaggaggtagagtgaaagattcgccaggtgtgaaatcccatcgtattcgaggagtcaaggatttactgggaattccggatcgtagaaagggaagatctaaatatggtgcagaaagaccaaaatcgaaatgaatggaagatgcctctggaactttttggttattttgggtccagatgaacgcaagtcgacatcgggatacgcattttggcttggtagcggtgttatctcttggagtagcaagaagcagtcctgtatagctctgtcccaagctcctctttctagtagccctactaaacctatgagttgactcgtacatactcacttattcttgacttatctgtgactgcatattcctagcattgtaccagggaatgttgcagaccgacgggcacttcgttgctgggctggaatagaaactgacgtatggaggacttgtgagatctttcactcttcgacaacgaaagccttgaggacgtcagcgatgtgttatagggacgtcccgcgatcttgcttctagagtacgtacgggaacatccaatcgagtgcctaaccttgggtgctccgatcttgttcgtgaggaagcaagactgccttcttcgttcaatgaatctgcataccaccaagggctatttgaaaaaagaagtctgaatccgtgtcttctctgccatttgatttccttcaccactagccccgccagctactagagtatagctactttcgctaccttgactcttcttgttattatccagacccatcaagtcattcaaaagcaaagaaagaaagatgaataagcaaagcgaaggccaagcctgatctccctttcccttgatatggtggactcctaaaataggctttctttgttcgtatgatttttaataatactataataagccactcctgaaaataggctggctactcgaaccaaatattgaacttgctctttagcataggtagacttcactacctggataggtcagcctcgttcccatttctctggtcctatatgttttttttgcaagtaccattcctgctattcgcattgattgagtactttatagttttcttcttgatggaagtgtcaaatacttagtaggaagtcccggtgggtaatcaccaaatgttctagtacgagtacatccagttccgggtggtcatctagtatgggacctaagagaagcccttttttaatccttttattaagccattgctaatcccgtaaggcaatccttcaacgttgtagaaaagagttcaatacaaaagcacacaaaggctttggactatgaaaggctacctttatcatgcatgaataaggccgggagattatgtcctcaacaaacctatctactactaaatgacaattaaagggacgccaaccattggaggtgatactggtgatggtaatggtgaagattcttctctttttcctgggtacataaagataagaagaaggcaacgaaaagcacttagaaaaggctattaagaaactgatccactatttgaaacctgtcatccacgttagaaagagagccatgaaaagcatagatcctcaaggaaaggaaaaaacaccacttcgtctatttacgattcccataaaccaggccgtgctttcttttatttagtaagctcagccgaagagccctggaccggcagcacctgcaaatgaaacatgcatgcctttcgctgcgcgcctttatttgcttcggaaatcaaacaatgcatttcttctcaacataaacatataccggtctttctctctagcctatacttgaccttgcgtacaagcctattatcctatcggtatgcctatgtgacccatatgtgctaaaccggtacttgttacttacttctatctattaaacgttaccggtacttagttaccgtgacttaatcatgcttagtactaaaccttactacgtagttcattcaagctatactgacctttccatgttttgtactcatcacttgcctcttcgcttagtgcactcgaaacagagcttcaagtaagatgtttgtggaacatctctatagcttgtcttacccacctcttttggttccttagaaagaaagcttcaaacagcaccattggccgaagcagacctggaagctgatctgcgagtgaatgaaattgaacgattaatatcgcctttcatgctaaaatcggacgatttcgacctttccggatgtcgattgggataagggtttgatcgagagctaggagattcggttgtttaacctaagagaagagatccagtttacagaggagatgccaggggcggtggctgttcaaggctaaggaggaaggcttgatttcttaaaaaaaagataagatccgactatcaaaccaaaggaaattgccaacaagagtagcttaaaagcacctagttaccgaggcagatgagaagaactgaacaagccaagaagagtactcaatcaaagcgagctttcatttttgcgggttatatttaaacttgcttttttttaagcatactacacactactttctataggacagggtcaggtaagagaggacgacaagccaatggtaaatccgagttggaaaaagagatgcaacacccaagtcaatctatgaaaaagctggcactcatcgctacaggcactcactttctttaggtcccagaagagagcaaatgctaaatgccaagacaattcaattcaattatatgataaaagggccaaagtgttgaaagaggaaagagggaggaattgatacgaaaagcgtaggaaatgtaaaaactacacacaccacttagtaaaatatgctctagtaaattcaatactatatataggaagtacggcggacaagcctggtattgttagttaagctagtaaattccttccctcacttcactacgacgaggaaatgcattgggctagctatgatatttggctagatagagttgaatgtgaaacacaccaatgttcaagtgttgagtaggcaattagcaaggagaagaaaaagtttttcaatccaggagttctaatctctcctcctcgccgcgggtaattcgctgacttaagtcaatatgaaaaagtgtggaaaatgggtggttgtactttcatcgacgaaaggaacaaagaactacaacaataataccgatcaatagtttttctttcaatatctactggtgcttccatgtctcattggaccgatgcaattgtgtctttcggtcactttattttggttggta

SEQ ID NO: 1114 - DNA, 468 bp, Oryza sativa
atggacaacattttttttggtgtttacaacgcgagaaacggctatgaaagcgccacagttcttcagggaatacggatagatttagcgataaacggctatgaaagtgcatttttgtcggaatttgcacctatttgtatctatttagtgatcagtccgctagtttctttgattccactcggtgttccttttccatttgcttccaatagttcgacctatccagaaaaattgtcggcctacgaatgtggtttcgatccctccggtgatgccagaagtcgtttcgatatacgattttatccggttcctattttatttattatccctgatctggaagtcacctttttttttccttgggcagtacctcctaacaagattgatctgtttggatcttggtccatgatggcctttttattgattttgacgattggatttctctatgaatggaaaaggggtgcttcggatcgggagtaa

SEQ ID NO: 1115 - DNA, 890 bp, Oryza sativa
atggacaacattttttttggtgtttacaacgcgagaaacggctatgaaagcgccacagttcttcagggaatacggatagatttagcgataaacggctatgaaagtgcatttttgtcggaatttgcacctatttgtatctacttagtgatcagtccgctagtttctttgattccactcggtgttccttttccatttgcttccaatagttcgacctatccagaaaaattgtcggcctacgaatgtggtttcgatccctccggtgatgccagaagtcgtttcgatatacgattttatccggttcctattttatttattatccctgatctggaagtcacctttttttttccttgggcagtacctcctaacaagattgatctgtttggatcttggtccatgatggcctttttattgattttgacgattggatttctctatgaatggaaaaggggtgcttcggatcgggagtaaccactagtgaaagggcaaaggggggaaggacataggaaagagggatgcctacaaaaaatcaattgattcgtcatggtagagaagaaaaacagcgcacggaccgtactcgagcttcggatcaatgtccccaaaagcaaggagtatgcctgcgtgtttcgacgagaacaccgaaaaaacctaattcagctctacgtaagatagcaaaagtacggttgagcaatcgacatgatatatttgctcacattccaggcgaaggtcataattcgcaggaacattctatagtcttagtcagaggaggtagagtgaaagattcgccaggtgtgaaatcccatcgtattcgaggagtcaaggatttactgggaattccggatcgtagaaagggaagatctaaatatggtgcagaaagaccaaaatcgaaatga

SEQ ID NO: 1116 - DNA, 370 bp, Citrullus lanatus
gggctgtggtgatgtcagaatttgcacctatttgtatctatttagtgatcagtccgctagtttctttgatcccactcggtgttccttttccatttgcttccaatagttcaacctatccagaaaaattgtcggcctatgaatgtggtttcgatccttccggtgatgccagaagtcgtttcgatatacgattttatcttgtttccattttatttattatccttgatccggaagtaaccttttcctttccttgggcagtacctctcaacaagattgatctgtttggatcttggtccatgatggcctttttattgattttgacgattggatttctctatgaatggaaaaggggtgcttcggatcgggagtaatt

SEQ ID NO: 1117 - DNA, 677 bp, Citrullus lanatus
tttctatttgattgttgtggttgtgtgtttcgagatttcattgccgctcttccggctacctgattatgcgggaatccctagttttcctctctgaggttgattgaatctctccttatctgattgtcggtctgcttcacatggatcccccgcctcgtttgagtgctgcttttttctgatcttcatccgggttccaaaatttatcattggaatttctttcattatctttcactgggcttttgccgctttttcggtatgccgctccgcgatcaaggagcgaaagaaccaagtgggctgtggtgatgtcagaatttgcacctatttgtatctatttagtgatcagtccgctagtttctttgatcccactcggtgttccttttccatttgcttccaatagttcaacctatccagaaaaattgtcggcctatgaatgtggtttcgatccttccggtgatgccagaagtcgtttcgatatacgattttatcttgtttccattttatttattatccttgatccggaagtaaccttttcctttccttgggcagtacctctcaacaagattgatctgtttggatcttggtccatgatggcctttttattgattttgacgattggatttctctatgaatggaaaaggggtgcttcggatcgggagtaattactagtgagagggcaaaaa

SEQ ID NO: 1118 - DNA, 3431 bp, Theobroma cacao
gcgcccaaaggtgctctattgagccggtcaccgtctggtagagtaggagccaacaaaggaagtcatggactgatcgcttggagcattcaattgcatgagaaaggtcgatctcaattgcttaacaccatgtaatcgatcaatgtgaggaagcagggaccagacccgcaataggcatcttccattcatctcgatttggctttttcagtaccatattatgatctccaacgaaatagtctcacttctaacatttcctcgccgaggtgttgtaaatgcgagtttacaaatgccgtcggtagtcctttccgctcagtccttcctgcagcagttaagtgtgcttttatcagtcagtcccgcttgatcgagtcgagtccagtaaactccctccacttattatccgtggggccagcggtttacaactaacttaaggaaactaagaccttcgcctactacttttctagccgatctcatcccctctcccgcatcataggttggtacagaggcgcattcccttatggcccattcgctggcaactactagctgactcttacatccgactccttaactgggtcgagctgcttcccgctttactctcccacctggtagagctagccaagtccccttcctcttccacagcaagatctcgttccatatattcctggtctcgtgagcttactcttcttctttcgtcgacttcgaaatctcaagaagaagagcgctttcctttatcttgctagtctatcattccatccagtgatcgaaagggttagaaaaaccaaggccaaaagagctttattcaagccggtaaccggtgaaagagtatgaacccttcatcactacggatcagatacaagagggaaagggttttagctcgatgggacattgatctcaatctgcctccacgggaagaagtataagttcccgttgaggaggctcccgaacccaatatggatgtgtacggggaaaggaatccaggccgcattaaggcgattttacaggcccaactgaaagaaagaaaaaggcgctcaaaaagagagcgccataaggggtccttgaagaactggtccaggccgccggggattttattttctcgctcggatttcgatttccgcaacctggaccagtttgtgggccaggtgatcagccagcatgcgcagcgctttgatcctgataaattggagaaaaagcatgaatctttttcccggcggttaacccagcttaggaaagatgatagctccataaactatcaggcgaaaggcaatattgaacgcaatcttctcttattgtccaagaatgaaaaagaagcttctatcaatatcgtgtcgccccagggaaccccctccttctagttaagaaaggttgcgagatgggctttttcttctttttttttttcggtatgccgctccgcgagcacggagcgagagaaccaagtgggctgtggtgatgtcagaatttgcacctatttgtatctatttagtgattagtccgctagtttctttgatcctactcggtcttccttttccatttgcttccaatagttcgacctatccagaaaaattgtcggcctacgaatgtggtttcgatcctttcggtgatgccagaagtcgtttcgatatacgattttatcttgtttccattttatttattatccctgatccggaagtaacctttttctttccttgggcagtacctcccaacaagattgatctgtttggattttggtccatgatggcctttttattgattttgacgattggatttttttatgaatggaaaaggggtgctttggattgggagtaatcactagtgatagggcaaaaatcggggggaaggacaaaggaaagagcgatgcctacattaaatcaattgattcgtcatggtagagaagaaaaacggcgcacggaccgtactcgagcttcggatcaatgtccccagaagcaaggagtatgcccgcgtgtttcaacgagaacaccgaaaaaacctaattcagctctacgtaagatagctaaagtacggttgagcaatcgacatgatatatttgcttatattccaggcgaaggtcataattcgcaggaacattctatggtcttaataagaggaggcagagtgaaagatttgccaggtgtgaaatcccattgtattcgaggagtcaaggatttgctgggaattccggatcgaagaagaggcagatcaaaatatggtgcagaaaaacccaaatcgagatgaatggaagatgcctctggaacttgtttttctcagtcagtcgaggaaagaaccataacgttacgccccaaaatagaactatacggagcccttccgaatgacctataatggagtgtactacactagccaagaaagagtgtagtagactccattcgcccgtggaggaagaatcaaaaaatagaaaggtattgcttctaatagttgctcgttcataaattcactcgaccacttgttagtcttgctacactacactacacgacacgagtctagggtgaatttgaagcagacacggtcaagtgaagtcgccttcacaagtgattcaacataccatattaaaataataaaaagagaagggtctcgcccaggtggctttcccgaaaggtaatggcttcaaactcaaacaaagaacgttcttctccaaggcatgagtcaaagaaaatgctgtatgtatctaatgcaagacccatcgataagctaaggctacgacatgaaggaaggccagaagaactacagaaccacgcccaccagagctaaagggagaccgaagggacttgcggaaaaaaaccgaaagatagggtagtgatgaggatgatcagcagttaggattccttccggcttggaaacgaacaatgagatgtaccggaagactttactgataccttagctgactaagcgccaatggaatggaccccttactctcgctctacgacttcaaaggctgcagaccgggcataggccaatggggctagacctcctggacagataggaaggaataggcggatttcaaggggtacgatggatctccaccccaatcactaggccctcgatagaaccgaaagacagaaagaaaggatgaaaaaaagacgaaggcgagcaaccttctaaaggggctgcgggagaaggattacaagaattgcttagggaaagcaggtccaaaaactaacggaaaagccgcttaccccactaacacgctaccgatactacaaatagagaccttacatcgatgggttcaatcactgaaagaagaaaaaaaaggattcttgccatcactggaaaacaaattgagctgtaggcatcaaggtaagggaccgagattatatactgctgcagaagcggaatcgaaggggttggttgaaaggtttgaaatgatccaatccatgttacggaaccaagacaacctatcttactaataataagaaagggttaagggc

SEQ ID NO: 1119 - DNA, 909 bp, Medicago truncatula
caatgtgtcgaaatatcatgattgggtcgaccaggcccggatcttttttctttttttccggtatgccgctccgcgagaatggagcgaaagaaccaagtggtttgtggtaatgtcagaatttgcacctatttgtatctatttagtgatcagtctgctagtttctttgatcttactcggtcttccttttccctttgcttccaatagttcgacctatccagaaaaattgtcggcctacgaatgtggtttcgatcctttcggtgatgccagaagtcgtttcgatatacgattttatcttgtttccattttatttattattcctgatccggaagtcaccttttcctttccttgggcagtacctcccaacaagattgatccgtttggatcttggtctatgatggcctttttattgattttgacgattggatctctctatgaatggaaaaggggtgcttcggatcgggagtaatcactagtgatagggcaaaaatagggaggaaggacaaaggaaagagcgatgcctacattaaatcaattgattcgtcatggtagagaagaaaaacggcgcacggaccgtactcgagcttcggatcaatgtccccagaagcaaggagtacgcccgcgtgtttttaagagaacaccgaaaaaaccaaattcagctcaacgtaagatagccaaagtacgattgagcaatcgacatgatatatttgctcacattccgggcgaaggtcataattcgcaggaacattctacggtcttaataagaggaggtagagttaaagatttgccaggtgtgaaatcccattgtattcgaggagtcaaggatttgttgggaattccggatcgaagaagaggcagatcaaaatatggtgcagaaaaacccaaatcgatatgaatggaggatgcctctgg

SEQ ID NO: 1120 - DNA, 824 bp, Sorghum bicolor
gagagcgagagaacgaagtgggctttggtgatgtcggaatttgcacctatttgtatctatttagtgatcagtccgctagtttctttgattccactcggtgttccttttccatttgcttccaatagttcgacctatccagaaaaattgtcggcctacgaatgtggtttcgatccctccggtgatgccagaagtcgtttcgatatacgattttatccggttcctattttatttattatccctgatccggaagtcaccttttcttttccttgggcagtacctcctaacaagattgatctgtttggatcttggtccatgatggcctttttattgattttgacgattggatctctctatgaatggaaaaggggtgcttcggatcgggagtaactactagtgaaagggctaaggggggaaggacataggaaagagggatgcctacaaaaaatcaattgattcgtcatggtagagaagaaaaacggcgcacggaccgtactcgagcttcggatcaatgtccccagaagcaaggagtatgcctgcgtgtttcgacgagaacaccgaaaaaacctaattcagctctacgtaagatagcaaaagtacggttgagcaatcgacatgatatatttgctcacattccaggcgaaggtcataattcgcaggaacattctatagtcttagtcagaggaggtagagtgaaagattcgccaggtgtgaaatcccatcgtattcgaggagtcaaggatttgctgggaattccggatcgtagaaagggaagatctaaatatggtgcagaaagaccaaaatcgaaatgaatggaagatgcctct

SEQ ID NO: 1121 - DNA, 2378 bp, Vitis vinifera
atggatcagaatttgggcaatattttgggggccttaactaccagtactccgatgttgtgggttattacaagcatcgcttttgtgagtctaatatatatttgggtaagttgggccggtcacaagcgtaatgccgaccgaatcattgcccacaacgaagggttgggtcttcccatgcactatgagttcggttggctgggggtcaggatcatccctatcattggtaagggaacccccgaccggagctctagcgcacctcccaagctctagtctttttctattagttgcgatgcgaacaggcgtttacttatgagattagttgagtaggtgtgcgttagttgtctgctataagatagcgtcttttggggctttcgacatagtggagtgaccgaaaagtgagtccgccgcgaatggcagggccgggggggcactaatcaataatgatgggggtcgtgctgaggagggcgacacgcccatatcacgatccacataaggagtggtgcgaatacatgatcggaggagcctcgtagtttccgaggctaccttcttgttaataagaaaccgataccaaccagacggcgttcagaacctgccttgaagtgcaaaaattagaaggaacgcagaagtaaggaaatgagacgactctttcttgaacaatatcataaacggatcttcctctccacaccaatcacgagtttttttccattcctctcgtatatcgtcgtcacgcccttaatgctaggttttgaaaaagacttttcatgtcattccaatttaggtccgattcggatccctccgttgtttccttttcctcccgcaccttttcctcgaaatgagaaagatgatggtacactcgaattatattatataagtacttcttgcttgccaaagatcctacttctacaattggtaggtcaccgggtttttcaaataagtcgtgttttaagtggttttcccatgttactacttccgtaccaattcggtcgatccggaataaatcggttaaacattttttgtgggagcctggtcttgactcttatgtgtggtattttatctcgtttggcttttggaatcacatcctgcagtggttggaacagctcgcaaaatccaagcacttcacctactttattgcccccaaccctttatcgtacctttcttgaaacagaatggtttcatgctccttcatcgattggttattcctcttcgttcgtctcttttttttcaatgtcggtctcgattagttcacaagattgaatggccaattctcctccggaccctcgattcgattattttccaagaatgtaatgttaagccgggtatgtatgtatctgggaggaactttaaagaagggctttcggttttttgcaccctcttttggtcttgcagctttttatatttatatttcgtatataatgaagcgggggctatccgccagtagcgtcgcggattctcgatgagggggtgggttctttcttcaaacacttttttccggtatgccgctctgcgagcaaggagcgagagaaccaagtgggctatggtgatgtcagaatttgcacctatttgtatctatttagtgatcagtccgctagtttctttaatcccactcggtgttccttttccatttgcttccaatagttcgacctatccagaaaaattgtcggcctacgaatgtggtttcgatcctttcggtgatgccagaagtcgttttgatatacgattttatcttgtttcaattttatttattattcctgatccggaagtaaccttttcctttccttgggcagtacctcccaacaagattgatccgtttggatcttggtccatgatggcctttttattgattttgacgattggatctctctatgaatggaaaaggggtgcttcggatcgggagtaaccactagtgatagggcaaaaatcggggggaaggacaaaggaaagagcgatgcctacattaaatcaattgattcgtcatggtagagaagaaaaacggcgcacggaccgtactcgagcttcggatcaatgtccccagaagcaaggagtacgcccgcgtgttccaacgagaacaccgaaaaaacctaattcagctccacgtaagatagccaaagtacggttgagcaatcgacatgatatatttgctcacattccgggcgaaggtcataattcgcaggagcattctatggtgttaataagaggaggtagagtgaaagatttgccaggtgttaaatttcattgtattcgaggagtcaaggatttgctgggaattccggatagaagaagaggcagatcaaaatatggtgcggaaaaacccaaatcgatatgaatggaagatgcctctctggaacttgtttttcttggtcaatcgagggaacaaccacaac

SEQ ID NO: 1122 - DNA, 1986 bp, Vitis vinifera
atggatcagaatttgggcaatattttgggggccttaactaccagtactccgatgttgtgggttattacaagcatcgcttttgtgagtctaatatatatttgggtaagttgggccggtcacaagcgtaatgccgaccgaatcattgcccacaacgaagggttgggtcttcccatgcactatgagttcggttggctgggggtcaggatcatccctatcattggtaagggaacccccgaccggagctctagcgcacctcccaagctctagtctttttctattagttgcgatgcgaacaggcgtttacttatgagattagttgagtaggtgtgcgttagttgtctgctataagatagcgtcttttggggctttcgacatagtggagtgaccgaaaagtgagtccgccgcgaatggcagggccgggggggcactaatcaataatgatgggggtcgtgctgaggagggcgacacgcccatatcacgatccacataaggagtggtgcgaatacatgatcggaggagcctcgtagtttccgaggctaccttcttgttaataagaaaccgataccaaccagacggcgttcagaacctgccttgaagtgcaaaaattagaaggaacgcagaagtaaggaaatgagacgactctttcttgaacaatatcataaacggatcttcctctccacaccaatcacgagtttttttccattcctctcgtatatcgtcgtcacgcccttaatgctaggttttgaaaaagacttttcatgtcattccaatttaggtccgattcggatccctccgttgtttccttttcctcccgcaccttttcctcgaaatgagaaagatgatggtacactcgaattatattatataagtacttcttgcttgccaaagatcctacttctacaattggtaggtcaccgggtttttcaaataagtcgtgttttaagtggttttcccatgttactacttccgtaccaattcggtcgatccggaataaatcggttaaacattttttgtgggagcctggtcttgactcttatgtgtggtattttatctcgtttggcttttggaatcacatcctgcagtggttggaacagctcgcaaaatccaagcacttcacctactttattgcccccaaccctttatcgtacctttcttgaaacagaatggtttcatgctccttcatcgattggttattcctcttcgttcgtctcttttttttcaatgtcggtctcgattagttcacaagattgaatggccaattctcctccggaccctcgattcgattattttccaagaatgtaatgttaagccgggtatgtatgtatctgggaggaactttaaagaagggctttcggttttttgcaccctcttttggtcttgcagctttttatatttatatttcgtatataatgaagcgggggctatccgccagtagcgtcgcggattctcgatgagggggtgggttctttcttcaaacacttttttccggtatgccgctctgcgagcaaggagcgagagaaccaagtgggctatggtgatgtcagaatttgcacctatttgtatctatttagtgatcagtccgctagtttctttaatcccactcggtgttccttttccatttgcttccaatagttcgacctatccagaaaaattgtcggcctacgaatgtggtttcgatcctttcggtgatgctagaagtcgttttgatatacgattttatcttgtttcaattttatttattattcctgatccggaagtaaccttttcctttccttgggcagtacctcccaacaagattgatccgtttggatcttggtccatgatggcctttttattgattttgacaattggatctctctatgaatggaaaaggggtgcttcggatcgggagtaaccactagtgatagggcaaaaatcgggaggaaggacaaaggaaagagcgatgcctacattaaatcaattgattcgtcatggtagagaagaaaa

SEQ ID NO: 1123 - DNA, 717 bp, Vitis vinifera
gaccctcgattcgattattttccaagaatgtaatgttaagccgggtatgtatgtatctgggaggaactttaaagaagggctttcggttttttgcaccctcttttggtcttgcagctttttatatttatatttcgtatataatgaagcgggggctatccgccagtagcgtcgcggattctcgatgagggggtgggttctttcttcaaacacttttttccggtatgccgctctgcgagcaaggagcgagagaaccaagtgggctatggtgatgtcagaatttgcacctatttgtatctatttagtgatcagtccgctagtttctttaatcccactcggtgttccttttccatttgcttccaatagttcgacctatccagaaaaattgtcggcctacgaatgtggtttcgatcctttcggtgatgccagaagtcgttttgatatacgattttatcttgtttcaattttatttattattcctgatccggaagtaaccttttcctttccttgggcagtacctcccaacaagattgatccgtttggatcttggtccatgatggcctttttattgattttgacgattggatctctctatgaatggaaaaggggtgcttcggatcgggagtaaccactagtgatagggcaaaaatcggggggaaggacaaaggaaagagcgatgcctacattaaatcaattgattcgtcatggtagagaagaaaa

SEQ ID NO: 1124 - DNA, 372 bp, Vitis vinifera
tgggctatggtgatgtcagaatttgcacctatttgtatctatttagtgatcagtccgctagtttctttaatcccactcggtgttccttttccatttgcttccaatagttcgacctatccagaaaaattgtcggcctacgaatgtggtttcgatcctttcggtgatgctagaagtcgttttgatatacgattttatcttgtttcaattttatttattattcctgatccggaagtaaccttttcctttccttgggcagtacctcccaacaagattgatccgtttggatcttggtccatgatggcctttttattgattttgacaattggatctctctatgaatggaaaaggggtgcttcggatcgggagtaacca

SEQ ID NO: 1125 - DNA, 360 bp, Sorghum bicolor
atgtcggaatttgcacctatttgtatctatttagtgatcagtccgctagtttctttgattccactcggtgttccttttccatttgcttccaatagttcgacctatccagaaaaattgtcggcctacgaatgtggtttcgatccctccggtgatgccagaagtcgtttcgatatacgattttatccggttcctattttatttattatccctgatccggaagtcaccttttcttttccttgggcagtacctcctaacaagattgatctgtttggatcttggtccatgatggcctttttattgattttgacgattggatctctctatgaatggaaaaggggtgcttcggatcgggagtaacta

SEQ ID NO: 1126 - DNA, 370 bp, Cannabis sativa
gggctgtgttgatgtcagaatttgcacctatttgtatctatttagtgatcagtctgctagtttctttgatcccactcggtgttccttttccatttgcttccaatagttcaacctatccagaaaaattgtcggcctacgaatgtggtttcgatcctttcggtgatgccagaagtcgtttcgatatacgattttatcttgtttcaattttatttattatccttgatccggaagtaaccttttcctttccttgggcagtacctctcaacaagattgatccgtttggatcttggtccatgatggcctttttattgattttgacgattggatctctctatgaatggaaaaggggtgcttcggatcgggagtaatc

SEQ ID NO: 1127 - DNA, 372 bp, Lotus japonicus
tggtttgtggtaatgtcagaatttgcacctatttgtatctatttagtgatcagtctgctagtttctttgatcccactcggtcttccttttcccttagcttccaatagttcgacctatccagaaaaattgtcggcctacgaatgtggtttcgatcctttcggtgatgccagaagtcgtttcgatatacgattttatcttgtttccattttatttattattcctgatccggaagtaaccttttcctttccttgggcagtacctcccaacaagattgatccgtttggatcttggtctatgatggcctttttattgattttgacgattggatctctctatgaatggaaaaggggtgcttcggatcgggagtaatca

SEQ ID NO: 1128 - DNA, 5841 bp, Cannabis sativa
tatggtctgcaagcctatctcgctttttcatttccgttgtccctcaacaaataacataagtgcagtgaagtagcgcttcatcccaggcgacacctccgcccgcctatgacagagaggcccttctcccctttgaaatgcggaagctcgcttattcagacaactactttagaaaaggatgaacgggtcattcgtcgcgggcctttcctgttgacagttggaaggcgggtgagttgattggcaagccagctaacggggccacgaagggcccaacagattgagggctcgaaattttatacttaacacagtgagttcgaagtcctcattcaccaccaacatgcttcaatccaatctcgggggcagaacccgatcatcgagagagcatgaaacttgctggcgacatcggtgtcggcggagtgtttcgcaaacctcccagcctcaccctagccctagggttggctccgagatagggaaagtggaaacctaattctatatggatctctccttgtagatcctttataaacagggcagctatccaggatctccgctttcactttcatactcttcatgtcgcgtgtttcgctcgctatggcgagctccactcccacgctttccgttggtcaacaaccaaccacaactcactataattcttcactactcctacaggctttacggagtctggagggattcatttttgttttccatttttaaaatagcgaatgcaattgaagccctagataaatttttatctgtggacaggaacttttatttaattgctagtattgtttattcttttttgggtttttatttgtgtgcaggcgtggagcacacaataaaatcacggcaggcttattcgtataataagcgttttaacgtacccattagaaaaactaacagctggaggggaaatagtatcgaggtgcaatatcctccagtggagtgtcgtcggtgtaaagagaaagatggcaccgtcgaccttcagtctcgtcaaggggctaaaagcccccctaccccccaatcgccccctctttttagttaaaaaaggttgcggatttttcttcttgatttttttccggtatgccgctccgcgagcaaggagcgaaagaaccaagtgggctgtgttgatgtcagaatttgcacctatttgtatctatttagtgatcagtctgctagtttctttgatcccactcggtgttccttttccatttgcttccaatagttcaacctatccagaaaaattgtcggcctacgaatgtggtttcgatcctttcggtgatgccagaagtcgtttcgatatacgattttatcttgtttcaattttatttattatccttgatccggaagtaaccttttcctttccttgggcagtacctctcaacaagattgatccgtttggatcttggtccatgatggcctttttattgattttgacgattggatctctctatgaatggaaaaggggtgcttcggatcgggagtaatcactagtgatagggctaaaatcggggggaaggacaaaggaaagagcgatgcctacattaaatcaattgattcgtcatggtagagaagaaaaacggcgcacggaccgtactcgagcttcggatcaatgtccccagaagcaaggagtacgcccgcgtgtttcaacgagaacaccgaaaaaacctaattcagctccacgtaagatagccaaagtacggttgagcaatcgacatgatatatttgctcacattccgggcgaaggtcataattcgcaggaacattctatggtgttaataagaggaggtagagtgaaagatttgccaggtgtgaaatcccattgtattcgaggagtcaaagatttgctgggaattccggatcgaagaagaggcagatcaaaatatggtgcggaaaaacccaaatcgatatgaatggaagatgcctctggaacttgtttttcaatgataattttcattttgaaaaattttattagtcttcgacagtcttgagagcgaggtttggaaccctactttcactcttttctagagagaaaaagaaataggggatacccttgacgccgttctggcgctctctcccttttttatagggggtcgccctatacagacaggtccgctgttttctgagcgctttgattgctttttatgaagtagccctttttcgtttgtgcatctttccgttggtcaacaaccaaccacaactcactataattcttcactactcctacaggctttacggagtctggagggattcattttttctcaatcaacaagaatgcctcaactggataaattcacttattttacacaattcttctggttatgccttttcttctttactttctatattttcatatgcaatgatggagatggaatacttgggatcagcagaattctaaaactacggaaccaactggtttcacaccgggggaacaacatccagagcaacgaccctaaccgtttggaagatctcttgataaaaggttttagcaccggtgtatcctatatgtactctagtttattcgaagtatcccaatggtgtaacgccgtcgacttattgggaaaaaggaggaaaagaactttgatctcctgtttcggagaaataagtggctcacgaggaatggaaagaaacatattatatttgatctcgaagtcctcatatagcacttcttccaatcctggatgggggatcacttgtaggaatgacataatactaatccatgttctacacggccaaggaagcatcgttttttaatctcattatgaagcggaaactacaataaaactttctaacaaatgaaaaagtttttgactgagaaacagaagaattcgttcttacttttaatttataaaggaattcgagaacgaacgtccgtgataggcgttttcggatttttttttctgggatgggtgaaaggcccatgtcttcctacacgtgtcaagttgaataaatgaatgcagtcttaaccagagagagaaacctgcgcctttgattttaggccgccggcggcgcagaacgcactaatccgcgacctgcaagttttccgaaaccgaactgaatagaattgttactttccgctgaaaatcaaagaaggtccattttcccacgtagttcgtcggtcaaaccaacgattctcttctcaaagtaatagagagatctttttctagttagacttctatcaatgcaatgaaagaaccatcccttcctatttgtttgtcctgtcagatagaaaaaaaattagaagcccttctttaccactttagggggtgggggtgaagggggggtttacatacaaccgaggcaaaagtggtttatgattgaatctcaaaggcattcttatcatttggtagatccaagtccatggcctatttcgggttcactcggagctttggcaaccaccgtaggaggtgtgatgtacatgcactcatttcaagggggtgcaacacttctcagtttgggcatcatatttatcttatatacaatgttcgtatggtggcgcgatgttctacgtgaatccacgttggaaggacatcataccaaagtagtacaattaggacttcgatatggttttcttctgttcatcgtatcggaggttatgttcttttttgcttttttttgggctttttttcattcttctttggcacctacggtagagatcggaggtatttggcccccaaaagggattggggttttagatccttgggaaatcccttttcttaataccctaattctcctttcatccggagctgccgtaacttgggctcatcatgctatactcgcggggaaggaaaaacgagcagtttacgctttagtagctaccgttttactggctctagtattcacaggctttcaaggaatggaatattatcaagcacccttcactatttcggatagtatttatggttctacctttttcttagcaactggctttcatggttttcatgtgattatcggtactcttttcttgatcatatgtggtattcgccaatatcttggtcatctgaccaaggagcatcacgttggctttgaagcagctgcatggtactggcattttgtagacgtggtttggttattcctatttgtctctatctattggtggggaggtatatgaaggaacgaaacagtggattgagtaatgaaagctcgaagacaaagagaaccgggcttttccaaagaattactgctgctttcctactccctttgattatcatatacaaaaaagtctcttccactttcctactaaatctctctttattctggcacataaatgaagggatcgaagagattatggcagattatgttcaccaagaaatgacccgaaattgggtctttgtctatttgagattgttccttttaatcgtaatcaaagatgttttcttgtctctcgttttttttctgaacaaatcgaagaacctaatggatcgaactcatccttggctgctacgaaacatatcggccttgcgttgcggaaggaacgttctgttctgttttgagttggaggcaagagctctttcttcaataaaggtttggaaccctcgttttgccgtttccttcacggccccgctcgccagtccaacttggtgaaataccttcccgcacctaattgatcaaaaagtccgcgatgagtggcacgggctcctttttgattttgagtgttgttatgggcccgatagtcgatacatagacggaggcttgcgtcatgcgactttcgctcctctcacattcgttcgagtggcttcgctcctcgcagaaattccagatcattgaagaggaatcaaaaaaggtagttttcctataaaaaagtacctggatgttcccttgtcccccaagagaataaagagagagcattgccttcctctactggagaaaatgaaaaagagaatctcaggttggaaaagcaaattgttgtcctccggaggtcgactaacgcttattaaacatgttcgactattccgatgcacatgttaaaagttttctcgtaaattacccggcctacacttcggctactaataagggggcaagaccttacaactagattagagatgatcccttctctccagtaagtgcagtgaaggactctcgcctcacccgcccctttgacttatggcatcatcgacttgcttttcaacctaagcgatttcataaccagaaagaaagacctctctttcgggatcagtcccgtccctagatgtagtagtcaatcagcgggacattcaaagaagctatgcaccttcactgaatgttaatgaaagcaagccctttcatcctaatctcatctactgaaaaggcggccgggcgtagcgcgttcttttttgggacacataggctattacagacgcatcattaaagactttgcgaagcgcggaatggaatcattgcagaataaaggtataacggttggggaccggaacaggattaagcctttaagcatgcggatgctgtcagccccggtttccggattggaataaggagttcatgttcatactgacgcatcactctatgccattggatgtatgttggcgcaggaagggccgctagatcaccccatctactttgcaagtagacgactttccgcttgggaattatacaaccatcaaaccttctttatcatgatccgacccacacctacgaccaagattgagtaccagagctgctcataacaacgtaccaaaaagaagaatgtgatgagttcatattctccagattcgactataaaccagatagtgaggatgaaaaaaaaagcataagctacctcgttcgtgctcccgtctttcccgctgccatcttcggtggatggccccctatctcttaaagcttctatgcgacccatgtagctatttattggtgcct

SEQ ID NO: 1129 - DNA, 986 bp, Setaria italica
tgaaaatcctttttagcttgtttcagtgggaagagcaaggggcattgcccttgaaatccttcagtggttcgaatccacatctgagcgtcttttttttttcggtatgccgctccgcgagcaaggagcgccgcgaggagagcgagagaacgaagtgggctttggtgatgtcggaatttgcacctatttgtatctatttagtgatcagtccgctagtttctttgattccactcggtgttccttttccatttgcttccaatagttcgacctatccagaaaaattgtcggcctacgaatgtggttccgatccctccggtgatgccagaagtcgtttcgatatacgattttatccggttcctattttatttattatccctgatccggaagtcaccttttcttttccttgggcagtacctcctaacaagattgatctgtttggatcttggtccatgatggcctttttattgattttgacgattggatctctctatgaatggaaaaggggtgcttcggatcgggagtaaccactagtgaaagggctaaggggggaaggacataggaaagaggaatgcctacaaaaaatcaattgattcgtcatggtagagaagaaaaacggcgcacggaccgtactcgagcttcggatcaatgtccccagaagcaaggagtatgcctgcgtgtttcgacgagaacaccgaaaaaacctaattcagctctacgtaagatagcaaaagtacggttgagcaatcgacatgatatatttgctcacattccaggcgaaggtcataattcgcaggaacattctatagtcttagtcagaggaggtagagtgaaagattcgccaggtgtgaaatcccatcgtattcgaggagtcaaggatttgctgggaattccggatcgtagaaagggaagatctaaatatggtgcagaaagaccaaaatcgaaatgaatggaagatgcctctggaactttttggttcttttgttcgggag

SEQ ID NO: 1130 - DNA, 825 bp, Brachypodium distachyon
tgggctttggtgatgtcggaatttgcacctatttgtatctatttagtgatcagtccgctagtttctttgattccactcggtgttccttttccatttgcttccaatagttcgacctatccagaaaaattgtcggcctacgaatgtggttccgatccctccggtgatgccagaagtcgtttcgatatacgattttatccggttcctattttatttattatccctgatccggaagtcaccttttcttttccttgggcagtacctcctaacaagattgatctgtttggatcttggtccatgatggcttttttattgattttgacgattggatctctctatgaatggaaaaggggtgcttcggatcgggagtaaccactttggaaagggcaaaggggggaaggacataggaaagagggatgcctacaaaaaatcaattgattcgtcatggtagagaagaaaaacggcgcacggaccgtactcgagcttcggatcaatgtccccagaagcaaggagtatgcctgcgtgtttcgacgagaacaccgaaaaaacctaattcagctctacgtaagatagcaaaagtacggttgagcaatcgacatgatatatttgctcacattccaggcgaaggtcataattcgcaggaacattctatagtcttagtaagaggaggtagagtgaaagattcgccaggtgtgaaatcccatcgtattcgaggagtcaaggatttgctgggaattccggatcgtagaaagggaagatcaaaatatggtgcagaaagacctaaatcgaaatgaatggaagatgcctctggaactttttggttctttt

SEQ ID NO: 1131 - DNA, 781 bp, Cucumis sativus
tgggctgtggtgatgtcagaatttgcacctatttgtatctatttagtgatcagtccgctagtttctttgatcccactcggtcttccttttccattttcttccaatagttcaacctatccagaaaaattgtcggcctatgaatgtggtttcgatccttccggtgatgccagaagtcgtttcgatatccgattttatcttgtttccattttatttattatccttgatccggaagtcaccttttcctttccttgggcagtacctctcaacaagattgatctctttggatcttggtccatgatggcctttttattgattttgacgattggatttctctatgaatggaaaaggggtgcttcggatcgggagtaatcactagtgagagggcgatgcctacattaaatcaattgattcgtcatggtagagaagaaaaacggcgcacggaccgtactcgagcttcggatcaatgtccccagaagcaaggagtacgcccgcgtcttgcaacgagaacaccgaaaaaacctaattcagctccacgtaagatagccaaagtacggttgagcaatcgacatgatatatttgctcacattccgggcgaaggtcataatttgcaggaacattctatggtcttaataagaggaggtagagtgaaagattcgccaggtgtgaaatcccattgtattcgaggagtcaaggatttgctgggaattccggatcgaagaagaggcagatctaaatatggtgcagaaaaaccaaaatcgatatgaatggaagatgcctctgg

SEQ ID NO: 1132 - DNA, 1249 bp, Malus domestica
cgttatgccgctccgcgagcaaggagcgaaagaaccaagtgggctgtggtgatgtcagaatttgcacctatttgtatctatttagcgatcagtccgctagtttctttgatcccactcggtgttccttttccatttgcttccaatagttcaacctatccagaaaaattgtcggcctatgaatgtggtttcgatcctttcggtgatgccagaagtcgtttcgatatacgattttatcttgtttcaattttatttattatccttgatccggaagtaaccttttcctttccttgggcagtacctctcaacaagattgatccgtttggatcttggtccatgatggcctttttattgattttgacgatcggatctctctatgaatggaaaaggggtgcttcggatcgggagtaatcactagtgatagggcaaaaatcgggggaaaggacaaaggaaagagcgatgcccacattaaatcaattgattcgtcatggtagagaagaaaaacggcgcacggaccgtactcgagcttcggatcaatgtccccagaagcaaggagtatgcccgcgtgtttcaacgagaacaccgaaaaaacctaattcagctccacgtaagatagccaaagtacgtttgagcaatcgacatgatatatttgctcacattccaggcgaaggtcataatttgcaggaacattctatggtgttaataagaggaggtagagtgaaagatttgccaggtgtgaaattccattgtattcgaggagtcaaggatttgctgggaattccggatcgaagaagaggcagatcaaaatatggtgcggaaaaacccaaatcgagatgaatggaagatgcctctggaactaacttgtttttctagatcagtcgaggtattcattgaaaagtctcaatgctatcttcgacagtcttgagagcgagggccgcaatagcgaccactaaaattttgtttctaaaagatcccgctcttgatctgggcgggatctatcagcagcggcattcttccttgctcgttcctaggaactcagtaacgtggccagtaagtcagcgagcattgaggcaggcagacagatattataaactgctttaagtcggtaaggcaaggaaggctgatttcaccgatcattcctacttgacgctttggacgagtattttcaaaacctcagttcactatcattaagggaacttcttggatcaccgctttgagtcttaaggcgacggaaggcagaagagggaaagtc

SEQ ID NO: 1133 - DNA, 852 bp, Solanum lycopersicum
tcggtatgccgctccgccagcaaggagcgaaagaaccaagttttctatggtgatgtcagaatttgcacctatttgtatctatttagtgatcagcccgctagtttctttgatcccactcggtcttccttttctattttcttccaatagttcgacctatccagaaaaattgtcggcctacgaatgtggtttcgatccttctggtgatgccagaagtcgttttgatataagattttatcttgtttccattttatttattattcctgatccggaagtaaccttttcctttccttgggcagtacctcccaacaagattgatccatttggatcttggtccatgatggcctttttattgattttgacggttggatctctctatgaatggaaaaggggtgcttcggatcgggagtaaccactagtgatagggcaaaaataggggggaaggacaaaggaaagagcgatgcctacattaaatcaattgattcgtcatggtagagaagaaaaatggcgcacggaccgtactcgagctttggatcaatgtccccagaagcaaggattatgcccgcgtgtttcaatgagaacaccgaaaaaacctaattcagctctacgtaagatagccaaagtacggttgagcaatcgacatgatatatttgctcacattccagacgaaggtcataatttgcaggaacattctatggtcttaataagaggaggtagagtgaaagatttgccaggtgtgaaattccattgtattcgaggagtcaaggatttgctgggaattccggatcgaagaagaggcagatcaaaatatggtgcggaaaaacataaaatagatatgaatggaagatgcctctg

SEQ ID NO: 1134 - DNA, 371 bp, Lotus japonicus
tggtttgtggtaatgtcagaatttgcacctatttgtatctatttagtgatcagtctgctagtttctttgatcccactcggtcttccttttcccttagcttccaatagttcgacctatccagaaaaattgtcggcctacgaatgtggtttcgatcctttcggtgatgccagaagtcgtttcgatatacgattttatcttgtttccattttatttattattcctgatccggaagtaaccttttcctttccttgggcagtacctcccaacaagattgatccgtttggatcttggtctatgatggcctttttattgattttgacgattggatctctctatgaatggaaaggggtgcttcggatcgggagtaatca

SEQ ID NO: 1135 - DNA, 1390 bp, Arabidopsis lyrata
aaaaatcaaaagaaaataaagtagaggagcaagaaaagcaaagcagccggtccttttccatttcctgaataatttgtctccgtctctaccttccatctctctcacccgctctcctcggaaaccacagcgacggacgataaagcttttgcctctaattttactcctgaaaatctggaatcagccggagcgaatctcgaagcttatgatctcaacttgctgaagaggctgggaatggctggtaaagaggagactaatgtatctgcacaagggtctttaaccagggaagctactgagatatggaagagtgagttggaatctcgtcggttgcaggtagatagtttagaagctgaacttgtggatgtcaaggcttaccttgagtttggttcagaagaagatgccagaaaggaattaggggttctttccggtagggtcagatcgactgcaactatgttgcggtatttgagatcaaaagctagaatcttggccattcctgatgatctaccaaatgtgtcatgtggtgtggaacagattgaactgaaaggattgaactttcttgagaaagatggtggttcatcttcttctggaggggctagcaacactagtcctgaaactagaaggtaccgtggttccttgggtatagaggatggagcctatactaatgagatgctccaatccatagagatggttactgatgtgctggactctcttgtgaggagggttaccgcagcagaatctgagacggctgttcaaaaagagagggcacttttgggagaggaagaaatcagtaggaagacaatccagatcgaaaatttgtccttgaagttagaagagatggaacgatttgcttatgggactaatagtgttctaaacgaaatgcgggaaaggattgaggaattagttgaagagacgatgaggcagagggaaaaagctgtggaaaatgaagaggagctgtgtcgtgtgaagagagagttcgagtcgcttaaaagctatgtcagtacttttaccaatgttagagaaacacttctttcgtccgagagacaattcaaaaccatcgaggagctctttgaacggctggtcactaagacaacacaattagaaggcgagaaggcacaaaaggaggttgaagttcagaaactgatggaggagaatgtgaaattgacagcacttctcgacaagaaagaggctcagcttctagctttgaatgaacaatgcaaagttatggctttgagtgcatcaaacatatgaatttgctatatctttgcatcaaacatatgaatttcttgagacaattctttcgcagaagatagatgatgcaatcttcttccttcattgttttttgcttcaaatgtgacattgtaatttttatctgtagattattatggttcatgca

SEQ ID NO: 1136 - DNA, 1442 bp, Eutrema parvulum
aaggcaaaaaaatcaaaagaaattaaagtagaggagcaacgaaagcaaagcaggtggtcctttcccatttcctcctgtaaaattgtcttcgtctctaccttccatctcacccgctctcttcggaaaaccctcgacggaagatcaactttttgcctctaatcctcgaatcaatcagccggagcaaatctccaaccttatgatctccaattttctggaaaataggctgggggatggcttgtaaagaaggtactaatatatctgcacaagagtctttaaccggggaagccaccgagatatggaagagtgaattggaatctcgtcggttccaggtagatagtttagaagctgagcttttgaatgttaaggcataccttgactttggttcggaagaagatgccaggaaggagttaggtgttcttttgggtagggtgagaacgactgcaacaatgttgcgctatttgaaatcaaaagctagaatcttggccatccctgatctagctcatttgtcatgcggtgtggaacagatggaactgaaaggattaaactttcttgagaaagatggtggttcatcttcttgtgaagatacattgactgaagttagaaggcaccggggttccttgggtatagaagatggagcttatactagtgagatgctccaatccatagagatggttactgatgtgctggagtctcttgtaaggagagttacagcagcagaatctgagacggctgttcaaaaggagatggtacttttgggagaggaagaacttagtaggaagacagtccaaatcgagaatttgtccataaagttagaagagatggaacgatttgctcatgggactaacagtgttctgaacgaaatgcgggaaaggattgaggatctagttgaagagacaatgagacagagggaaaaagctgtggaaaatgaagaggagctgtgtcgtgtgaagagagaattcgaatcgcttaaaacctatgtcagtacttttactaatgttagagaaacacttctttcgtccgagagacaattcaagaccatcgaagagctctttgaacggttggtcactaagacgacacaactagagggcgagaaggcgcaaaaggaggtcgaagttcagaaactgatggaagaaaatgtgaagttgacggcgcttcttgacaagaaagaagctcagcttctagctttgaatgaacaatgcaaagttatggctttaagtgcatcaaacatctgatttgcatttgcttctatcttcagctggcattgtttttttagctcatctcttattgtttatttttctcttcttgagacaatgctttcgcagaagtaaagatcttcgagattgttgcaaggcttcttactccattgttctttgcttcggacaaaaacattcttgtaactttcatctgtaaattatcatggcttatagagcctatatcttcta

SEQ ID NO: 1137 - DNA, 1284 bp, Arabidopsis lyrata
gcaaaaaatcaaaagaaattaaagtagaggagcaacaaaagcaaaacagttctgtaaattgtcttcgtctccaccttccatctcacccgttctcttcggaaaacacagcgacggccctctaattcgttcctgaaaatctggaatcggccggagcgaatctcgaagcttatgatctcgagttggaaaagaggttgggggatggctggtagagaggatactaatgcatctgcacaagagttcttaaacagggaagccactgagatatggaagagtgaattggaatctcgtcggttgcaggtagatagtttagaagctgaacttgttgatgtcaatgcttaccttgagtttggttcagaagaagatgccagaaaggaattaggggttctttcgggtagggtcagatcgactgcaacaatgttgcgctatttgagatcaaaagctggaaacttggccattcctgatctagcgaatgtgtcatccggtaaagatggtggttcatcttctgaaggggagaggaacactagaaggtaccatggttccttgggtgtagaggatggagcctatactaatgagatgctccaatccatagaaatggttactgatgtgctggaatctcttgtgaggagggttacagcagcagaatctgagacggctgttcaaaaggagaaggcacttttgggcgaggaagaaatcagtaggaagacagtccaaatcgagaatttgtcctcgaagttagaagaaatggaacgatttgctcatgggactaatagtgttctaaatgaaatgcgggaaaggattgaggaactagttgaagagacgatgagacaaagggaaaaagctaaggaaaacgaagaggagctgtggcgtgtgaagagagagttcgagtcgcttaaaagctatgttagtacttttaccaatgtcagagaaacacttctttcatccgagagacaattcaaaaccattgaggagctctttgaaaggttggtcactaagacgacacaattagaaggtgagaaggcacaaaaggaggttgaagttcagaaactgatggaggagaatgtgaaattgacggcacttctcgacaagaaagaggctcagcttctagctttaaatgaacaatgcaaagtcatggctttgagtgcatcaaacatttgaatttgctatctttgcattgttgttgactcatctcttattgccatctttctattcttgagacaaatgctttcgcagaagagaagatcttcgagatgatgcaatattcttccttcattgttctttgtttca

SEQ ID NO: 1138 - DNA, 1337 bp, Eutrema halophilum
aagaaaataaatcaaaaggagaaaaaaattaaaagtagagaggagcaacaaaagcaaagcagctggtcctttcccattgccctgtaaattgtcttcgtctcctaccttccatctcacccgctctcttcggaaaacccccgaccaaagattaatcaaagaagctttttccctctaattcgttccctcgaatccaatcaagccggagcaaatctccaagctttatgatctccaatttttgaagagggctggggatggcttgtaaagaagatactaattcatctgcacaagagtcattaaccaaggaagagagtgaattggaatctcatcggtttcaggtagatagtttagaagctgagcttttgaatgtcaaggcttaccttgagtttggttcagaagaagatgccaggaaggagttagtggatctttcgggtagggtgagagaaactgcaactattttgcgctatttgagatcaaaagctagaatcttggccattcctagtctagctcatgtggaacagatgggactgaaaggattagaccttgttgagaaagatggtgattcatcatcttctgaagatgcagctagaaggcaccgggatggttcctctggtgtagaggatggagcgtatactagtgagatgctccagtccatagagatggttactgatgtgttggaatctctcgttaggagagttacagcagcagaatctgagacggctgttcaaaaggagatggtgcttttgggagaggaagagcttagtaggaagacagtccagatcgagaatctgtcgtccaagttacaagagatggagcggtttgctcacgggactaatagtgtcctgaacgagatgcgggagaggattgaggagcttgttgaagagacgatgagacagagggaaaaagctgttgagaatgaagaggagctttgtcgtgtgaagagagagttcgagtctcttaaaagctatgtcagtacttttaccaatgtcagagaaacgcttctttcgtctgagagacaattcaaaaccatcgaagagctctttgaacggttggtgacaaagacgacgcaattagagggagagaaggcgcagaaagaggttgaagttcagaaactgatggaggagaatgtgaaattgacggcacttcttgacaagaaagaggctcagcttctagctttgaatgaacaatgcaaagttatggctttaagtgcatcaaacatctgaaatttgcttctatttttgtttttgtttttgttttggctcatctcttgttggtgtcatctttctcatcgtgagacaatgttttcacagacatttatatcaccattatgactttcaagc

SEQ ID NO: 1139 - DNA, 1334 bp, Brassica napus
tcagcgataaattaaagcacaggaggaagaggagggggaaaaacaaaacaaaagcaaagcagctttgggttcctttcccatttcagcctctaccttccaatctctctcacccgctctcttcggcaaaccctcaacgcaagatcaaatcctttttgcctctaattcgttcccccaatcaatcgatcaagcagccggagcttatgatctcgaatttttgaagagactgtggatggcttgtaaagaggacactaatgcatctgcgcaagagtctttaacccgggaagactctgagatatgtaggactgaattggaatctcggcggtttcaggtagatagtttagaagctgagcttatggatgtcaaggcttgccttgagttcggttcagaggaagacgccagaaaggagttaggcgttctttctggtagggtgagaacgactgcgacaatgttgcggtacttgagatcaaaagctacagtcttggccattcctgatctatctcagatggtacttaaagacggtggtggttcatcttcctgtgaagatacattatctgaagctagaaggcactgtggtggctccttgggtatagaggatggagcttatactagtgagatgctccagtccatagagatggttactaacgtgcttgagtttcttgttaagagagtttcagtagcggaatctgagactgctgttcaaaaggagatggtactcttgggagaggaagagcttagtaagaagacggtccaaatcgagaatctggccgtaaagttacaagagatggagcggtttgctcacggaactaatagtgttctgagcgaaatgagggaaaggattgaggagctagttgaagagacgatgagacagagggagaaagctgtggagaatgaagaggagctgtgtcgtgtgaagagagagttcgagtctcttaaaagctatgtcagcactttcaccaatgtcagggaaacgcttctttcgtctgagagacagttcaaaaccatcgaagagctctttgaacggttggtgagtaagacgacacaactagaggaagagaaggcgcaaaaggaggttgaagtacagaaactgatggaagagaatgtgaaattgacagcacttcttgacaagaaagaagctcagcttttagcgttgaatgaacaatgcaaagttatggctttaagtgcatcaaacatctgaacatttgcttatttcttcgcctcatctcttgttgttatgattttttctctttcttaagacaaagacaatggttttgacgaagagaagatcttccaaattgttgcaaagctgcttactctattgttctttggttcagatt

SEQ ID NO: 1140 - DNA, 818 bp, Arabidopsis lyrata
ccttctactgttacttggatatgagctctgtttgtggtaagttggatttccaagatgcagactttgacatctcgagtcccacgcaatgttctaaaggctcgaagcatacctcgtttactgcatctgaagattctcaggagtctgatggagatgaaactggttatatagacccaactgcgtatgaagaaaccgctgttcaggatttcggcaaatccactttaagtcccaactctttggatgatgaagacaaggatgagaaccttacgactcaaacaccaattgttctcatcccagccataaaaggcagccgagagaagcatggcttgtcactgaggaagtctagtgtttcatgggcggctgatgtgtatgatcctcctccctcgatagcctcccacacagtcacaagaagcaagaaacagcagcagaaatccaagagcaaagacaaccacaggaagactggaaagaaaggacagaagagcaaagacaactcttcctcacgtggtggcagcagcaaagacaagaagcaagcttctcgcaaacacagtcgggacaaatttgaatgggtaactcagatgcctatagttgcagcttcttcttaaatggtattggctgctagtaaccaagcacgtctttgagcttggcctcctcttgtgtgataaataatcaaatctctttgtgagtgattcctgttgagtttcgtaacttttcttatgggtaatggatgatccttaacactattgtgaatactttgttgaagtttgttacttttttctttttggattaagttttcacttttgagaataactcaatggaacttt

SEQ ID NO: 1141 - DNA, 1031 bp, Arabidopsis lyrata
cggcttattcttaagaatccttccacagtcgccgccgatataatcttctccgccagatttgtgagggatcaaaatggctccaaatggctcccagaggaagaagaaagaagcctggattgatgcgagaggatgcagcacgagatcgcatgagagtttttgggtttcatgagcgtgttatcagtgagagtattaaggaactgttagaggtctatggtgaagaccaatggtttttgattgaagatgatagctatggtcccctccttgctatctgccttgaaaagcaagcggaaaaagacaaacaattggctgaagtacaagcctaccaattgcctgagaatcaagatgaagagatggctgaggaagaacaacccaaccaattggctgaggaagaacaagaagaagagaaggagcaggagcaggacatgcaaattgagtatggaagagaccaagctgataagttatcaatcaatagcgatgcagtcatggacccatcaccagcagctttacatttgggagaagcattagcagattatgcacaaggttctgttggaggtgtcgaaaatcttcactgtggatggctaagttcggaggaggagacggatcctgaggaggagacggatccaaaggagaaggagacggagccagaggaggaggagacgaatccaaaggagaaggagacggagccagaggaggatagtgacggtgatgatgatgagatcattcagctaactccagaacctctttgtgaagaacttcaagagcttctcagggaagtacgtggacagaagaggaggaagaaagagacgaggtgggacaagtaaaggagtcatgagctcctgtaagtaacaaattgatatatatgttaggaagccaaatagtagtaagctatagtattgtggtgaaaaaaggtaaaacgacccatcttgacatctctgtgtgggttttaatataatttgggtttaagtagagaaagcaaatattctttatcagtagttgtatgattcatactatagtacacgaacccacttatc

SEQ ID NO: 1142 - DNA, 645 bp, Arabidopsis thaliana
gagtaaaccctagcagcggacacacacttaagtccatcgacatctggagagtgagaagagaggaatagccaaagatgactttcaagcgaaggaacggtgggaggaacaagcacaacagaggacacgtcaacccaatcagatgctccaactgcggcaaatgctgccctaaggacaaggccattaagaggttcattgtgaggaacattgtggagcaggctgctattagagatgttcaggaagctagcgtctatgagggatacacattgccgaagctatatgcaaagacgcaatactgtgtctcctgtgctatccactctcacgtcgttagagtccgttcccgcaccaaccgtagggttcgtactcctcctccacgtttcaccagacgcaaggaggatactcccaagcctggacagccaggacaggcccctcgtccagctgggcctggagctgcagctgcaccgcgtgtctgaagcctgcaatcagcttaaattgtagtttcatttttcaagatttttgtttttcttatgttggcttcagattttgtttccttgtgaatctccttatgttttttttttttttcaaataaatgtctcgactttgttattattatatataaacctcatagttttgcaatttgcttaagtt

SEQ ID NO: 1143 - DNA, 601 bp, Arabidopsis lyrata
aagtccatcgacatcgagaacagaggaaaagccaaagatgactttcaagcgtaggaacggtggaaggaacaagcacaacagaggtcacgtcaagccaatcagatgctccaactgtggcaaatgttgtcccaaggataaggccattaagaggttcattgtgaggaacattgtggagcaggctgctattagagatgttcaggaagctagcgtctacgaagcatacacattaccgaagctatatgcaaagacgcaatactgtgtctcctgtgctatccactctcacgtcgttagagttcgatcccgcaccaaccgtagggttcgtactcctccacctcgtttcgccagacgcaaggaggatactcccaagcctgggcaaccaggacaggcccctcgtccagctggacctggagctgcagctgcaccgcgtgcctgaaacctgcaatcagcttaaattgtagtttcatttttcaagatttttgtttttcgtatgttggcttcagattttattcccatgtgaatctccaaatgctgttttttttaataaatgtctcgactttgttattattatatatgtaaacctctatagttttgcaatctgctt

SEQ ID NO: 1144 - DNA, 396 bp, Arabidopsis lyrata
cagactttcaagcgtaggaacggtggaaggaacaagcacaacagaggtcacgtcaagccaatcagatgctccaactgtggcaaatgttgtcccaaggacaaggccattaagaggttcattgtgaggaacattgtggagcaggctgctattagagatgtccaggaagctagcgtctacgaagcatacacattaccgaagctatatgcaaagacgcaatactgtgtctcctgtgctatccactctcacgtcgttagagtccgttcccgcaccaaccgtagggtccgtactcctccaccgcgttttgccagacgcaaggaggatactcccaagcctgggcaaccaggacaggcccctcgtccagctggacctggacctgcagctgcaccgcgtgtctga

SEQ ID NO: 1145 - DNA, 813 bp, Eutrema halophilum
atgatgagccaggccttgggcttgcagagtatcaataacgggcctcaaacatttaagttaacccaccgtaataaaaccctaaagggggaaccgtgtacatataatacagattactttgggtttttagggttacagcattcttcctctgtcgccgcaaaaaaagagaacagacgcaataggcttgaagctctctgctgcaacatgactttcaagcgcaggaatggtggcaggaacaagcacaaccgtggtcatgtgaaccccatcaggtgttccaactgcgggaagtgctgccccaaggacaaggcgattaagagattcatcgtcaggaacattgttgaacaggctgccatcagagatgttcaagaagccagcgtctacgatggttacactctcccaaagctgtacgctaagatgcaatactgtgtgtcatgtgcaatccactctcacgttgtgagagtccgatcccgcaccaaccgtagggtccgtacccctcctccccgttttgccagacgcaaggaggatactcccaagcctggacaacctggtcaggctcctcgcccagctggtggtgctcctgctgcacctcgtgcttaaagactgcctccatcccaaaactctttattttctattttcagtctcagtgtttgaattttttgaagatgttttctacatttggttaaagatcattttgtcatgtcaagctttgaacgctctaagactatttatcagtttattttgactttggcgctctattttacttgtgcttgtattttcaagattaatcttgagcaaccacagattcgctaatcttaa

SEQ ID NO: 1146 - DNA, 642 bp, Arabidopsis lyrata
tattttgcaaattttagggttactgaacacttcttcttccctgtcgccgcatcaaagagaactgaagcaataagcttttgaatctctctgcatcaacatgactttcaagcgtaggaatggtggcaggaacaagcataaccgtggtcatgtgaacccaatcaggtgttccaactgtggaaagtgttgccccaaggataaggcgattaagagattcatcgtcaggaacattgttgagcaggctgctattagagatgtgcaagaagctagcgtctacgaagcttacactctcccaaagctttacgctaagatgcaatactgcgtctcttgtgctatccactctcacgttgttagagtccgatcccgcactaaccgtagggttcgtaccccaccacctcgtttcgccagacgcaaggaggacactcccaagcctggacagcctggtcaggctcctcgccctgctggtggtgctcctgctgctcctcgtgcctaaagacttcaagaagctggcaatccaaaactttttatattctagtttcagtctctctgttgtctgaaatttttgaagatgttttctacattttgctaaagatgatttcgccatatggagcgttaaatgtttcagaccattttaccagttgattt

SEQ ID NO: 1147 - DNA, 640 bp, Arabidopsis thaliana
agaatatttcgcaaatattagggttcctgcactcttcttcttccctgtcgccgcatcaaagagaactgaagcaataggcttttgaagctctctgcataaacatgactttcaagcgcaggaatggtggcaggaacaagcataaccgtggtcatgtgaaaccaatcaggtgttccaactgtggaaagtgttgccccaaggacaaggcgattaagagatttatcgtaaggaacattgttgagcaggctgctattagagatgttcaagaagctagcgtctacgaaggttacactctcccaaagctttacgctaagacgcagtactgtgtctcgtgtgctatccattctcacgttgtgagagtccgatcccgcaccaaccgtagagttcgtaccccaccacctcgttttgccagacgcaaggaggatacacccaagcctgcacaacctggtcaggctcctcgccctgccggtggtgctcctgctgctcctcgtgcctgaagacttcaagaagctggcaatccgaaacttcttatattctagtttcaatctctcttttgtctgaaatttttgaagatgttttctacattttgttaaagatgatttcgccatattggagctttaaacgtttcagaccattttaccag

SEQ ID NO: 1148 - DNA, 620 bp, Raphanus sativus
gccgcaacgaaaaagaaacgcgaataggctttgttctaactctccacactgcaacatgactttcaagcgcaggaacggtggaaggaacaagcacaaccgtggtcatgtgaaccccatcaggtgttccaactgcgggaaatgctgtcccaaggataaggcgatcaagaggttcatcgtcaggaacatcgttgaacaagctgccatcagagatgttcaagaagccagtgtgtacgatggttacactctcccgaagttgtatgccaagacgcagtactgtgtctcatgtgctatccactctcacgtcgtgagagtccgttcccgcaccaaccgtagggttcgtaccccacctccacgttttgtcagacgcaaggaggatgctcccaagcccggacaacctggtcaggccgctcgccctgctggtggtgcccctgctgctgctgctcgtgcttaaagactgcaagaagctggcaactcaaaaatctttatgttctagtatcagtctcagggttggctagaatttttgaagatgttttctgcatttggttaaaagataatttcgtcatgtggacctttgaatactgtgagactatttatcagtttgttttgacatttggcgtttc

SEQ ID NO: 1149 - DNA, 674 bp, Raphanus sativus
  misc_feature (591)..(591): n is a, c, g, or t
  misc_feature (636)..(636): n is a, c, g, or t
gggtcaagaagagagtaaccctagcagcagcttttcagctcaagaagagaggaggaattttagtcgcagccgcatatcaaagaacatgactttcaagcgtaggaacggaggaaggaacaagcacaaccgtggccacgtcaacccaatcagatgctccaactgtggcaaatgttgcccaaaggacaaggccataaagaggttcatagtgaggaacatagtggagcaggctgccattagagatgttcaggaagccagtgtctacgatgggtacactctccctaagctgtatgcgaagacgcagtactgtgtctcatgtgccatccactctcacgttgttagagtccgttcccgcaccaaccgcagggttcgtactccccctccacgtttcgtcagacgcaaggaggatgcgcccaagcctggacaacctggtcaggctcctcgtcctgctggagctggagctgctgcacctcgtacctgaagaagcctttgaagatttgtttttttttttttctgttgctactagtaccatctgaatctcaaaatgcagtttgatgtttcgactttgttatattccagacatgtctttttttncaacataactgattgagcatctgtctgtttttcatttcttcaatnctctgttctagtattgaagatataatttcgcaaaaaaa

SEQ ID NO: 1150 - DNA, 681 bp, Thellungiella halophila
gagggttacagcattcttcctctgtcgccgcaaaaaaagagaacagacgcaataggcttgaagctctctgctgcaacatgactttcaagcgcaggaatggtggcaggaacaagcacaaccgtggtcatgtgaaccccatcaggtgttccaactgcgggaagtgctgccccaaggacaaggcgattaagagattcatcgtcaggaacattgttgaacaggctgccatcagagatgttcaagaagccagcgtctacgatggttacactctcccaaagctgtacgctaagatgcaatactgtgtgtcatgtgcaatccactctcacgttgtgagagtccgatcccgcaccaaccgtagggtccgtacccctcctccccgttttgccagacgcaaggaggatactcccaagcctggacaacctggtcaggctcctcgcccagctggtggtgctcctgctgcacctcgtgcttaaagactgcctccatcccaaaactctttattttctattttcagtctcagtgtttgaattttttgaagatgttttctacatttggttaaagatcattttgtcatgtcaagctttgaacgctctaagactatttatcagtttattttgactttggcgctctattttacttgtgcttgtattttcaagattaatcttgagcaaccacagattcgct

SEQ ID NO: 1151 - DNA, 531 bp, Brassica napus
gtcttagtcgccgccgccgagcaaagaagatgactttcaagcgcaggaacggagggaggaacaagcacaaccgtgggcacgtgaagccaatcagatgctccaactgcggcaaatgttgcccaaaggacaaggccatcaagaggttcatcgtgaggaacattgtggagcaggctgctattagagatgttcaggaagctagcgtctacgatgggtacacattgcctaagctgtatgctaagacgcagtactgtgtctcatgtgcgatacactctcacgttgttagagttcgttcccgtaccaaccgtagggttcgtactcccccgcctcgttttgttagacgcaaggaggatgctcccaagcctgggcaacctggtcaggctcctcgtcctgctggagctgcagctgccccgcgtgcctgaagcctctgaatatccttgtttcagctttttgaagttttatgttttggttcagattattcgtactagtaccatgttgaatctcgaaagctgttttagtagtgttcttgtttcg

SEQ ID NO: 1152 - DNA, 600 bp, Eutrema halophilum
aaccctagcagtcacagctgagatcattgtgccttcgtttcacgagaagagaggaaaaggaaaaagcttcttctccaagatgactttcaagcgtaggaacggtgggagaaacaagcacaaccgaggtcacgtcaacccaatcagatgctccaactgtggcaaatgttgcccaaaggacaaggcgattaagaggtttatcgtcaggaacattgtggagcaggctgccattagagatgttcaggaagctagcgtctacgatgggtacacattgccgaagctatattcgaaggtgcaatactgtgtctcatgtgcgatccactctcacgttgtcagagtccgatcccgcaccaaccgcagggttcgtactccaccgccgcgttttgccagacgcaaggaggatgctcccaagcctggtcaaccaggacaggcccctcgtcctgctggagctggacctggagctgcaccgcgtgtctgaagcctgcttctttctttttttttcctaaggattttgttttccttatgttgggtttagaatgtactccctctgtttccaataattacatgttttttgatatttcacaatattaattaagtatttac

SEQ ID NO: 1153 - DNA, 702 bp, Brassica juncea
cgcgggggtcgtcgacgagaagagagtaaccctagcagcagcagacacacacacagcttctcatctcacgagaaagagagatctttagtcgcaaccgaagatgactttcaagcgtaggaacggtgggaggaacaagcacaaccgtggacacgtgaacccaatcagatgctccaactgcggcaaatgttgcccaaaggacaaggccatcaagaggttcatcgtgaggaacattgtggagcaggctgccattagagatgttcaggaagctagcgtctacgatgggtacacattgcctaagctgtacgcgaagacgcaatactgtgtctcctgtgcgatccactctcacgttgttagagtccgttcccgcaccaaccgcagggttcgtaccccgcctcctcgttttgttagacgcaaggaggatgctcccaagcctggacaacctggtcaggctcctcgtcctgctggagctggagctgctgcaccgcgtgcctgaagcctttgaagatttgttttttttccttttgctactagtacccatctgaatctcaaaaaccagtttgatgtttcgactgtgttgtattcccaaacatgtctttttttctgcatcataactgattgagcacgttcttatactctcatccgtgtgtttctcatctgtgtgttttttactttgtctttcatttcgtcaatgctctgtttcta

SEQ ID NO: 1154 - DNA, 653 bp, Brassica juncea
cacacacacagctcaccagaagagaggagtcttagtcgccgccgccgagcaaagaagatgactttcaagcgcaggaacggagggaggaacaagcacaaccgtgggcacgtgaagccaatcagatgctccaactgcggcaaatgttgcccaaaggacaaggccatcaagaggttcatcgtgaggaacattgtggagcaggctgctattagagatgttcaggaagctagcgtctacgatgggtacacattgcctaagctgtatgctaagacgcagtactgtgtctcatgtgcgatccactctcacgttgttagagttcgttcccgtaccaaccgcagggttcgtaccccgcctcctcgttttgttagacgcaaggaggatgctcccaagcctggacaacctggtcaggctccccgtcctgctggagctgcagctgccccgcgtgcctgaagcctctgaatatccttgtttcagctttttgaagttttatgttttggttcagattattcgtactagtaccatgttgaatctcgaaagctgttttagtagtattcttgtttcgacttcgttatatttattacactttgtttgtttttctccgagagatgatttgttttaacaataaatcttcaaatatttgaaactgttcaaataaa

SEQ ID NO: 1155 - DNA, 687 bp, Brassica oleracea
gatcgacagaagagagttaaccctagcagcagcagcagcagcagacacacagctcttcagctctcgacgacaagaggaatctcagtcgcagccgcgtctcaaagaagatgactttcaagcgcaggaacggagggaggaacaagcacaaccgtggccacgtcaagccaatcagatgctccaactgtggcaaatgttgcccaaaggacaaggccatcaagagattcatagtgaggaacatcgtggagcaggctgccattagagatgttcaggaagccagcgtctacgatgggtacacgttgcctaagctgtatgcgaagacgcagtactgtgtctcgtgtgctatccactctcacgttgttagagtccgttcccgcaccaaccgcagggttcgtactccccctccacgtttcgtcagacgcaaggaggacgcgcccaagcctggacaacctggtcaggctcctcgtcctgctggagctgcagctgcaccgcgtgcctgaagcctcttccgcatatctctgttccagcttttttgaagcttttctgtttttgtttctcttatgtttggctcagttactcaatactactacaatttgaaatctcagaagctgtttttattagtggttgtttcgactttgttatatttcaatcctctgtcttgttttgctgcaacagatcaatgctcttttc

SEQ ID NO: 1156 - DNA, 663 bp, Brassica oleracea
gcagagtaaccctagcagcagacgcacacacagctcacgagaagaggagtcttagtcgcagccgccgagcaaagaagatgacattcaagcgcaggaacggagggaggaacaagcacaaccgtgggcacgtgaagccaatcagatgctccaactgcggcaaatgctgcccaaaggacaaggccatcaagaggttcatcgtgaggaacattgtggagcaggctgccattagagatgttcaggaagctagcgtctacgatgggtacacattgcctaagctgtatgctaagacgcaatactgtgtctcttgtgcgatccactctcacgttgttagagtccgttcacgcaccaaccgcagggttcgtaccccgccgcctcgttttgttagacgcaaggaggatgctcccaagcctggacaacctggtcaggctcctcgtcctgctggagctgcagctgccccgcgtgcctgaagcctctgaatatcctagtttcagctttttcaagttttatgtttggttcagattattcgtactagtaccatgtgaatctcgaaagctgtttagtacttcttgtttcgacttcgttatatttaaaacacttttgtttgtttttctccaagagatgatttgttttaacaataaactatatctcgaccaccgttttttg

SEQ ID NO: 1157 - DNA, 1418 bp, Brassica rapa
  misc_feature (3)..(3): n is a, c, g, or t
  misc_feature (642)..(643): n is a, c, g, or t
ggnctgtcgccgtaacaaagaaaacaagagatcgcactagaggcttacaactcattgcttgcaacatgactttcaagcgtagaaacggtggcaggaacaagcacaatcgtggtcatgtgaaccccattaggtgttccaactgcgggaaatgctgccccaaggataaggcaattaagagattccttgtcaggaacattgttgagcaagctgcgatcagagatgttcaagaagccagtgtttacgatggttacactctcccaaagttgtacgccaagatgcaatattgtgtttcatgcgctatccactcacacgttgtgagagtccgatcccgcaccaaccgtagggttcgtaccccacctcctcgttttgctagacgcaaggaggatactcccaagccgggacaacctggtcaggcccctcgccctgctggtggtgctcctgctgctcctcgtgcttaaaagactgcaagaagctgacaactcaaacacctttatattatagtttcagtctcttcgttgtccgaaaattttgaacatgttttctacatttggttaaagatgttttttgtcaagctgtgctttgagactatttatcagttcattttgacattggcaatacattttttatttagttcattcaaannaatacaaatttctattaagatttgggagagattcactccttttcatgtgtgcttaaccgacaaaaggagataacaatgaaacataaaaaaaaaaagcaacatcagtacatacataattaaagggtgctgttggtgagactgaaagtaagcactaaccaccaataattaacattaattgatacctgatcaatgataattatcgacaaagtgggtcagtcagatcatattatattatactcttttgattaacttatttggcacggtcttggataatatcgaatcccatctcagtcggatcggtagcttgaagctcatagtgaatcccttccaaaaccctcctcagaccagccttcgacgttgcgtataagatctttgcccttattcttgatgcctccggcgaccagtagataaagaagatcttgctcttgcggcagttatcgaccgtgacaaagtcgaagtcaaatacggcatagcgacagtcgtccacgggtaaggaagcagcgagatcttgatagttttctccggcgccgccgactttgtcaacggtgactttacgggaattctcgtcgatcttgaacacgatgtatctgtgcactttcttccatttcatctccaagaatgagctcgtgcactcttccgtaactcgcatccccgtcgtcgccatcttgaaagccatcgccattgttgctaagattctggggtctcttttttttggcgtggagagcttttccgttaaaatggaatgactttgtggtctttatataataaagttacc

SEQ ID NO: 1158 - DNA, 685 bp, Brassica rapa
ggagagtaaccctagcagcagacacacacacacacacacacagctcaccagaagagaggagtctaagtcgccgccgccgagcaaagaagatgactttcaaacgcaggaacggagggaggaacaagcacaaccgtgggcacgtgaagccaatcagatgctccaactgcggcaaatgttgcccaaaggacaaggccatcaagaggtttatcgtgaggaacattgtggagcaggctgctattagagatgttcaggaagctagcgtatacgatgggtacacattgcctaagctgtatgctaagacgcagtactgtgtctcctgtgcgatacactctcacgttgttagagttcgttcccgcaccaaccgcagagttcgtactcccccgcctcgttttgttagacgcaaggaggatgctcccaagcctggacaacctggtcaggctcctcgtcctgctggagctgcagctgccccgcgtgcctgaagcctctgaatatcccttgtttcagctttttgaagttttatgtttggttcagattgatcgtactagtaccaatatgtgaatctcgaaagctgttttagtagtgttcttgtttcgacttcgttatatttaaaacactttgtttgttttctcgaagtcatgatttgttttaacaataaatcttcaaataagtaaaactgttcaaatga

SEQ ID NO: 1159 - DNA, 627 bp, Brassica napus
gtcgccgtaacaaagaaaacaagagatcgcactagaggcttacaactcattgcttgcaacatgactttcaagcgtagaaacggtggcaggaacaagcacaatcgtggtcatgtgaaccccattaggtgttccaactgcgggaaatgctgccccaaggataaggcaattaagagattccttgtcaggaacattgttgagcaagctgcgatcagagatgttcaagaagccagtgtttacgatggttacactctcccaaagttgtacgccaagatgcaatattgtgtttcatgcgctatccactcacacgttgtgagagtccgatcccgcaccaaccgtagggttcgtaccccacctcctcgttttgctagacgcaaggaggatactcccaagccgggacaacctggtcaggcccctcgccctgctggtggtgctcctgctgctcctcgtgcttaaaagactgcaagaagctgacaactcaaacacctttatattatagtttcagtctcttcgttgtccgaaaattttgaacatgttttctacatttggttaaagatgttttttgtcaagctgtgctttgagactatttatcagttcattttgacattggcaatacattttttatttagt

SEQ ID NO: 1160 - DNA, 656 bp, Brassica napus
gtcgccgtaacaaagaaaacaagagatcgcactagaggcttacaactcattgcttgcaacatgactttcaagcgtagaaacggtggcaggaacaagcacaatcgtggtcatgtgaaccccattaggtgttccaactgcgggaaatgctgccccaaggataaggcaattaagagattccttgtcaggaacattgttgagcaagctgcgatcagagatgttcaagaagccagtgtttacgatggttacactctcccaaagttgtacgccaagatgcaatattgtgtttcatgcgctatccactcacacgttgtgagagtccgatcccgcaccaaccgtagggttcgtaccccacctcctcgttttgctagacgcaaggaggatactcccaagccgggacaacctggtcaggcccctcgccctgctggtggtgctcctgctgctcctcgtgcttaaaagactgcaagaagctgacaactcaaacacctttatattatagtttcagtctcttcgttgtccgaaaattttgaacatgttttctacatttggttaaagatgttttttgtcaagctgtgctttgagactatttatcagttcattttgacattggcaatacattttttatttagttcattcaaaccaatacatttttcaagagc

SEQ ID NO: 1161 - DNA, 613 bp, Brassica napus
agcagcagacgcacacacagctcacgagaagaggagtcttagtcgcagccgccgagcaaagaagatgacattcaagcgcaggaacggagggaggaacaagcacaaccgtgggcacgtgaagccaatcagatgctccaactgcggcaaatgctgcccaaaggacaaggccatcaagaggttcatcgtgaggaacattgtggagcaggctgccattagagatgttcaggaagctagcgtctacgatgggtacacattgcctaagctgtatgctaagacgcaatactgtgtctcttgtgcgatccactctcacgttgttagagtccgttcccgcaccaaccgcagggttcgtaccccgccgcctcgttttgttagacgcaaggaggatgctcccaagcctggacaacctggtcaggctcctcgtcctgctggagctgcagctgccccgcgtgcctgaagcctctgaatatcctagtttcagctttttcaagttttatgtttggttcagattattcgtactagtaccatgtgaatctcgaaagctgtttagtacttcttgtttcgacttcgttatatttaaaacacttttgtttgtttttctccaatagatgatttg

SEQ ID NO: 1162 - DNA, 611 bp, Brassica napus
cgcacacacagctcacgagaagaggagtcttagtcgcagccgccgagcaaagaagatgacattcaagcgcaggaacggagggaggaacaagcacaaccgtgggcacgtgaagccaatcagatgctccaactgcggcaaatgctgcccaaaggacaaggccatcaagaggttcatcgtgaggaacattgtggagcaggctgccattagagatgttcaggaagctagcgtctacgatgggtacacattgcctaagctgtatgctaagacgcaatactgtgtctcttgtgcgatccactctcacgttgttagagtccgttcacgcaccaaccgcagggttcgtaccccgccgcctcgttttgttagacgcaaggaggatgctcccaagcctggacaacctggtcaggctcctcgtcctgctggagctgcagctgccccgcgtgcctgaagcctctgaatatcctagtttcagctttttcaagttttatgtttggttcagattattcgtactagtaccatgtgaatctcgaaagctgtttagtacttcttgtttcgacttcgttatatttaaaacacttttgtttgtttttctccaatagatgatttgttttaac

SEQ ID NO: 1163 - DNA, 639 bp, Raphanus sativus
gtcgccgcaaagaagaggggagtacgcaaaacaggcttgagaaactctttcctgcaacatgactttcaagcgcaggaacggtggtaggaacaagcacaaccgtggtcacgtgaacccaatcaggtgttccaactgcgggaaatgctgtcctaaggataaggcgattaagagattcatcgtcaggaacatcgttgagcaagctgccatcagagatgttcaagaagctagtgtctacgatggttacactctcccaaagttgtacgccaagacgcagtactgtgtttcgtgtgctatccactctcacgttgtgagagttcgatcccgcaccaaccgtagagttcgtacccctcctccccgttttgtcagacgcaaggaggatgctcccaagcctggacagcctggccaggctcctcgccctgctggtggtgctccagctgctcctcgtacctgaagactgcaagaagctggctatcaaaaactttctatattctagtctcagtcttgtctggagtttttgaagatttttttggtgtttggttaaagataattttgaatgctttgagactttttttatttttgacattggcatttcctccctgttctattcaatttttgtgcgtcttaccatctgataacaac

SEQ ID NO: 1164 - DNA, 601 bp, Thellungiella halophila
gaaccctagcagtcacagctgagatcattgtgccttcgtttcacgagaagagaggaaaaggaaaaagcttcttctccaagatgactttcaagcgtaggaacggtgggagaaacaagcacaaccgaggtcacgtcaacccaatcagatgctccaactgtggcaaatgttgcccaaaggacaaggcgattaagaggtttatcgtcaggaacattgtggagcaggctgccattagagatgttcaggaagctagcgtctacgatgggtacacattgccgaagctatattcgaaggtgcaatactgtgtctcatgtgcgatccactctcacgttgtcagagtccgatcccgcaccaaccgcagggttcgtactccaccgccgcgttttgccagacgcaaggaggatgctcccaagcctggtcaaccaggacaggcccctcgtcctgctggagctggacctggagctgcaccgcgtgtctgaagcctgcttctttctttttttttcctaaggattttgttttccttatgttgggtttagaatgtactccctctgtttccaataattacatgttttttgatatttcacaatattaattaagtatttac

SEQ ID NO: 1165 - DNA, 653 bp, Brassica napus
agacacacacacacacagctcaccagaagagaggagtctaagtcgccgccgccgagcaaagaagatgactttcaaacgcaggaacggagggaggaacaagcacaaccgtgggcacgtgaagccaatcagatgctccaactgcggcaaatgttgcccaaaggacaaggccatcaagaggtttatcgtgaggaacattgtggagcaggctgctattagagatgttcaggaagctagcgtatacgatgggtacacattgcctaagctgtatgctaagacgcagtactgtgtctcctgtgcgatacactctcacgttgttagagttcgttcccgcaccaaccgcagagttcgtactcccccgcctcgttttgttagacgcaaggaggatgctcccaagcctggacaacctggtcaggctcctcgtcctgctggagctgcagctgccccgcgtgcctgaagcctctgaatatcccttgtttcagctttttgaagttttatgtttggttcagattgatcgtactagtaccaatatgtgaatctcgaaagctgttttagtagtgttcttgtttcgacttcgttatatttaaaacactttgtttgttttctcgaagtcatgatttgttttaacaataaatcttcaaataagtaaaactgtt

SEQ ID NO: 1166 - DNA, 584 bp, Brassica napus
aagatgactttcaagcgcaggaacggagggaggaacaagcacaaccgtggccacgtcaagccaatcagatgctccaactgtggcaaatgctgcccaaaggacaaggccataaagaggttcatagtgaggaacatcgtggaacaagctgccattagagatgttcaggaagccagcgtctacgatgggtacacgttgccaaagctgtatgcgaagacacagtactgtgtctcgtgtgccattcactctcacgttgttcgtgtccgttcccgcactaaccgcagggttcgtactccccctccacgtttcgtcagacgcaaggaggatgcgcccaagcctggacaacctggtcaggctcctcgtcctgcaggagctggagcagctgcaccgcgtgcctgaagcctcttctgcatatctttgtttcagcttttgaagcttttctgtttttgtttcgcttatgtttggttcagttaatcatactactacaatttgaaatctcaaaagctgtttttattagtggttgtttcgactttgattatatttcaatcctctgtctttgttttgctccaacagatcaatgctttttt

SEQ ID NO: 1167 - DNA, 671 bp, Brassica juncea
aaaaacgaaaagaacgagcttgaatctctccctgctgcaacatgactttcaagcgcaggaacggtggtaggaacaagcacaaccgtggtcatgtgaacccaatcagatgttccaactgcgggaaatgctgtcccaaggataaggcgatcaagagattcctcgtcaggaacatcgttgagcaagctgccatcagagatgttcaagaagctagtgtctacgatggttacactctcccaaagttgtactctaagatgcagtactgtgtttcatgtgcgatccactcccacgttgtgagagttcgatcacgcaccaaccgtagagttcgtacccctcctccacgttttgccagacgcaaggaagataccccaaagcctgggcagcctggtcaggctcctcgccctgctggtggtgctccagctgctcctcgtgcctaaagactgcaagaagctggctatcgaaaacactttatactctagtttcagtcttgtctggagtttctgaacatgtttttggcatttggttaaagatgattttgaatgctttgagactatttatcagtttatttttgacattagcatttcctccctgttctattcaaatatttgtgtggcgcgacatcttattacagcattttaagttactatcatgtaacctgggatgtaatgcagttt

SEQ ID NO: 1168 - DNA, 593 bp, Brassica juncea
caaggacaaggcgattaagagaacagatcgcacaaggcttgaaactctttgcttgcaaacatgactttcaagcgtaggaacggtggcaggaacaagcacaaccgtggtcatgtgaaccccatcaggtgttccaactgcgggaaatgctgtcccaaggacaaggcgattaagagattccttgtcaggaacatcgttgagcaggctgccatcagagatgttcaagaagccagtgtttacgatggttacactctgccaaagttgtactctaagatgcagtactgtgtttcatgtgctattcactctcacgttgtgagagttcgatcccgtaccaaccgtagggttcgtaccccacctccccgttttgccagacgcaaggaggatactcccaagcctggacaacctggtcaggcccctcgccctgctggtggtgcccctgctgctcctcgtgcttaaaagactgcacaagatactggcaactcaaaaccctttatattatagtttcagtctctgtgttgtctggaatttttgaacatgttttctacatttggttaaagataattttgtcaagtggagctctgaatgctttgagacta

SEQ ID NO: 1169 - DNA, 646 bp, Brassica juncea
gagagtaaaccctagcagcagcttttcagctcacgaggagaagagatcgcagccgcgtatcatcaaagatgactttcaagcgtaggaacggagggaggaacaagcacaaccgtggccacgtcaagccaatcagatgctccaactgcggcaaatgctgcccgaaggacaaggccatcaagaggttcatagtgaggaacatcgtggaacaagctgccattagagatgttcaggaagccagcgtctacgatgggtacacgttgcctaagctgtatgcgaagacacagtactgtgtctcgtgtgccattcactctcacgttgttcgtgtccgttcccgcactaaccgcagggttcgtactccccctccacgtttcgtcagacgcaaggaggatgcgcccaagcctggacaacctggtcaggctcctcgtcctgctggagctggagcagctgcaccgcgtgcctgaagcctcttctgcatatctttgtttcagcttttgaagcttttctgtttttgtttcgcttatgtttggttcagttattcaatactactacaatttgaaatctcaaaagctgtttttattagtggttgtttcgactttgattatatttcaatcctctgtcttgtttttgctcccaacagatcaatgct

SEQ ID NO: 1170 - DNA, 633 bp, Brassica juncea
gattctcaccctggtcgccgtaacgaagcaagaagagatcgcagtagaggcttgaaactctttgcttgcaacatgactttcaagcgtaggaacggtggcaggaacaagcacaaccgtggtcatgtgaaccccatcaggtgttccaactgcgggaaatgctgtcccaaggacaaggcgattaagagattccttgtcaggaacatcgttgagcaggctgccatcagagatgttcaagaagccagtgtttacgatggttacactctgccaaagttgtactctaagatgcaatactgtgtttcatgtgctatccactctcacgttgtgagagttcgatcccgcaccaaccgtagggttcgtaccccacctccccgttttgccagacgcaaggaggatactcccaagcctggacaacctggtcaggcccctcgccctgctggtggtgcccctgctgctcctcgtgcttaaaagactgcagaagatactggcaactcaaaaccctttatattatagtttcagtctctgcgctgtctggaatttttgaacatgctttctatatttggttaaagataattttgtcaagtggagctttgaatgctttgagactatttatcagttcatttttgacattataaa

SEQ ID NO: 1171 - DNA, 673 bp, Brassica juncea
gtaaccctagcagcagcagcttttcagctcaggagaagaggaatcttaagtcgcagccagatctcaaagaaaatgactttcaagcgtaggaacggagggaggaacaagcacaaccgtggccacgtcaacccaatcagatgctccaactgcggcaaatgttgcccaaaggacaaggccataaagaggttcatagtgaggaacatcgtggagcaggctgccatcagagatgttcaggaagccagtgtctacgatgggtacacgctccctaagctgtatgcgaagacgcaatactgtgtctcgtgcgcgatccactctcacgttgttcgtgtccgttcccgcaccaatcgcagggttcgtactccccctccacgtttcgtcagacgcaaggaggatgctcccaagcctggacaacctggtcaggctcctcgtcctgctggagctggaactgctgcaccgcgtgcctgaagcctttgaagatttgttttttttccttttgctactagtacccatctgaatctcaaaaaccagtttgatgtttcgactttgttgtattcccaaacatgtctttttttctgcatcataactgattgagcacgttcttatactctcatccgtgtgtttctcatctgtgtgttttttactttgtttttcatttcgtcaatgctctgtttct

SEQ ID NO: 1172 - DNA, 619 bp, Brassica oleracea
ggcctgtcgccggaacgaagaaaagaagagatcgcactagaggcttgaaactctttgcttgcagcatgactttcaagcgtagaaacggtggcaggaacaagcacaaccgtggtcatgtgaaccccattaggtgttccaactgcgggaaatgctgccccaaggataaggcaattaagagattccttgtcaggaacattgttgaacaagcagctatcagagatgttcaagaagccagtgtttacgatggttacactctcccaaagttgtacgccaagatgcaatattgtgtttcatgcgctatccactcacacgttgtgagagtccgatcccgcaccaaccgtagggttcgtaccccacctcctcgttttgctagacgcaaggaggatactcccaagccgggacaacctggtcagccccctcgccctgctggtggtgcccctgctgctcctcgtgcttaaaagactgcaagaagctggcaactcaaacacctttatattatagtttcagtctcttctttgtccgaaaattttgaacatgttttcttcatttggttaaagatgatttttgtcatgtggagctttgaatgctttgatattatttatcagttcattttgacatt

SEQ ID NO: 1173 - DNA, 630 bp, Brassica rapa
agagggaagagagtaaaccctagcagcagcttttcagctcacgaggagaagagatcgcagccgcgtatcaaagaagatgactttcaagcgcaggaacggagggagaaacaagcacaaccgaggccacgtcaagccaatcagatgctccaactgcggcaaatgctgccccaaagacaaggccatcaagaggttcatagtgaggaacatcgtggagcaagctgccattagagatgttcaggaagccagcgtctacgatgggtacacgttgcctaagctgtatgcgaagacacagtactgtgtctcatgtgcgatccactctcacgttgttcgtgtccgttcccgcactaaccgcagggttcgtactccccctccacgtttcgtcagacgcaaggaggatgcgcccaagcctggacaacctggtcaggctcctcgtcctgctggagctggagcagctgcaccgcgtgcctgaagcctcttctgcatatctttgtttcagcttttgaaagcttttctgtttttgtttcgcttattatgtttggttcagttacttgatactactactcacaatttgaatctcaaaagctgtttttattagtggttgtttcgactttgattatatttcaaacctct

SEQ ID NO: 1174 - DNA, 637 bp, Brassica rapa
ggaagagagtaaaccctagcagcagcttttcagctcacgaggagaagagatcgcagccgcgtatcaaagaagatgactttcaagcgtaggaacggagggaggaacaagcacaaccgtggccacgtcaagccaatcagatgctccaactgcggcaaatgctgcccgaaggacaaggccatcaagaggttcatagtgaggaacatcgtggaacaagctgccattagagatgttcaggaagccagcgtctacgatgggtacacgttgcctaagttgtatgcgaagacgcagtactgtgtctcgtgtgcgattcactctcacgttgttcgtgtccgttcccgcactaaccgcagggttcgtactccccctccacgtttcgtcagacgcaaggaggatgcgcccaagcctggacaacctggtcaggctcctcgtcctgcaggagctggagcagctgcaccgcgtgcctgaagcctcttcttcatttctttgtttcagcttttgaagcttttctgtttttgtttcgcttatgtttggttcagttaatcatactctactacaatttgaatctcaaaagctgtttttattagtggttgtttcgactttgattatatttcaatcctctgtcttgtttttgctccaa

SEQ ID NO: 1175 - DNA, 723 bp, Brassica napus
aggggcctgtcgccggaacgaagaaaagaagagatcgcactagaggcttgaaactctctgcttgcagcatgactttcaagcgtagaaacggtggcaggaacaagcacaaccgtggtcatgtgaaccccattaggtgttccaactgcgggaaatgctgccccaaggataaggcaattaagagattccttgtcaggaacattgttgaacaagcagctatcagagatgttcaagaagccagtgtttacgatggttacactctcccaaagttgtacgccaagatgcaatattgtgtttcatgcgctatccactcacacgttgtgagagtccgatcccgcaccaaccgtagggttcgtaccccacctcctcgttttgctagacgcaaggaggatactcccaagccgggacaacctggtcagccccctcgccctgctggtggtgcccctgctgctcctcgtgcttaaaagactgcaagaagctggcaactcaaacacctttatattatagtttcagtctcttctttgtccgaaaattttgaacatgttttcttcatttggttaaagatgtttttttgtcatgtggagctttgaatgctttgatattatttatcagttcattttgacattagcatttcctctcttatccaattcacttgcaaatgaatacctctttccagagaaatttatgaatcccctaccaggttaccactcacaaaaaaaaaaaaaa

SEQ ID NO: 1176 - DNA, 690 bp, Brassica napus
atcgcactagaggcttgaaactctctgcttgcagcatgactttcaagcgtagaaacggtggcaggaacaagcacaaccgtggtcatgtgaaccccattaggtgttccaactgcgggaaatgctgccccaaggataaggcaattaagagattccttgtcaggaacattgttgaacaagcagctatcagagatgttcaagaagccagtgtttacgatggttacactctcccaaagttgtacgccaagatgcaatattgtgtttcatgcgctatccactcacacgttgtgagagtccgatcccgcaccaaccgtagggttcgtaccccacctcctcgttttgctagacgcaaggaggatactcccaagccgggacaacctggtcagccccctcgccctgctggtggtgcccctgctgctcctcgtgcttaaaagactgcaagaagctggcaactcaaacacctttatattatagtttcagtctcttctttgtccgaaaattttgaacatgttttcttcatttggttaaagatgtttttttgtcatgtggagctttgaatgctttgatattatttatcagttcattttgacattagcatttcctctcttatccaattcacttgcaaatgaatacctctttccagagaaatttatgaatcccctaccaggttaccactcacaaaaaaaaaaaaaa

SEQ ID NO: 1177 - DNA, 789 bp, Brassica napus
tggacgcctgcgggaccggtccggaatctcgggtcgacccacgcgtccgccctagcagcagcttttcagctcacgactcaggaggaggaggaatctcagtcgcagcagcagccgcgtctcaaagaagatgactttcaagcgcaggaacggagggaggaacaagcacaaccgtggccacgtcaagccaatcagatgctccaactgcggcaaatgctgccccaaagacaaggccatcaagaggttcatagtgaggaacatcgtggagcaggctgccattagagatgttcaggaagccagcgtctacgatgggtacacgttgccaaagctgtatgcgaagacgcagtactgtgtctcgtgtgctatccactctcacgttgttcgtgtccgttcccgcactaaccgcagggttcgtactccccctccacgtttcgtcagacgcaaggaggatgcgcccaagcctggacaacctggtcaggctcctcgtcctgctggagctggagcagctgcaccgcgtgcctgaagcctctcttccgcatatctttgtttcagcttttctgtttttgtttctctttatgtttggttcagttaatcatactactactacaatttgaatctcttttattagtggttgtttcgactttgattatatttcaatcctctgtcttgttttgctccaacagatcaatgctcttttcaattttccccatctgttatttttcatttcttcagtgatctgtttttgtattaaatcgaaaattttatactcgagtgccattacagcactcttaa

SEQ ID NO: 1178 - DNA, 687 bp, Brassica napus
ggggggagaaaggaggaagagagtaaaccctagcagcagcttttcagctcacgaggagaagagatcgcagccgcgtatcaaagaagatgactttcaagcgcaggaacggagggagaaacaagcacaaccgaggccacgtcaagccaatcagatgctccaactgcggcaaatgctgccccaaagacaaggccatcaagaggttcatagtgaggaacatcgtggagcaagctgccattagagatgttcaggaagccagcgtctacgatgggtacacgttgcctaagctgtatgcgaagacacagtactgtgtctcatgtgcgatccactctcacgttgttcgtgtccgttcccgcactaaccgcagggttcgtactccccctccacgtttcgtcagacgcaaggaggatgcgcccaagcctggacaacctggtcaggctcctcgtcctgctggagctggagcagctgcaccgcgtgcctgaagcctcttctgcatatctttgtttcagcttttgaaagcttttctgtttttgtttcgcttattatgtttggttcagttacttgatactactactcacaatttgaatctcaaaagctgtttttattagtggttgtttcgactttgattatatttcaaacctcttttgtcttgttttgctgcaacagatcaatgctcttttcagttttctc

SEQ ID NO: 1179 - DNA, 657 bp, Brassica napus
taaaccctagcagcagcttttcagctcacgaggagaagagatcgcagccgcgtatcaaagaagatgactttcaagcgcaggaacggagggagaaacaagcacaaccgaggccacgtcaagccaatcagatgctccaactgcggcaaatgctgccccaaagacaaggccatcaagaggttcatagtgaggaacatcgtggagcaagctgccattagagatgttcaggaagccagcgtctacgatgggtacacgttgcctaagctgtatgcgaagacacagtactgtgtctcatgtgcgatccactctcacgttgttcgtgtccgttcccgcactaaccgcagggttcgtactccccctccacgtttcgtcagacgcaaggaggatgcgcccaagcctggacaacctggtcaggctcctcgtcctgctggagctggagcagctgcaccgcgtgcctgaagcctcttctgcatatctttgtttcagcttttgaaagcttttctgtttttgtttcgcttattatgtttggttcagttacttgatactactactcacaatttgaatctcaaaagctgtttttattagtggttgtttcgactttgattatatttcaaacctcttttgtcttgttttgctgcaacagatcaatgctcttttcag

SEQ ID NO: 1180 - DNA, 642 bp, Brassica napus
gttcgccgcaaaagaagagaagaagagacgcaaaacaggcttgagaagctctttgctgcgaacatgactttcaaacgaaggaacggtggtaggaacaagcacaaccgtggtcatgtgaacccaatcaggtgttccaactgcgggaaatgctgtcccaaggataaggcgattaagagattcctcgtcaggaacatcgttgagcaagctgccatcagagatgttcaagaagctagtgtttacgatggttacactctaccaaagttgtacgctaagatgcagtactgtgtttcatgtgctatccactctcacgttgtgagagttcgatcgcgcactaaccgtagagttcgtaccccaccgccccgttttgccagacgcaaggaggatgctcccaagcctggacaacctggtcaggcccctcgccctgctggtggtgctccagctgctcctcgtgcctaaagactgcaacaagcgggcaatcccaaactctttatattctagtagtctcagtcttgtctggagtttgtgaaaatgtttttgacgtttggttaaagatagttttgaatgctttgagactttatctgttcatttttgacgtttgcatttcctctcaatttgacatgttttattcaatattttcactga

SEQ ID NO: 1181 - DNA, 683 bp, Brassica napus
ggttcgccgcaaaagaagagaagaagagacgcaaaacaggcttgagaagctctttgctgcgaacatgactttcaaacgaaggaacggtggtaggaacaagcacaaccgtggtcatgtgaacccaatcaggtgttccaactgcgggaaatgctgtcccaaggataaggcgattaagagattcctcgtcaggaacatcgttgagcaagctgccatcagagatgttcaagaagctagtgtttacgatggttacactctaccaaagttgtacgctaagatgcagtactgtgtttcatgtgctatccactctcacgttgtgagagttcgatcgcgcactaaccgtagagttcgtaccccaccgccccgttttgccagacgcaaggaggatgctcccaagcctggacaacctggtcaggcccctcgccctgctggtggtgctccagctgctcctcgtgcctaaagactgcaacaagcgggcaatcccaaactctttatattctagtagtctcagtcttgtctggagtttgtgaaaatgtttttgacgtttggttaaagatagttttgaatgctttgagactttatctgttcatttttgacgtttgcatttcctctcaatttgacatgttttattcaatattttcactgaccataacctttaaattattctcacataacctgtatagtaa

SEQ ID NO: 1182 - DNA, 667 bp, Raphanus sativus
gggtcgaggagcagagtaaccctagcagcagacacacgcacacagcttctcggctcacaagaaagaaagaagaagaagatgactttcaagcgtaggaacggagggaggaacaagcacaaccgtggccacgtgaacccaatcagatgctccaactgcggcaaatgttgcccaaaggacaaggccatcaagaggttcatcgtgaggaacattgtggagcaggctgccatcagagatgttcaggaagctagcgtctacgacgggtacacattgccgaagctgtatgctaagacgcagtactgtgtctcatgtgcgatccactctcacgttgttagagtccgttcccgcaccaaccgcagagttcgtactcccccacctcgttttgtcagacgcaaggaggatgctcccaagcctggacaacctggtcaggctcctcgtcctgctggagctggagctgcaccgcgtgcctgaagcctctgcttatcctagtttcatccttttgttttgttttatgtttggttgagattattcatactagtactatgggaatctcgaaagctgtttagtagttcttgtttcgactatgttatattttgaaagtctttgtgcctaagtggagaacaacatatatgattggagacaattttcatgagtgacacttccaggagaa

SEQ ID NO: 1183 - DNA, 620 bp, Raphanus sativus
  misc_feature (25)..(25): n is a, c, g, or t
  misc_feature (32)..(32): n is a, c, g, or t
  misc_feature (50)..(50): n is a, c, g, or t
  misc_feature (438)..(438): n is a, c, g, or t
ggaacctgtcgccgtaacgaagaanagaacanatcgcagaaggcttgaanctctttgcttgcaaacatgactttcaagcgtaggaacggtggcaggaacaagcacaaccgtggtcacgtgaaccccatcaggtgttccaactgcgggaaatgctgtcccaaggataaggcgattaagagattcctcgtcaggaacattgttgagcaggctgctattagagatgttcaagaagccagtgtctacgatggttacactctcccaaagctgtactctaaggtgcaatactgtgtttcatgtgctatccactctcacgttgtgagagttcgatcccgcaccaaccgtagggttcgtactcctcctccccgttttgccagacgcaaggaggatactcccaagcctggacaacctggtcaggcccctcgccctgctggtggtgcncctgctgctcctcgtacttaaaagactgcaagaagctggtcactcaaaactcttaatgttatagtttcagtctctgcgctgtctggaatttttgaacatgttttctacctttggttagagatgattttgtcatgtgtaactttgaattctttgagaccaatctatcagttcattttgacatt

SEQ ID NO: 1184 - DNA, 619 bp, Raphanus sativus
ggaacctgtcgccgtaacgaagaagagtacagatcggagaaggcttgaaactctttgcttgcaaacatgactttcaagcgtaggaacggtggcaggaacaagcacaaccgtggtcacgtgaatcccatcaggtgttccaactgcgggaaatgctgtcccaaggataaggcgattaagagattccttgtcaggaacatcgttgagcaggctgctatcagagatgttcaagaagccagtgtctacgatggttacactctcccaaagctgtactctaaggtgcaatactgtgtttcatgtgctatccactctcacgttgtgagagttcgatcccgcaccaaccgtagggttcgtacccctcctccccgttttgccagacgcaaggaggatactcccaagcctggacagcctggtcaggcccctcgccctgctggtggtgcccctgctgctcctcgtacttaaaagactgcaaggagctggccactcaactcttaatattatagtttcagtctctgggctgtctggaatttttgaacatgttctctacatctggttagagatgattttgtaacttcgaattctttgagaccaatctatcagttcatttcgacatttgcatttc

SEQ ID NO: 1185 - DNA, 626 bp, Raphanus sativus
  misc_feature (572)..(572): n is a, c, g, or t
ggacctgtcgccgtaacgaagaagagaacagatcgcagaaggcttgaaactcttttgcttgcaaacatgactttcaagcgtaggaacggtggcaggaacaagcacaaccgtggtcacgtgaatcccatcaggtgttccaactgcgggaaatgctgtcccaaggataaggcgattaagagattcctcgtcaggaacattgttgagcaggctgctatcagagatgttcaagaagccagtgtctacgatggttacactctcccaaagctgtactctaaggtgcaatactgtgtttcatgtgctatccactctcacgttgtgagagttcgatcccgcaccaaccgtagggttcgtacccctcctccccgttttgccagacgcaaggaggatactcccaagcctggacaacctggtcaggcccctcgccctgctggtggtgcccctgctgctcctcgtacttaaaagactgcaagaagctgctctctcaaaactcttaatgttatagtttcagtctctgcgctgtctggaatttttgaacatgttttttacatttggttagagatgatttcgtcatntgtaactttgaattctttgagaccaatctatcagttcattttgacattggcatt

SEQ ID NO: 1186 - DNA, 619 bp, Brassica napus
aacgcaataggcttcttgtaactaactcttcactgcaacatgactttcaagcgcaggaacggtggcaggaacaagcacaaccgtggtcatgtgaagcccatcaggtgttccaactgcgggaaatgctgtcccaaggataaggctatcaagaggttcatcgtcaggaacatcgttgagcaggctgccatcagagatgttcaagaagccagtgtctacgatggttacactcttcccaagttgtacgccaagacgcagtactgtgtctcatgtgctatccactctcacgttgtgagagtccgttcccgcaccaaccgtagggttcgtacccctcccccacgtttcgtcagacgcaaggaggatgctcccaagcccggacaacctggtcaggctgctcgccctgctggtggtgcccctgctgctcctcgtgcctagaaactgctagaagctggcaactcaaacttctttatattctagtttcggtctcatggttgtctagaatatttgaagatgttttctacatttggttaaagatagttttgttttggatctttgaatgctttgagactatttatcagcttgttttgacatttggcgtttcctctttttgtttcatgcaaat

SEQ ID NO: 1187 - DNA, 736 bp, Brassica napus
atcccgttcaacccatggcaattccaagacatgtcgacttaaatgaactgctacaaaaaaagagaaacgcaataggcttcttgtaactaacctcttcactgcaacatgactttcaagcgcaggaacggtggcaggaacaagcacaaccgtggtcatgtgaagcccatcaggtgttccaactgcgggaaatgctgtcccaaggataaggctatcaagaggttcatcgtcaggaacatcgttgagcaggctgccatcagagatgttcaagaagccagtgtctacgatggttacactcttcccaagttgtacgccaagacgcagtactgtgtctcatgtgctatccactctcacgttgtgagagttcgttcccgtaccaaccgtagggttcgtaccccacccccacgtttcgtcagacgcaaggaggatgctcccaagcccggacaacctggtcaggctgctcgccctgctgggggtgcccctgctgctcctcgtgcctaaaaaccgcaagaagctggcaactcaaacctctttatattctagtttcagtctcagggttgtctagaatatttgaagatgttttctacatttggttaaagatagttttgttgtggatctttgaatgctttgagactatttatcttacttttttgactatttggctatttcctctttttggttcatgcaaatcaattctttcagtaagattcaactcgactttaaaggatactgaataact

SEQ ID NO: 1188 - DNA, 669 bp, Brassica juncea
tgaagagttagttacaaaaagagaaacgcaataggcttcttgtaactaactcttcactgcaacatgactttcaagcgcaggaacggtggcaggaacaagcacaaccgtggtcatgtgaagcccatcaggtgttccaactgcgggaaatgctgtcccaaggataaggctatcaagaggttcatcgtcaggaacatcgttgagcaggctgccatcagagatgttcaagaagccagtgtctacgatggttacactcttcccaagttgtacgccaagacgcagtactgtgtctcatgtgctatccactctcacgttgtgagagttcgttcccgtaccaaccgtagggttcgtaccccacccccacgtttcgtcagacgcaaggaggatgctcccaagcccggacaacctggtcaggctgctcgccctgctgggggtgcccctgctgctcctcgtgcctaaaaaccgcaagaagctggcaactcaaacctctttatattctagtttcagtctcagggttgtctagaatatttgaagatgttttctacatttggttaaagatagttttgttgtggatctttgaatgctttgagactatttatctactttttttgactttggcatttcctctttttggttcatgcaaatcaattctttcaaaaaaaaaaaaaaaaa

SEQ ID NO: 1189 - DNA, 529 bp, Brassica juncea
gactttcaagcgcaggaacggtggtaggaacaagcacaaccgtggtcatgtgaacccaatcagatgttccaactgcgggaaatgctgtcccaaggataaggcgattaagagattcctcgtcaggaacatcgtcgagcaagctgccatcagagatgtacaagaagctagtgtctacgatggttacactctcccaaagctgtacgctaagatgcagtactgtgtttcatgtgctatccactctcacgttgtgagagttcgttcccgcaccaaacgtagggttcgtacccctcctccccgttttgccagacgcaaggaggatactcccaagcctggacagcctggtcaggcccctcgccctgctggtggtgctccagctgctcctcgtgcctaaagacttcaagaaactggctatcaaaaactctttatattctagtttcagtattctctggagttcttgaagatgtttttggcatttggttaaagataattttgaatgctttttgagactttttatcagtttatttttgac

SEQ ID NO: 1190 - DNA, 615 bp, Brassica juncea
gagtacgcgggggccgcaacaaaaagagaaacgcaataggcttcttgtaactaactcttcactgcaacatgactttcaagcgcaggaacggtggcaggaacaagcacaaccgtggtcatgtgaagcccatcaggtgttccaactgcgggaaatgctgtcccaaggataaggctatcaagaggttcatcgtcaggaacatcgttgagcaggctgccatcagagatgtccaagaagccagtgtctacgatggatacactcttcccaagttgtacgctaagacgcagtactgtgtctcatgtgctatccactctcacgttgtgagagttcgttctcgtaccaaccgtagggttcgtaccccacccccacgtttcgtcagacgcaaggaggatgcacccaagcctggacaacctggtcaggcccctcgccctgctggtggtgcccctgctgctgctcgtgcttaaagactgcgagaagctggcaactcaaaaatctttatattctagtttcagtctcagggttgtctagaatttttgaagatgttttctaccttttgttaaagataattttgttttggagctttgaatgctttgagactatttatcagtttgtttttgt

SEQ ID NO: 1191 - DNA, 471 bp, Brassica juncea
aaacgcaatagccttgaaactcttcactgcaacatgactttcaagcgcaggaacggtggcaggaacaagcacaaccgtggtcacgtgaacccaatcaggtgttccaactgcgggaaatgctgtcccaaggataaggcaatcaagaggttcatcgtcaggaacatcgttgagcaagctgccatcagagatgttcaagaagctagtgtctacgatggttacactcttcccaagttgtatgctaagatgcagtactgtgtctcatgtgctatccactctcacgttgtgagagttcgttcccgtaccaaccgtagggttcgtaccccacccccacgtttcgtcagacgcaaggaggatgctcccaagcccggacaacctggtcaggctgctcgccctgctgggggtgcccctgctgctcctcgtgcctaaaaaccgcaagaagctggcaactcaaacctctttatattctagttt

SEQ ID NO: 1192 - DNA, 665 bp, Brassica oleracea
ttcctcccccgtcgccgcaacaaaaaagagaaacgcaataggcttcttgtaactaacttcactgcaacatgactttcaagcgcaggaacggtggcaggaacaagcacaaccgtggtcatgtgaagcccatcaggtgttccaactgcgggaaatgctgtcccaaggataaggctatcaagaggttcatcgtcaggaacatcgttgagcaggctgccatcagagatgttcaagaagccagtgtctacgatggttacactcttcccaagttgtacgccaagacgcagtactgtgtctcatgtgctatccactctcacgttgtgagagtccgttcccgcaccaaccgtagggttcgtacccctcccccacgtttcgtcagacgcaaggaggatgctcccaagcccggacaacctggtcaggctgctcgccctgctggtggtgcccctgctgctcctcgtgcctaaaaactgctagaagctggcaactcaaacttctttatattctagtttcggtctcagggttgtctagaatatttgaagatgttttctacatttggttaaagatagttttgttttggatctttgaatgctttgagactatttatcagcttgttttgacatttggcgtttcctctttttgtttcatgcaaatctattctttcagaagta

SEQ ID NO: 1193 - DNA, 671 bp, Brassica rapa
agaaataattggtcgccgcaacaaaaagagaaacgcaataggcttcttgtaactaactcttcactgcaacatgactttcaagcgcaggaacggtggcaggaacaagcacaaccgtggtcatgtgaagcccatcaggtgttccaactgcgggaaatgctgtcccaaggataaggctatcaagaggttcatcgtcaggaacatcgttgagcaggctgccatcagagatgtccaagaagccagtgtctacgatggatacactcttcccaagttgtacgctaagacgcagtactgtgtctcatgtgctatccactctcacgttgtgagagttcgttctcgtaccaaccgtagggttcgtaccccacccccacgtttcgtcagacgcaaggaggatgcacccaagcctggacaacctggtcaggcccctcgccctgctggtggtgcccctgctgctgctcgtgcttaaagactgcgagaagctggcaactcaaaaatctttatattctagtttcagtctcagggttgtctagaatttttgaagatgttttctaccttttgttaaagataattttgttttggagctttgaatgctttgagactatttatcagtttgtttttgtcatttggcgtttcctcttttttgttcaagcaaatcaattatttctagaaaaaaa

SEQ ID NO: 1194 - DNA, 651 bp, Brassica rapa
tggtcgccgcaacaaaaagagaaacgcaataggcttcttgtaactaactcttcactgcaacatgactttcaagcgtaggaacggtggcaggaacaagcacaaccgtggtcatgtgaagcccatcaggtgttccaactgcgggaaatgctgtcccaaggataaggctatcaagaggttcatcgtcaggaacatcgttgagcaggctgccatcagagatgttcaagaagccagtgtctacgatggttacactcttcccaagttgtacgctaagacgcagtactgtgtctcatgtgctatccactctcacgttgtgagagtccgttcccgcaccaaccgtagggttcgtaccccacccccacgtttcgtcagacgcaaggaggatgctcccaagcccggacaacctggtcaggctgctcgccctgctggtggtgcccctgctgctcctcgtgcctaaaaactgcaagaagctggcaacacaaacctctttatattctagtttcagtctcagggttgtctagaatattggaggatgttttctacatttggttaaagatagttttgttgtggatctttgattgctttgagactatttatcagcttgttttgacatttggcgtttcctctttttggttcatgcaaatcaattctttc

SEQ ID NO: 1195 - DNA, 691 bp, Brassica napus
aacgcagagtacgcgggggccgcaacaaaaaaagagaaacgcaataggcttcttgtaactaacctcttcactgcaacatgactttcaagcgcaggaacggtggcaggaacaagcacaaccgtggtcatgtgaagcccatcaggtgttccaactgcgggaaatgctgtcccaaggataaggctatcaagaggttcatcgtcaggaacatcgttgagcaggctgccatcagagatgttcaagaagccagtgtctacgatggttacactcttcccaagttgtacgctaagacgcagtactgtgtctcatgtgctatccactctcacgttgtgagagtccgttcccgcaccaaccgtagggttcgtaccccacccccacgtttcgtcagacgcaaggaggatgctcccaagcccggacaacctggtcaggctgctcgccctgctggtggtgcccctgctgctcctcgtgcctaaaaactgcaagaagctggcaacacaaacctctttatattctagtttcagtctcagggttgtctagaatattggaggatgttttctacatttggttaaagatagttttgttgtggatctttgattgctttgagactatttatcagcttgttttgacatttggcgtttcctctttttggttcatgcaaatcaattctttcagaaaaaaaaaaaaaaaaaaaaaa

SEQ ID NO: 1196 - DNA, 649 bp, Brassica napus
caacaaaaaaagagaaacgcaataggcttcttgtaactaacctcttcactgcaacatgactttcaagcgcaggaacggtggcaggaacaagcacaaccgtggtcatgtgaagcccatcaggtgttccaactgcgggaaatgctgtcccaaggataaggctatcaagaggttcatcgtcaggaacatcgttgagcaggctgccatcagagatgttcaagaagccagtgtctacgatggttacactcttcccaagttgtacgctaagacgcagtactgtgtctcatgtgctatccactctcacgttgtgagagtccgttcccgcaccaaccgtagggttcgtaccccacccccacgtttcgtcagacgcaaggaggatgctcccaagcccggacaacctggtcaggctgctcgccctgctggtggtgcccctgctgctcctcgtgcctaaaaactgcaagaagctggcaacacaaacctctttatattctagtttcagtctcagggttgtctagaatattggaggatgttttctacatttggttaaagatagttttgttgtggatctttgattgctttgagactatttatcagcttgttttgacatttggcgtttcctctttttggttcatgcaaatcaattctttcagaa

SEQ ID NO: 1197 - DNA, 665 bp, Brassica napus
atcaacgcagagtacgcgggggtcgccgcaacaaaaagagaaacgcaataggcttcttgtaactaactcttcactgcaacatgactttcaagcgcaggaacggtggcaggaacaagcacaaccgtggtcatgtgaagcccatcaggtgttccaactgcgggaaatgctgtcccaaggataaggctatcaagaggttcatcgtcaggaacatcgttgagcaggctgccatcagagatgttcaagaagccagtgtctacgatggttacactcttcccaagttgtacgccaagacgcagtactgtgtctcatgtgctatccactctcacgttgtgagagtccgttcccgcaccaaccgtagggttcgtacccctcccccacgtttcgtcagacgcaaggaggatgctcccaagcccggacaacctggtcaggctgctcgccctgctggtggtgcccctgctgctcctcgtgcctagaaactgctagaagctggcaactcaaacttctttatattctagtttcggtctcatggttgtctagaatatttgaagatgttttctacatttggttaaagatagttttgttttggatctttgaatgctttgagactatttatcagcttgttttgacatttggcgtttcctctttttgtttcatgcaaatcaatt

SEQ ID NO: 1198 - DNA, 620 bp, Raphanus sativus
gccgcaacgaaaaagaaacgcgaataggctttgttctaactctccacactgcaacatgactttcaagcgcaggaacggtggaaggaacaagcacaaccgtggtcatgtgaaccccatcaggtgttccaactgcgggaaatgctgtcccaaggataaggcgatcaagaggttcatcgtcaggaacatcgttgaacaggctgccatcagagatgttcaagaagccagtgtctacgatggttacactctcccgaagttgtatgccaagacgcagtactgtgtctcatgtgctatccactctcacgtcgtgagagtccgttcccgcaccaaccgtagggttcgtaccccacctccacgttttgtcagacgcaaggaggatgctcccaagcctggacaacctggtcaggccgctcgccctgctggtggtgcccctgctgctgctcgtgcttaaagactgcaagaagctggcaaatcaaaaatctttatattctagtttcactctcagggttgcctagaatttttgaagatgctttctacatttggttaaaagataatttcgtcatgtggacctttgaatgctttgagactatttatcagtttgttttgacatttggcgtttcttc

SEQ ID NO: 1199 - DNA, 667 bp, Raphanus sativus
  misc_feature (627)..(627): n is a, c, g, or t
  misc_feature (648)..(648): n is a, c, g, or t
ggccgcaacgaaaaagaaacgcgaataggctttgttctaactctccacactgcaacatgactttcaagcgcaggaacggtggaaggaacaagcacaaccgtggtcatgtgaaccccatcaggtgctccaactgcgggaaatgctgtcccaaggataaggcgatcaagaggttcatcgtcaggaacatcgttgaacaagctgccatcagagatgttcaagaagccagtgtctacgatggttacactctcccgaagttgtatgccaagacgcagtactgtgtctcatgtgctatccactctcacgtcgtgagagtccgttcccgcaccaaccgtagggttcgtaccccacctccacgttttgtcagacgcaaggaggatgctcccaagcctggacaacctggacaggccgctcgccctgctggtggtgcccctgctgctgctcgtgcttaaagactgcaagaagctggcaactcaaaaatctttatattctagtttcagtctcagggttgtctagaatttttgaagatgctttctacatttggtttaaagataatttcgtcatgtctacctttgaatgcttggagactatttatcagtttgttttgacatttggcgtttcttctttttngttctcgcaaatcaattcttncaatagaagtattgagtga

SEQ ID NO: 1200 - DNA, 635 bp, Brassica napus
aaaaagagaaacgcaataggcttcttgtaactaactcttcactgcaacatgactttcaagcgcaggaacggtggcaggaacaagcacaaccgtggtcatgtgaagcccatcaggtgttccaactgcgggaaatgctgtcccaaggataaggctatcaagaggttcatcgtcaggaacatcgttgagcaggctgccatcagagatgttcaagaagccagtgtctacgatggttacactcttcccaagttgtacgccaagacgcagtactgtgtctcatgtgctatccactctcacgttgtgagagtccgttcccgcaccaaccgtagggttcgtacccctcccccacgtttcgtcagacgcaaggaggatgctcccaagcccggacaacctggtcaggctgctcgccctgctggtggtgcccctgctgctgctcgtgcctaaaaactgctagaagctggcaactcaaacttctttatattctagtttcggtctcagggttgtctagaatatttgaagatgttttctacatttggttaaagatagttttgttttggatctttgaatgctttgagactatttatcagcttgttttgacatttggcgtttttcctctttttgtttcatgcaaatcaatt

SEQ ID NO: 1201 - DNA, 448 bp, Brassica juncea
gtacgcgggggcctgtcgccgtaacaaagaaaacaagagatcgcactagaggcttgaaactcattgcttgcaacatgactttcaagcgtagaaacggtggcaggaacaagcacaatcgtggtcatgtgaaccccattaggtgttccaactgtgggaaatgctgccccaaggataaggcaattaagagattccttgtcaggaacattgttgagcaagctgctatcagagatgttcaagaagccagtgtttacgatggttacactctcccaaagttgtacgccaagatgcaatattgtgtttcatgcgctatccactcacacgttgtgagagtccgatcccgcaccaaccgaagggttcgtaccccacctcctcgttttgctagacgcaaggaggatactcccaagccggggcaacctggtcaggcccctcgccctgctggtggtgcccc

SEQ ID NO: 1202 - DNA, 727 bp, Brassica rapa
  misc_feature (590)..(590): n is a, c, g, or t
ggttcgccgcaaataagagaagcaaaacaggcttgagaagctctttgctgcaaacatgactttcaagcgcaggaacggtggtaggaacaagcacaaccgtggtcatgtgaacccaatcaggtgttccaactgcgggaaatgctgccccaaggataaggcgattaagagattcctcgtcaggaacatcgttgagcaagctgccatcagagatgtacaagaagctagtgtatacgatggttacactctaccaaagttgtacgctaagatgcagtactgtgtttcatgtgctatccactctcacgttgtgagagttcgatccagcactaaccgtagagttcgtaccccaccgccccgttttgccagacgcaaggaggatgcgcccaagcctggacatcctggtcaggcccctcgacctgctggtggtgccccagctgctcctcgtgcctaaagactgcaacaagctggctatcccaaactatttatattctagtagtctcagtcttgtctggagtttgtgaaaatatttttggcatttggttttgaatctttgaaactctttataagtttatttttgacgtttacatttcctntcaatttgacatgttttattccatatttgcactgatcacctctggaaatattttcgcactggtattgatcttatgctatgcatggaaatatttttgtttatttttataattgcatgtgattcataaaagataaatat

SEQ ID NO: 1203 - DNA, 649 bp, Brassica rapa
ggttcgccgcaaataagagaagcaaaacaggcttgagaagctctttgctgcaaacatgactttcaagcgcaggaacggtggtaggaacaagcacaaccgtggtcatgtgaacccaatcaggtgttccaactgcgggaaatgctgccccaaggataaggcgattaagagattcctcgtcaggaacatcgtcgagcaagctgccatcagagatgtgcaagaagctagtgtctacgatggttacactctaccaaagttgtacgcgaagatgcagtactgtgtttcatgtgctatccactctcacgttgtgagagttcgatccagcactaaccgtagagttcgtaccccaccgcctcgttttgccagacgcaaggaggatgcgcccaagcctggacatcctggtcaggcccctcgacctgctggtggtgctccagctgctcctcgtgcctaaagactgcaacaagctggctatcccaaactatttatattctagtagtctcagtcttgtctggagtttgtgaaaatatttttggcatttggttttgaatctttgaaactctttataagtttatttttgatgtttacatttcctctcaatttgacatgttttattcgatatttgcactgatcacctttggaaatattttcgcac

SEQ ID NO: 1204 - DNA, 579 bp, Brassica napus
gactttcaagcgcaggaacggtggtaggaacaagcacaaccgtggtcatgtgaacccaatcaggtgttccaactgcgggaaatgctgccccaaggataaggcgattaagagattcctcgtcaggaacatcgtcgagcaagctgccatcagagatgtgcaagaagctagtgtctacgatggttacactctaccaaagttgtacgcgaagatgcagtactgtgtttcatgtgctatccactctcacgttgtgagagttcgatccagcactaaccgtagagttcgtaccccaccgcctcgttttgccagacgcaaggaggatgcgcccaagcctggacaacctggtcaagcccctcgccctgctggtggtgctccagctgctcctcgtgcctgaagactgcaacaagctggcaatcccaaactatttatattctagtagtctcagtcttgtctggagtttgtgaaaatatttttggcatttggttttgaatctttgaaactctttataagtttatttttgacgtttacatttcctctcaatttgacatgttttattcgatatttgcactgatcacctttgga

SEQ ID NO: 1205 - DNA, 568 bp, Brassica napus
gactttcaagcgcaggaacggtggtaggaacaagcacaaccgtggtcatgtgaacccaatcaggtgttccaactgcgggaaatgctgccccaaggataaggcgattaagagattcctcgtcaggaacatcgtcgagcaagctgccatcagagatgtgcaagaagctagtgtctacgatggttacactctaccaaagttgtacgcgaagatgcagtactgtgtttcatgtgctatccactctcacgttgtgagagttcgatccagcactaaccgtagagttcgtaccccaccgcctcgttttgccagacgcaaggaggatgcgcccaagcctggacaacctggtcaagcccctcgccctgctggtggtgctccagctgctcctcgtgcctgaagactgcaacaagctggcaatcccaaactatttatattctagtagtctcagtcttgtctggagtttgtgaaaatatttttggcatttggttttgaatctttgaaactctttataagtttatttttgacgtttacatttcctctcaatttgacatgttttattcgatatttgcactga

SEQ ID NO: 1206 - DNA, 669 bp, Brassica napus
agggagagtaaccctagcagcagacacacacacacacagctcaccagaagagaggagtctaagtcgccgccgccgagcaaagaagatgactttcaaacgcaggaacggagggaggaacaagcacaaccgtgggcacgtgaagccaatcagatgctccaactgcggcaaatgttgcccaaaggaccatcaagaggtttatcgtgaggaacattgtggagcaggctgctattagagatgttcaggaagctagcgtatacgatgggtacacattgcctaagctgtatgctaagacgcagtactgtgtctcctgtgcgatacactctcacgttgttagagttcgttcccgcaccaaccgcagagttcgtactcccccgcctcgttttgttagacgcaaggaggatgctcccaagcctggacaacctggtcaggctcctcgtcctgctggagctgcagctgccccgcgtgcctgaagcctctgaatatcccttgtttcagctttttgaagttttatgtttggttcagattgatcgtactagtaccaatatgtgaatctcgaaagctgttttagtagtgttcttgtttcgacttcgttatatttaaaacactttgtttgttttctcgaagtcatgatttgttttaacaataaatcttcaaataagtaaaactgtt

SEQ ID NO: 1207 - DNA, 562 bp, Brassica juncea
gccgcaacgaacaagaaaacgctaatagggcttgtaactcgtcactgcaacatcatgactttcaagcgcaggaacggtggcaggaacaagcacaaccgtggtcatgtgaacccaatcaggtgttccaactgcgggaaatgctgtcccaaggataaggcgatcaagagattcctcgtcaggaacatcgttgaacaggctgccatcagagatgttcaagaagccagtgtctacgatggttacactctaccaaagttgtactctaagatgcagtactgtgtctcttgtgctatccactctcacgtcgtgagagtccgttcacgcaccaaccgtagggttcgtaccccaccgccacgttttgtcagacgcaaggatgatgcccccaagcccggacaacctggtcaggcccctcgccctgctggtggtgcccctgctgctcgtgcttaaagactgcaagaagctggcaactcaaacacctttatattatagtttcagtctcttctttgtccgaaaattttgaacatgttttcttcatttggttaaagatgatttttgtcatgtggag

SEQ ID NO: 1208 - DNA, 702 bp, Eutrema parvulum
ctaaaagtaacaataaaccatcttcactgtagctcagtcgtcgagaagagagaataaccctagcagcagtagagacacagcttttcagctcacgagaagagaaatcttagtcgcagccgcgtcgcaaagaagatgactttcaagcgtaggaacggtgggaggaacaagcacaaccgtggccacgtgaagccaatccgatgctccaactgtggcaaatgttgccccaaagtactaaccaattcgcctccaggaacattgtggagcaggctgccattagagatgttcaggaagccagcgtctacgatgggtacacattgccgaagctgtatgcgaagacgcaatactgtgtctcatgtgccatccattctcacgttgttagagtccgatcccgcaccaaccgtagggttcgtactccgccgccgcgttttgccagacgcaaggaggatgctcccaagccaggacagcctggtcaggctcctcgtcctgcaggacctggagttggagctgcaccgcgtgcctgaagcctctgcatatcttaatttcagcttttgaagattattttgttttgcttatgtttggttcaaattaattatactactaccatgtgaatctcaaaagcttttagtagttgttgtttcgactttgttatattttaaacttcgtcttgttttgctcttaatcgtaaaagataactttccttca

SEQ ID NO: 1209 - DNA, 796 bp, Cleome spinosa
cacgtgccaaagctgccataacagtattgtaggtggaaagatcaggagtgaccccagcttcaagcattctcttgtaaacagtcatggcttgatcaatcgaaccacagtgactataagcactaatcagagtgttgaaagtgtctctttccggtatgaacccccccggccgtacggccggggacagtcgaagagccgcacaaaaccctagcttggagctgtactgtaggcaggcaaccatgactttcaagcgcaggaacggtggcaggaacaagcacaacaggggacatgtcaatttcatccgctgctccaactgcggcaaggcctgtcctaaggacaaggcggtaaagagatttatcgtcaggaacattgtcgagcaggcagctatcagggatgttcaggaagccagtgtctacgatggctacgctctgccgaagctgtacgccaagctgcagcactgtatctcgtgcgccatccactctcacgtcgtgagggtcaggtcccgcaccaaccgtagggttcgtaccccaccgcagcgtttcgccagacgcagggaagacatgcctaagccagggcaaccaggacaggctccccgtgtccccggagctggagctgcaccccgcacctgagattctacagaccttgcttccttcccccaatccatgttcactagtttcttttaacgttgtctgaaattttactttggggatgcttttatatttgtgattttgatctctcgagttcaaatgctttgagacttgctatagttattcgactcagaccagatggttttcttgtc

SEQ ID NO: 1210 - DNA, 501 bp, Cleome spinosa
cgctgaaaaccctacttcgcaaaagtcaagccggaaccaaccatgaccttcaagcgcaggaacggtggcaggaacaagcacaacaggggccgatgtcaatttatccggtgctccaactgtggcaagtgctgccctaaggacaaggctgttaagaggtttatcgtgaggaacattgtcgagcaggcggctattagggatgttcaggaagccagcgtctatgatggctacactctgcccaagctgtatgccaagatgcaatactgtatatcctgtgcaatccactctcacgttgtgagggtcagatcccgcaccaaccgcagggttcgtaccccaccgcagcgcttcgccagacgcagggaggacatgccgaagccagggcaaccaggacaggcgccgcgtgtccccggcgctggagctgctcctcgtacctgaagttctcaaaatcccttcccccaatccacagtctcttttccattctgtctgaaacctcaggatgctttt

SEQ ID NO: 1211 - DNA, 559 bp, Brassica napus
aacatgactttcaagcgcaggaacggcggcaggaacaagcacaaccgtggtcatgtgaagcccatcaggtgttccaactgcgggaaatgctgtcccaaggataaggctatcaagaggttcatcgtcaggaacatcgttgagcaggctgccatcagagatgttcaagaagccagtgtctacgatggttacactcttcccaacgttgtacgctaagacgcagtactgtgtctcatgtgctatccactctcacgttgtgagagcccgttcccgcaccaacctagggttcgtacccacccccacgttcgtcagacgcaaggaggatgctcccaagcccggacaacctggtcaggctgctcgccctgctggtggtgcccctgctgctcctcgtgcctaaaaactgcaagaagctggcaacacaaacctctttatattctagtttcagtctcagggttgtctagaatattggaggatgttttctacatttggttaaagatagttttgttgtggatctttgattgctttgagactatttatcagcttgttttgacatttggcgttt

SEQ ID NO: 1212 - DNA, 780 bp, Arachis hypogaea
ttgtgcccctgtccactgagagcattatctccagaaccctagagagctttagagcgtaacaagcttcaaccatgactttcaagcgcaggaacggaggaagaaacaagcatggccgtggccacgtcaaattcattcgctgctccaattgcggcaagtgttgtcccaaggacaaatcaatcaagaggtttcttgtgaggaacattgttgagcaggctgcagttcgtgatgttcaggaagcctgtgtctatgagcaatacactcttccgaaactgtatgtgaagatgcagtattgtgtttcgtgtgctattcactctcacgttgtgagggtacgttctcgcactgataggaggaaccgtgagcctccgcagcgctttgctaggcgcagggatgatgcgccaaggcccggtcaacctggtcaagctcctcgtcctgctggagctggagctgcccctcgtgtttaaattcattctataattttaggccttgttaattcaatattgttaagaacttaattttcttttgctgcttattatttaaatatcagttaccttgggataatgatgtttttttcttagtctggttgcctggaactgaaccataacaatttaatggttttgatgagaatggttttaatgattttcttacgtcttcgaatgctcaaattgtaatttgtcaatgggtatgcacttgtatctctgaaataaatttaccccgtatgcgcgaactgaaattagtcatgtaattggttcttattttcatccaatacaaatcttcattata

SEQ ID NO: 1213 - DNA, 742 bp, Zostera marina
ggggaatcgccgtgccgagacaaatttgacagaaagagagaacaaggtcgacgtctctcgatctcccgacatgacattcaagcgtaggaatggaggccgcaacaagcatggccgtggccacgtcaactttatccgttgttcgaactgcggaaagtgttgccctaaggacaaagcaatcaagagatttctcgtgaggaacattgttgaacaagctgctgtcagggatgtccaggaggcttgcgtctacgaaggatacactttacctaagctctacgcaaagatgcaatactgtgtctcttgtgccattcattctcatgttgtcagggttcgttctcgtgaaaataggagaaacagggagcctccacagagattcaggcgtaaagatgataccaacaaacctggccaacctcctcgcccagcaggagctcccggtgcccctccgccacgccaatgatttcgaaaaaaatctctgatcttaaattcacaatacattattaaattttataaacgttggattgatggaatccgcgttattcatcttagagcaagttttttgctgtttcagatttcaaatgattttcttatctctagaagtacctatttctagttatttgcaggtttgtttgaactacataaacttgataattttcaaaatcttttttagttttttcatcgcttattcattggtaaatttaagacctaaacaatgtttttaagaattaaattcgatttactaaaactt

SEQ ID NO: 1214 - DNA, 713 bp, Euonymus alatus
ccactcagaaccctaatttcggagggcgggaccggaagtcttatcgacggctctcttgaagttgccacacaaccatgactttcaagcgcaggaacggaggccgtaacaagcacggtcgtggccacgtcaagttcatccgctgctcaaattgcggcaaatgctgccccaaggacaaggctattaagaggttccttgtgaggaacatcgttgaacaagctgctgtcagggatattcaagaagctggcgtctatgagcagtacactctcccgaagctttatgcgaagatgcaatactgtgtgtcatgtgccatccactctcatgtggtcagggtgcgttctcgtactaacaggagggtccgggagccaccacagcgtttcatcagacgcagggatgatatgccaaagcctggtcagcctggccaagcacctcgtcccgcaggagctggcaaccctgtccgtgcttgagatcaaattattttctgatgctgttttgctgtcatatgcatgctgagaattccatcaatttctgttgtttaggacaccgtattctataattacaggcttcaatttttgaggttgtctattcagattttggatctacgaattgaggtcgtcagtttagctttcttgacattattttccatttgcacggtttggacttgcaaatttgcaatcagttttgcctttgaactacattagggggccgttattttg

SEQ ID NO: 1215 - DNA, 621 bp, Fagus grandifolia
  misc_feature (11)..(12): n is a, c, g, or t
  misc_feature (14)..(15): n is a, c, g, or t
  misc_feature (17)..(18): n is a, c, g, or t
  misc_feature (21)..(21): n is a, c, g, or t
ctttaactatnnanngnngcnacctagagcagagcagccgaccctagctagagatctcccttggcaaccatgactttcaagcgcaggaatggtggtcgtaacaagcacggccgtggccacgtcaagttcatccgctgctccaactgcggcaaatgctgtcccaaggataaggccatcaagaggttccttgtgaggaacattgttgagcaagctgcagttagggatgttcaagaagcctgcgtctatgaccagtatgttcttccaaagctatatgcaaagatgcagtattgtgtttcctgtgcgattcactcgcatgttgtgagggttcgctctcgcactaataggaggaagcgtgagccaccacagcgtttccagaggcgtagggaggatacaccaaggcctggtcagcctggacaagctcctcgccctgctggagctgggaatcctgctcgagcataaaacgcctccaagtttatcatataaactgttatgctcgtttttagtttgtctaggaaatcttaatggttgacattatgttttctttatgaattttttattgagaatggaacctgattatgtaacttatttgagatcactataattcttgtatttgaaattagt

SEQ ID NO: 1216 - DNA, 656 bp, Eschscholzia californica
aaaccctaactacccaatctgtgcagcggagaagtcaagaaaaatgactttcaagaggagaaatggaggaagaaacaagcatggccgaggtcatgtcaaattcatccgatgttcaaactgcggaaaatgttgccctaaggataaggccataaagagattccttgttcgcaacatcgtagaacaagctgctgttcgtgatgttcaggaagcttgtgtttatgaaggttacactctcccaaagctgtacgcaaagatgcagtattgtgtttcatgtgctatccactctcacgttgttagggttaggtctcgcactgaccgtcgcaaccgtgcacctcctcagcgtttcagacgaaaggaagacacacccaaaccagcacaagctcctcgcccagcagcaactactgccaatccaccccgtgcataaggagtttacggtgacgcggctatgtctttatagttatattgcatttcaaatagacatttctgttagaagtgaaatttcaagttttttgaagagattaattgacaatcttgttatttgaagcagtagataatttcagaacttagtctaatgagttacatgatttgattgaatcctgttttactcaactttgaaactgtctgttgtttgagttaaaaaaaaaaaaaaaaactcg

SEQ ID NO: 1217 - DNA, 654 bp, Arachis hypogaea
ttgtgccactgagattatcacctccagaaccctagctagcttcagagcggaacgagcttcaagccttcagccatgactttcaagcgcagaaacggaggaagaaacaagcatggccgtggccacgtcaaattcattcgctgctccaattgcggcaagtgctgccccaaggacaaatcaatcaagaggtttcttgtgaggaacattgttgagcaggctgcagttcgtgatgttcaggaagcctgtgtctatgagcaatacactcttccgaagctgtatgtgaagatgcaatattgtgtttcgtgtgctattcactctcacgttgtgagggtgcgatctcgcactgataggaggaaccgtgagcctccgcagcgctttgctaggcgcagggatgatgcaccaaggcccggtcaacctggtcaagctcctcgtcctattggagttggagctggagctggagctgctcgtgcttagacataactccattctataattttgttggttcaattttgttaagaacttcattttcttttgctgtttattatttaaatatcagttatgttgggataatgatgttttttttcttactgtggttgcctggaataatgaatgataacaatttagtggttttgatgagaatgattacggagttcgatt

SEQ ID NO: 1218 - DNA, 606 bp, Chelidonium majus
tttcaagagcaaagggtttctacgcgtcttctcagttctcagtcagtcgcaaaatgacgtttaagagaaggaatggtggccgcaacaagcacggccgtggccacactaagttcatccgctgttccaactgcggaaaatgctgccctaaggacaaggccatcaagaggtttcttgtgaggaacatcgttgagcaagctgctgttagggatgttcaggaagcttgtgtttatgacgggtacactcttcccaagctgtacgcaaagatgcagtactgtgtttcctgtgcaatccactctcacgttgttagggttcgctctcgtaccaaccggaggaaccgtgacccacctcagcgctttagacgccgggatgatatgccaaagccagggcaagccgcacgccctgcaggtggtgcccctgctgctgctgctgcagctcagcctgctcgcgtttaacaatctaaattttgcgctggttttgcatcatgcttttgagatgtaaggtggaaccaagttttgtgtggacgaatgtttgtttaggggatccccaaaaatctcctcgtttctagatgctaagtttagtttttattgttttggaagtattatctac

SEQ ID NO: 1219 - DNA, 1208 bp, Cannabis sativa
attcaaggcccaaaaggagcccaaaacactgtaaaaccctagctggtttcataacatgctttctcgaccccaaccacatactctgagtctgagatcttgatcaagtttagggttcagcagcgaacatgactttcaagcgaaggaatggtggaagaaacaaacatggtcgtggccatgtgaaatttatccgctgttccaactgtggtaaatgttgccctaaggacaaggccatcaagagattcttggtgaggaacattgtcgaacaagcggctgtgagggatgttcaggaagcttgtgtctacgatggttacactcttcccaagctctacgccaagatgcagtactgtgtctcctgtgcaattcactctcacgttgtgagagttcgttccagggaaaacaggagggtccgtgagcccccacagcgtttcagacgccgggaggacactgctaggcccggcggtgcaccaggccaggctggacaacgcccagcaggaggagcaccagctgctgctcgcacttgaacaaagtgacatgcaatgttcttgttccttgagcatcttctctttcgaggctttagttattggatgttaccttaaaagtctttttttggttacctaattcagttggctatgagacttcaatgtattagtgtcttgtggatttttgcttcaattttggtagcgttcttgttattggttaatgagtgaaattacaatttacaagttcggaatctatctaatgaaaaagaaggaatatattatatttgttttttcctgtaaagatattccacatgtattcttctctggtttgttagtcaattcttttagttaaccagagtacgaaagaaaaacaaatggaaaagcgacgaatgtgaggtgttgtaaattgtaattctaacgtaaacgtgttggtagtagtagccagtactgctgctgccattatttcattccataatatatgttatgagcgtctttcttaatccctaagggtatttgtgatgagcttgagaaaatgatgtgcaagttttggtgaaagtcttcttcaaaagatggtactggcatacattagatgaatattggaatcgtattaccccaaaagagcaaggtggtatgagattttgacatttgcatgattacaatattgttcttcttggtaaacaagtgtggagacttcacactctcaaagattctttggtttgtaaattattc

SEQ ID NO: 1220 - DNA, 696 bp, Humulus lupulus
cccattacggccgaaaatgttctctcgaccccaaggagataatctgagatcttgatcaagtgtagggttcaggagcgaacatgactttcaagcgaaggaatggtggaagaaacaaacatggtcgtggccatgtgaaatttatccgctgttccaattgtggtaaatgttgccctaaggacaaggccatcaagagatttttggtgaggaacattgtcgagcaagcggcggtgagggatgttcaggaagcctgtgtctatgatggctacactcttcccaagctctacgccaagatgcagtactgtgtctcctgtgcaattcactctcacgttgtgagggttcgttccagggaaaacaggagagtccgtgagcctccacagcgtttcagacgccgggaggacactgctaggcccggtggtgcaccaggtcaggcagggcaacgcccagcaggaggagccccagctgctgctcgcacttgaacaaagtgacatgcaaggctccttttcctcaagcctcttttcgttcgaggctttagttatttattggatgttacattaaagtcttttggtttcctaattcagttccctatgagagacttcaatattagtgtcttgtggatttttgtttcaattttgctagtgttcttgttattggttaatgaattgaaattacaatttacaagttaattcaagaaattct

SEQ ID NO: 1221 - DNA, 510 bp, Eschscholzia californica
gaacaagcgaaaaccctaacccatccgcacaggagaagagaaatcactgaaaatgacattcaagagaagaaatggaggaagaaacaaacatggccgaggtcatgtcaaattcatccgctgttccaactgcggaaaatgttgccctaaggataaggccatcaagagattccttgttcgcaacatcgtagaacaagccgctgttcgtgatgtccaggaagcttgtgtttatgaaggttacacactcccaaaactgtacgctaagatgcagtactgtgtatcatgtgcaattcactcgcacgtcgttagggttaggtctcgaactgaccgtcgtaagcgtgacccacctcagcgatttaggcgaaaggaggatggacctaagccaggacaagctcctcgcccagctgcagctgcaggtgcaggtgcaactgctattccaccccgcccatgaggaattcacaacggttctgttccttatagatataaatctttaatcagtggatgaatttcaag

SEQ ID NO: 1222 - DNA, 759 bp, Cucurbita pepo
ccttctgcgtcctcttcatataaaaggatcactaccaccaattcataaaccctatttcagccgacgagctctctgattctctctggttcgctcggtcatctgagacactagagctatgactttcaagcgtaggaatggtggacgcaacaagcacggacgcggacacgtgaaatttatccgctgctccaactgcggaaaatgctgccccaaggacaaggccatcaagaggttccttgttaggaacatcgtggagcaggcagctgttagagatgttcaggaagcctgtgtctatgatcagtacactcttcctaagctatatgccaagatgcagtactgtgtttcttgtgctatccactctcacgttgtgagggttcgatcacgcactgacaggaggaagcgtgatcctccacagcgcttcattagacgcagggaagatgcaccaaagcctggacagccaggacaggctcctcgcgttggagctggccctggagctccaccccgtgcttgaaagaacgtcttacttgctatttaattttgtcatggtttcccaaatttcgcggacttcaattttattaggtttttcaaaatagtttgaggctttgttatgagtatcaaattatgttctactgttgaattctgattaattttggttgaacggggtctacttgaacattttcaatgtttttgtaatggctcaattatctatcaaaaaaaaaaaaaaaaaagaaatactgtgtgtatacaccgctgtcttcgtag

SEQ ID NO: 1223 - DNA, 665 bp, Arachis hypogaea
ggggaaagaaagaaaagtagaaaaccctaatagttgtgccactgagattatcgcctccagaaccctagctagcttcagagcggaacgagcttcaaccatgactttcaagcgcagaaacggaggaagaaacaagcatggccgtggccacgtcaaattcattcgctgctccaattgcggcaagtgctgccccaaggacaaatcaatcaagaggtttcttgtgaggaacattgttgagcaggctgcagttcgtgatgttcaggaagcctgtgtctatgagcaatacactcttccgaagctgtatgtgaagatgcaatattgtgtttcgtgtgctattcactctcacgttgtgagggtgcgatctcgcactgataggaggaaccgtgagcctccgcagcgctttgctaggcgcagggatgatgcaccaaggcctggtcaacctggtcaagctcctcgtcctattggagctggagctggagctggagctgctcgtccttaaaactccattctataattttaggcttcttggttcaattttgttaagaacttcattttcttttgctgtattatttaaatatcagttatgttgggataatgatgttttttttctggttgcctgaaatactgaatgataacaatttaatggttttgatgagaatggttacgga

SEQ ID NO: 1224 - DNA, 535 bp, Cucurbita pepo
tagctgattctctctggttcgttcgtccatccggaagactagaaccatgactttcaagcgcaggaatggtggacgcaacaagcatggacgcggacacgtgaaattcatccgctgctccaactgtggtaaatgctgcccgaaggataaggccattaagaggttccttgttaggaacatcgtggagcaggcagctgttagggatgttcaggaagcgtgtgtctatgatcaatacactcttcctaagctatatgctaagatgcagtactgtgtttcctgtgctatccactctcacgttgtgagggttcgatcacgcactgataggagaaaacgtgagccaccacagcgattcattagacgcagggatgatatgccaaagcctggtcagccaggacaggcccctcgcgttggagctggagctggagctcctcctccccgtccctgaagaggaacccctttatatgctctatttaattttcttatggttgctgcaatttggtgaacttgaattttatttagcatttctcgatatattttt

SEQ ID NO: 1225 - DNA, 740 bp, Trigonella foenum-graecum
ctatgacgttcaagcgtaggaatggaggtcgcaacaagcacggccgtggccatgtcaagttcatccgatgctccaactgtggaaaatgctgccctaaggataaggctatcaagcgttttctggtgaggaacattgttgaacaagctgcagtcagagatgttcaggaagcttgtgtttatgatcaatacactcttcctaagctgtatgtgaagatgcagtactgtgtttcctgtgctattcactctcatgttgtgagggtcagatctcgcactgacaggaggaagcgtgagcctccacagcgtttcattaggcgcagggatgatgcaccaaggcctggccagcccggtcaagcccctcgccctgctggacctggagctcctccagcccgtgcctagaagaagctaatctgaagttttttgtcttgttggatcagatttatgtcatgaacctcagttggtttgcttaattttagattccagttttgtgtagcaacaatatattattgtctgactttttgcttgcgttctctggcaatacctacattttggatcattttaatttgatgtttttgaatgagtggaacctttatatttaataatttctgaggatgtgcaagagtaggtgatagatagcatggaacctgtgttatatttgaaaactgaaaatgtcagatttgcttaaaggatgaaaatcacaagctcttgcctaaataagatagtatcttgaaacacaatactatt

SEQ ID NO: 1226 - DNA, 714 bp, Citrullus lanatus
ttaccggtgcggatcttctctctcacactcggcatttcccacaaaaaccctaatcggctgcgtctctctctctctgcttcatttgaagatctccaactttggaacaatgactttcaagcgcaggaatggcggacgtaacaagcatggccgtggacacgttaagttcatccggtgctccaactgcggaaaatgctgccctaaggacaaggctattaagaggtttctcgtgaggaatattgtggagcaggctgctgttagggatgtccaagaagcctgtgtctatgatcaatatactcttcctaagctttatgcgaagatgcagtactgtgtttcctgtgctattcactcacatgttgtgagagttcgatctcgtactgatagaagaaatcggcaaccaccacaacgtttcatcagacgcagggaggatcaggcaaaacctggtcagccagggcaagcacctcgtcctgttggagctggaaatcctgcccgtgtataaaagaaacctttccatggcttctacgagtaagtcgtagggatcttttacaagtcgctctattatagtttggttgtttcttttgtggatgaaagtgaaatttagaaacaaacttagctgacaattttgcaacttggaaggaactaaagaccgtttatggagttgtttatttaatggtttttcttcagtttcttgtttcgctgttccgggagttccgattt

SEQ ID NO: 1227 - DNA, 728 bp, Amborella trichopoda
acactctctctctcatccttccacgttcatatttaagccctgcctctcttctctccaagccctagaacggttcccttaatcatctcatccagtgagagagaaccggctactgcaaaccctaattcactccaaccatgacgttcaagaggaggaatggtggtcgtaacaagcatggtcgtggccatgtcaacttcatccgctgctcaaactgcggcaagtgctgccctaaggacaaagccataaagaggtttctggttcgtaacatagtcgaacaagctgccgttagagatgtgcaagaggcatgcgtttacgatggctatactcttccaaagctctatgcaaaaatgcaatactgtgtttcttgcgccatccactcgcatgtggttcgtgtgaggtctcgcactgatagacgtaaccgtgagccccctcagcgattcaggcgcagggatgatgcccccaagcctggacaagctcctcgtccagcaggagctgcgcctgctcgaccatgatgagtttgctctctcttcggatttgatcagttttctaggcttcttcattgcaatgagaaaccatatttttgtttaagacgttgttaggggtccttatatgttattttctcaagaattgtcttgatagctttggatttaatgtgcttttggatttatacgcatgtgacttgaaaactaccagctgtgaatttcaatcttttccatatcattccttcgttc

SEQ ID NO: 1228 - DNA, 676 bp, Malus domestica
cttctggcttctgcagcagcgagtaaaaccctacatactccattgccgacggccgctgaactttcagatctcctccctctctcggaacaccatgactttcaagcgcagaaatggaggtcgcaacaagcacggccgtggacacgtcaagttcatccgctgctccaactgcggcaagtgctgccctaaggacaaggccatcaagagattcttggtgaggaacatcgtcgagcaggctgcggtgagagatgttcaggaagcctgtgtctatgagcaatacactctgcctaagctgtatgccaagatgcagtactgtgtttcctgtgcaattcactctcacgttgtgagggtgcgatcgcgcaccaacaggaggaaccgcgagccgccacagcgattcatcagacgcagggatgatgccccaaggcccggccagcctggtcaagctccccgacccgctggagctggggttcctgctcgtacttgatttgagcatgtcaatcctttcgttatgtgatggaggtttcccagtagctacacaatcttctggactgagttgtgtaggacttttttgttattctcgtgttattgttcagacgttttgaggattaaactacaatgtttatggatgtttttttttatgataatgaaatcttggatgacataatgcccaattttgaat

SEQ ID NO: 1229 - DNA, 664 bp, Malus domestica
gattgatcatgcttctggcttctgcagcagcgagtaaaaccctacatactccattgccgacggccgctgaactttcagatctcctccctctctcggaacaccatgactttcaagcgcagaaatggaggtcgcaacaagcacggccgtggacacgtcaagttcatccgctgctccaactgcggcaagtgctgccctaaggacaaggccatcaagagattcttggtgaggaacatcgtcgagcaggctgcggtgagagatgttcaggaagcctgtgtctatgagcaatacactctgcctaagctgtatgccaagatgcagtactgtgtttcctgtgcaattcactctcacgttgtgagggtgcgatcgcgcaccaacaggaggaaccgcgagccgccacagcgattcatcagacgcagggatgatgccccaaggcccggccagcctggtcaagctccccgacccgctggagctggggttcctgctcgtacttgatttgagcatgtcaatcctttcgttatgtgatggaggtttcccagtagctacacaatcttctggactgagttgtgtaggacttttttgttattctcgtgttattgttcagacgttttgaggattaaactacaatgtttatggatgtttttttttatgataatgaaatcttgga

SEQ ID NO: 1230 - DNA, 1291 bp, Beta vulgaris
  misc_feature (851)..(851): n is a, c, g, or t
  misc_feature (854)..(854): n is a, c, g, or t
  misc_feature (862)..(862): n is a, c, g, or t
  misc_feature (866)..(866): n is a, c, g, or t
acgatctgttactaacaggaggaaccgtgacccaccacaacgtttccctagacgcaaggaggacacaccaaggcctggtgctcctggagctcgacctgctggtgctcctgctgctggagcccgtgcataagggatactcacgttcgtctgaagcttaatgttgccatgcttatttcatagattttgtgaactttagttcaaagttttggttcaggatttttgtaaacctcaaaccctagtgagcgcagcagcagccacagtcggaggagagagaaattcgcctcgcctgccttcaaccatgactttcaagagaagaaacggaggtcgcaacaagcatggccgcggtcatgttaacttcattcgttgctccaactgcggtaaatgctgccctaaggacaaggccatcaagagatttatcgtgaggaacattgttgaacaagcagctgttcgtgatgttcaagaagcttgtgtctatgatgggtatgtgctcccaaagctttacaccaagatgcaatattgtgtctcctgtgctatccactcccacgtggtgagggtacgatctgttactaacaggaggaaccgtgacccaccacaacgtttccctagacgcaaggaggacacaccaaggcctggtgctcctggagctcgacctgctggtgctcctgctgctggagcccgtgcataagggatactcacgttcgtctgaagcttaatgttgccatgcttatttcatagattttgtgaactttagttcaaagttttggttcaggatttttgtaaacctcaactctatgcttgagctgtctttatttagaattgaatggggatgattgttatccaaagtttaatgntcnaatttttncttnaaaaaaaaaaaaaatctgggggggccggcccatttccccaagggggcaataaatccggccggttttaaaagcggggggaaaaccggggttccaattatactttggacacccctttcccggggaaaaaaaaggcccccttccctccaattgcccccggagggaggaatttagggaatttgaaaaccgaatttttaaaccttttttacagggaacggaaccttaaaaaaaaaaaaggggggtttctttgaaaccttaaaaaggccccaaggaaaacttgggggccccagaacccaattttgggggggaaaaaacacagggccctatttggaaaccaggaaaaaaaaaggggggctgtttttccccccccccttacccgggggttaagaaaaactttttaaacacccccaaataaaaaaaaaccctcc

SEQ ID NO: 1231 - DNA, 672 bp, Cucumis sativus
tatctcacgcttagcctttgcccacacaaaaccctaatcggctgcctctctctctctgcttcatttgaagatctccaactttgtaacaatgactttcaagcgcaggaacggcggacgtaacaagcacggccgtggacacgttaagttcattcgctgctccaactgcgggaaatgctgccctaaggacaaggctattaagaggtttctcgtgaggaatattgtggagcaggctgctgttagggatgttcaagaagcctgtgtctatgaccaatatactcttcctaagctttatgctaagatgcagtactgtgtttcctgtgctattcactcacatgttgtgagagttcgatctcgcactgatagaagaaatcggcaaccaccacagcgtttcatcagacgcagggaggatcaggcaaagcccggtcagccaggtcaagcacctcgtcctgttggagctggaaatcctgctcgtgtataaaagaaacctttttatggcttctacgagtaagtcgtagggttcttttataggcgctcttttatagtttggttgtttcttatgtggatgaaagtgaatttttgaatcaatatggaaacgaacttatccgagaattttgcaacttggaatgagctaaagaccgtttattgagttatctaatgtgttttcttcacttt

SEQ ID NO: 1232 - DNA, 682 bp, Medicago truncatula
cggccggggagcataaactcgaacgtaaccctagaggcattgcggctgctgaagtgatcggagcttggcaacaatgacgttcaagcgtagaaatggaggtcgtaacaagcatggtcgtggccatgtcaaattcatccgatgctccaactgtggaaaatgctgtcctaaggataaggctatcaagcgttttctcgtgaggaacattgttgaacaggctgctgttagagatgttcaggaagcgtgtgtttacgatcaatacactcttccaaagttgtacgtgaagatgcagtactgtgtgtcatgtgctattcactctcatgttgtgagggtcagatctcgcactgacaggaggaagcgtgagcctccacagcgtttcattaggcgcagggatgatgcacccaggcccggccagcccggtcaagccccacgccctgctggaccaggcgctcctccagcccgtgcctagaagctaatatgaagttttttttttctttttttgtgttgttggatcagatttatatcatgaacctcatttgatttgcttaattttagattccagttgtgtagcaacattatgttattgtctgatgttttgcttgtgttcttgggcaatacctacattttggatcattttaatttgatgcttttgaatgagtggaccttgatatttaataaaaaaaaa

SEQ ID NO: 1233 - DNA, 738 bp, Cucumis melo
atatctcacgctcagcctttgcccacacaaaaccctaatcggctgcctctctctctctgcttcattgaagatctccaactttgtaacgatgactttcaagcgcaggaacggcggacgcaacaagcacggccgtggacacgttaagttcattcggtgctccaactgcgggaaatgctgtcctaaggacaaggctattaagaggtttctcgtgaggaatattgtggagcaggctgctgtcagggatgttcaagaagcctgtgtctatgaccaatatactcttcctaagctttatgctaagatgcagtactgtgtttcctgtgctattcactcacatgttgtgcgagttcgatctcgcactgatagaagaaatcggcaaccaccacagcgtttcatcagacgcagggaggatcaggcaaagcccggtcagccaggtcaagcacctcgtcctgttggagccggaaatcctgctcgtgtataaaagaaaccttttcatggcttctacgagtaagccgtagggatcttttataggcactcttttatagtttggttgtttcttatgtggatgaaagtgaatttttgaatcaatatggaaacaaacttatctgagaattttgcaacttggaatgagctaaagaccggtaattgagttatccaatgagttttcttcactttcttgtttggattggattttctcccattttctaacaatatggattacgtctgaccttttggtcgaga

SEQ ID NO: 1234 - DNA, 857 bp, Arachis hypogaea
ttgtgcccctgtcccctgagagtatcacctccataaccctagagagctttcagagcgtaacgagcttcaaccatgactttcaagcgcaggaacggaggaagaaacaagcatggccgtggccacgtaaaattcattcgctgctccaattgcggcaagtgctgtcccaaggacaaatcaatcaagaggtttcttgtgaggaacattgttgagcaggctgcagttcgagatgttcaggaagcctgtgtctatgagcaatacactcttccgaagctgtatgtgaagatgcagtactgtgtttcgtgtgctattcactctcatgttgtgagggtgcgttctcgcactgataggaggaaccgtgagcctccgcaacgctttgctagacgcagggatgatgcaccaaggcccggtcaacctggtcaagctcctcgtcctgctggagttggagctgctccacgtgcttgaactcattctataattttaggccttgttaattcaatcttgttaagaacttaattttcttttgctgcttatgatttaaatatcagttatgttgggataatgatgttttttcttagtctggttgcctggaatactgaaccataacaatttaatgattttgatgagaatggttacggacttcgattatcttacgttttcgaatgctcaaatgtaatttgtcaatggttatgcacttgtatctctgaaataaatttgccccacatgcgcgaactgaaattagtcatgtaattggttcttatttcttccaatacaaatcttcattatactaaagtttgagccttagaaatgaatggtttgtaaggcaacgaaccttgattttctagtgttcaacgttagga

SEQ ID NO: 1235 - DNA, 640 bp, Arachis hypogaea
ctattgagaagctgccaccagaaccctaatttcacagccgcaggagctcccacaatgactttcaagcgcagaaatggcggaagaaacaagcatggccgcggccacgtcaaattcatccgctgttccaactgcggcaagtgctgccctaaggacaaatcgatcaagcggttccttgtgaggaacattgttgagcaagctgcagttcgtgatgttcaggaagcctgcgtctatgagcaatacactcttccgaagttgtacgtgaagatgcagtattgtgtttcctgtgccatccactctcatgtcgtgagggtgcgttctcgcaccgataggaggaaccgcgagccgccacagcgctttgccaggcgtagggatgatgcaccaaggcccggtcagcctggtcaagcaccccgtcctgctggtggagtaggagctgcccctagagcttaactcaaattctaagatcgtaggacatgttgcatcgattttgtgataatccttaattactattgttttttattttgaatctcagttgccgtaaaattattttctccctattgttgcatgaattactcaattgtcatgattttctgttttggataacaacggacaccggttatataaagtttagcgatttggggta

SEQ ID NO: 1236 - DNA, 823 bp, Cajanus cajan
gcaagtggtatcaacgcagatacggggggatctcacagcagccgcagaattcagaagagaggatcgtcaaattcttcaccatgacgttcaagcgcaggaatggcggtcgcaacaaacacggccgcggccacgtcaaattcattcgatgctccaactgcggcaaatgctgccctaaggacaaggctatcaagaggtttttggtgaggaacattgttgaacaggctgcagtcagagatgtgcaggaagcctgtgtctatgaacaatacactcttcccaaactgtatgtgaagatgcagtactgtgtttcctgtgccatccactctcatgttgtgagggttcgatcccgcactgacaggaggaagcgtgatcctccacagcgattcatcaggcgcagatgatgcaccaaggcctggtcagcctggtcaagccccacgtcctgctggagtaggagcccctgcccgtgcttaaaagcaaattctaagcttttaggccttgctgatttagtttatgttatgaacttatattccatttgctgtttattttttgaattttcagttttgtgtagggatattatattttcttattggttcgctttagtcctcggagaatacttgcatttcctattgttctaattttgtggttttttgaggtagaattgaaacttgatatatttatatatttgtgcttttgaagtacgttagttgtggcatactcaattttatccattgcactcgtcaataatgtaaaagtgtcttcccaaataggtttgtcccttgtattacctcaaaatcactagaaatatcaaacatataggggtcattga

SEQ ID NO: 1237 - DNA, 731 bp, Glycine max
ctaaatagagagtttcgttcgtcaccatgactttcaagcgcaggaatggaggtcgcaacaaacacggccgcggccacgtcaagttcattcgatgctccaactgcggcaaatgctgccctaaggacaaggctatcaagaggtttctggtgaggaacattgttgaacaggctgcagtcagagatgtgcaggaggcttgtgtctacgaacaatacacgcttccgaagctgtatgtgaagatgcagtattgtgtttcctgtgctatccactctcatgttgtgagggttcgatcccgcactgataggagaaagcgtgagcctccacagcgattcatcaggcgcagggatgatgcaccaaggcctggtcagcctggtcaagccccacgtcctgctggagtaggagctcctgcccgagcttaaaagaaaattccaagtttttggggcttgtttgttcagttttatgttgcaaacttaaattccatttgctgtttatttttgaaatttcagttttgtgtagggatattatattctcttctagttgtttgcttcagtggtcggagaaaattttctattgttatcatttgatggttttgaggagaatgtaacctgatatatgatatattttagcgttttgaagtacctcagtttgtctgtggtggtagcaagttttgatttttgatttccaaatataaattctgttctgttaaaatggaattaaattggtttttaactgta

SEQ ID NO: 1238 - DNA, 463 bp, Silene vulgaris
gatctcgccattctccgccgccgcctccttctctccaaaggaaacagaatgactttcaagcgcaggaacggtggtcgcaacaagcacggccgtggccacgtcaagttcatccgctgctccaattgcggcaaatgctgcccaaaagacaaggccatcaagagattcttggtcaggaacattgttgagcaagctgctattagagacgttcaggaggcctgcgtctatgacggatatacactgcctaagttgtatgcaaagacacagtactgtgtctcttgtgccattcactcacatgtggtgagggttcgctcccgcactgaccgcaggaaccgtgaaccaccaaagcgcttcatgagacgcagggatgatacgcccaagcctggtcagcctggtcagcctggtcaagcaccgcgtccagctgctggagttgggaatcctgtccgtgcatgaagggtcaatcaga

SEQ ID NO: 1239 - DNA, 794 bp, Humulus lupulus
gttctctcgaccccaaggagataatctgagatcttgatcaagtgtagggttcaggggcgaacatgactttcaagcgaaggaatggtggaagaaacaaacatggtcgtggccatgtgaaatttatccgctgttccaattgtggtaaatgttgccctaaggacaaggccatcaagagatttttggtgaggaacattgtcgagcaagcggcagtgagggatgttcaggaagcctgtgtctatgatggctacactcttcccaagctctacgccaagatgcagtactgtgtctcctgtgcaattcactctcacgttgtgagggttcgttccagggaaaacaggagagtccgtgagcctccacagcgtttcagacgccgggaggacactgctaggcccggtggtgcaccaggtcaggcagggcaacgcccagcaggaggagccccagctgctactcgcacttgaacaaagtgacatgcaaggctccttttcctcaagcctcttttcgttcgaggctttagttattggatgttacattaaagtcttttggtttcctaattcagttccctatgagagacttcaatattagtgtcttgtggatttttgtttcaattttgctagtgttcttgttattggttaatgaattgaaattacaatttacaagttaattcaagaaattctccgtgctcttgcatatgtttccgagtcatcaaaattactattttgtattgtttcccgtcatagtggtgtattcttttgtagttggccgaatctgtcgacaagcaatggtacttctttttc

SEQ ID NO: 1240 - DNA, 4914 bp, Theobroma cacao
aaaattaaatatctatcggcaataaataggggaacggacccgggtaaagcccgaaaccgggagtaaccctaaacggaagagaacggactctataaataaccatggactgtttcaatcttagtcaacccgcggcaaaaaccctaggagaggcagggaggcgccacggtcagattcatcgaatccgggccctaggggtctcacttcaactttcaagatgactttcaagcgaaggaatggcgggagaaacaagcacggccgtggccatgtaaagttcattcgctgctccaactgcggcaaatgctgccccaaggacaaggctatcaagaggtttttggtgaggaacattgttgagcaagctgcagttagagatgttcaggaagcttgtgtctatgaaacttacactcttcccaagctttatgcaaagatgcagtactgtgtctcatgtgcaatccactctcacgttgtgagggtcagatctcgcactaataggagaattcgtgatccaccacagcgctttagacgtcgggaggatctgccaaaagccggtgctcctggtcaggctgcacgaactgctggagcacctgctgctgctcgtacttgaagacccgccatatcctggcatgagtgtagaggcatcaatctgggggcgattgctgttcacatcccccattttgcagtttatcaaatattctctgaactctatatgaccttttaactttagaattatgtggattagtgctgtcatatgcatcaacaaactggaaacgttgatagcatagtctgaaaacctgatgaacctcattgagtttatgcagtaaatctgttattttctagtatgcatttccatgattcttttactttctgtttaaatacccctcggctgatgtgctggctcagaaaagatgattaggtgttctggtggtggccacagcagctctgaaccatcattacgatttcgtgaatcgatgccaaagccttgggtgccttgggttcttgggatgaatgacccaccgattcatagaaaaaccgtgtattctttccaccacttctcatgcaaggaaaaatgggactaatgtaaacaatttcccctccaccgccattggctgactcgtctgatctatttgcagcaagtaccagaaggcttattgtttaaattattactcgaataagaagaaaataaattgcctcccacagcatctgtcaactgccagcagttgaacaccatcaataaatgatgataataatcaattggcatacgccgaaacgatgaaagaagaaaagagaaagcaagggagacgacgacgtgcatataaagaaaaatactaaaactaggaccgctagttgagagtagagacgtcatcatcagtgtcttatacaggcaaccaagggctgtaggccggagcaattttagcaatgccccaacctctgctcaggtattttctgcaatagtttagcgtggcccattcggccagcttttcttgggttaattaaaaattgtcctgttgtgtctcgctggctttgagtcgcgtggcgtggcgtggcgttgctccagggccttggctacgtgtttgtgacttgtgagttggggagagaggaacacgaagacgaaggaaaacgcaagacaagacgcagagagagaagttggtttggcttttttagattgatttttgtccgggcaggacagggcagggtagggggtcaataaagatactaagccagttcatattggttatgattttgatcttcatcatttttctctttatctgttcgaaaacagaaaaaccccattactctgccgtttctgtttccatcatcaagccaagcgcaagcgctaacaagtaacagcaaaatttccccttcacgtgcccctacccatccattcactttctttctttattctgcttctccctctctctctcgccttcttccaccagtcatcacaacacaataaagaaatgatcttttgacaccgctaattctccagttccttaacggtgttgtttcttgcatccattgccgttgtcttgttgtccaacactttggttaatcaagaaaagaatgggtgatcttcgcgtttgttatcccaacggtgacatttcaagggaggatcgcctatgcccctcacccttcccttcgcctccgttttccttgtcgttgtcgaatcctggtcagccctgttcgattgcgagagagagttgggacagcgcagaggaaaccgctcgtcgtatagtttggagtgtacaaccaactttggacgctgacagaaagcggaaagagattgtcgagtacgttcaacgacttattcaagatggtcttgggtaccaggtcttcccatatggctcagttccgctcaagacatacttaccggatggagatattgacttaaccacgctcagcagtccagctattgaggatactttggtgtctgatgttcatgctattctcaggggcgaagagcacaatcaaaaagctccctacagagttaaggatgttcattgcattgatgctgaggttaagcttgtgaagtgccttgtgcaagatattgttgtagatatttccttcaatcagttgggagggctttgtacactgtgttttcttgaacagattgatcgtcttgttggtaaagatcatctctttaagcgcagcattatcctcataaaagcttggtgttattatgaaagtcgtatacttggtgcccatcatggcttgatttctacatatgctttagaaacactggtcctatatatatttcatctatttcactcttctttaactggccctatagcagttctctacagatttttggattacttcagcaaatttgattgggagaattattgtatcagcttaaatggaccagtttgcaaatcttccctgcctgatatagtggctgaggttcccgaaaatgtggggaataatccacttttgagcgaagaatttctgagaaagtgcatcaacatgttttctgttccatcaaagggggttgagacaaactcgcggttatttcctctgaagcatcttaatataattgatccactaaaagaaaacaacaaccttgggcgcagtgttaacagaggtaactactatagaattcgtagtgctttcaaatatggggctcacaagcttgagcagatccttattttaccaagagaaagaataccggatgagcttgttaagttttttgcaaacactttggaaaggcatggaagcaatcatttgactggcatgcaaaatcttccatcgacttctgatgctcgaggttatgaccatttagctggcatttttggggattctgaatctttaaaatcattgttggaccttactggggattatgatggccagttttggagtttgttatatggtcaatattgccatttattttctgtatctagtcctgtgtccccccatttacagaatgaaaatcattgggaaactatcgaacaatccatacccttaaaacaggatctttattctcagagggactcaaatgggattttgggatcacaattttgtttttcgaagcctcctgttgcagttcatactgctttggattcagaggataagaagaaacgaggaacaggaacatatattcccagcattaagtatcgttctaatcgggagaggcactcatctgggagaggaatctttcaggcttcaagagcctacagtcagcttcagagatatactaataataaaggctctgctactgttcaacaagagatggctttgtctcaagaaggtagccatgaactctcaccaaaggagtacccagctctgggccctgtgaagtttggaccacccaatactcatccaccttacccatccgtttggggtttatgtgctgccagtggtttaaattgcccacctgagagatttgaatccgagtcttctagccttgaattacagagcacaaacatgccagaagacaatgcattgccagatccttgcacttgtggctccacaccaagtgttatgataccagcagcacaaagtgctaagcctgttcttgaaagtaatcaagaaagtgatgcagggctgtcataccatctgaaaaatgaacatgattttccacctctgtccctctgaaggataatcagaacagaaaatgtgaagaatagaagacagaaagcattagcagtagatgctaacatctaaacctttagggagaccctttttccccattacttctttctcttgttgcctcggttgtttccaaatttcaatgttagcatgatactcgaaactgtatcttgttcttgtacattcggttcgtttacttccatgttgttggcttccattgaaggtgtacatagtgaagtaatgttcacttggatttggtttggcataggtagtaaagtccaatgggaaattttgtttggacaatttttgggaaatatagaattctgcagctgtattggtcatacaatcttggaagctgctatagagatttgagtcttaaatatgtaaaatatcgacattgtttgatattgtgaaaatagaaccatgttgatatgccaatatgtacctgtgcatacatccatgtagattttagctactactgctattaaaggtagaaaattggaaatgatgtatgctaatggcattgatgagttttacagggcatgagaggcaacagtgtctgatgtttagtggatgacagccagtgtatatgccattattttttgtggtgggtgtttgtaaaatgaaaaagtcccaaggactcaaccagtggtctagtggtaggatggtaccctgccacggtacggacccgggttcgattcccgggtggtgcaatttcgagctatgacgaatctggtgcctcttgtgatggtagggtctatcactattgtctgattcttcggatgaaattggtcacatctgagctcgttttaattataaaataagtcgtcatat

SEQ ID NO: 1241 - DNA, 791 bp, Cucurbita pepo
tcgttgcattttctctctctctgcttcgtctgaaagctctgcagctttgaaacaatgactttcaagcgcaggaacggtggacgtaacaagcacggccgtggacacgttaagttcatcaggtgctccaactgtggcaaatgctgccccaaggacaaggctattaagaggtttctcgtgaggaatattgtggagcaggctgctgttagggatgtccaagaagcctgtgtctatgaccaatacactcttcctaagctttatgcaaagatgcagtactgtgtttcctgtgccattcactcacatgttgtgagagttcgatctcgtactgatagaagaaatcggcaaccaccacagcgtttcatcagacgcagggatgatcagccaaagcctggccagccaggtcaagcacctcgtcctgctggagctggagttcctgctcgtgtatagaagaaacctttatattgcttctacgagcaatacgtaggagtctttacagtcgctctattatagttcggtcgttttctttggggatggaagtgaattttagaatgaatatggaaacttacccgagaattttgcaggtaggaaggagggaggtaaagaacaggtttattgagttagttaatggatttttctacagtttcttgtttggatactccaatttgtttcttaagtcatcatttcctgtccgtcttttctgctttaatcatatcatatggtatagggaaggggcaacgagaaagcagcatgaaaattagattaagattgttaattccatacccctttatgacatt

SEQ ID NO: 1242 - DNA, 740 bp, Malus domestica
acggccccaaaactctcagatctcctcctctcggaacgccatgactttcaagcgcagaaatggaggtcgcaacaagcacggccgcggacacgtcaagttcatccgctgctccaactgcggcaagtgctgccccaaggacaaggccatcaagagattcctggtgaggaacatcgtcgagcaagctgcggtgagggatgttcaggaagcctgtgtctatgagcaatacacgttgcctaagctgtatgccaagatgcagtactgtgtttcctgtgcaattcactcccatgttgtgagggtgcgatcccgcaccaacaggaggaaccgtgagccaccacagcgatatatcagacgcagggatgatgccccaaggcccggtcagcctggtcaagctccccgacctgctggagctggtgttcctgctcgtacttgatttgagcatatcgatcctttcgttatgtgatggacgcctcccggtatctacacgatcttctggactgagttgtgtagaacttttttgtgattctcgtgttgtggtttagacgttttggggattaaagtacaatgtttttggatgttttatttcgatgataatgcaattttagaattcgttatggttttatttcgtggtttctccactttcgttttcagataaactcttgtaatcaatttagttaaaccctaatccacagtttgaaggacacaatgtgaattttcaattgattgtttctttcgtccaccga

SEQ ID NO: 1243 - DNA, 678 bp, Phaseolus coccineus
tggccggggggtttcactctagcagccgcagcaccaagaaccctagagagcaatttgctgtcaccactcaccatgacgttcaagcgcaggaatggaggtcgcaacaagcacggtcgcggccacgtcaaattcattcgttgctccaactgcggcaaatgctgccctaaggacaaggcaatcaagaggtttcttgtgaggaacattgttgagcaggctgcagttagagatgtgcaggaggcttgtgtctatgagcaatacacgcttcccaaactgtacgtgaagatgcagtactgtgtttcctgtgctatccactctcatgttgttagggttcgatcccgcactaacaggaggaagcgtgatcctccacagcgattcatcaggcgcagggatgatgcaccaaggcctggtcagcctggtcaagcacctcgtcccgctggtgcaggagctcctgtccgaacctgagagaaaatccaaaggaaaagtccgtgttatgctgaatcaaatttataagaaattttcctttgtttcctaatttttgaaaatcagttttctggagtgtaggggtattttgttctaattatttgctttagtagttggataatatctttctggttacaacttcgtggctttttatgatagtggaacctgatatatatcatgattcagaaattttgaaaa

SEQ ID NO: 1244 - DNA, 650 bp, Cyamopsis tetragonoloba
cacgaggccctagcagaacagaggagagggtagtagttcttctgtaaccatgacattcaagcgcaggaatggaggtcgcaacaagcatggtcgcggccacgtgaaattcattcgatgctccaactgtggcaaatgctgccctaaggacaaggcaatcaagcgctttctggtgaggaacattgttgaacaggcagctgtcagagatgttcaggaggcttgtatctatgaccagtacactcttccgaagctgtatgtgaagatgcagtactgtgtttcatgtgctatccactctcatgttgtgagggttcgatcccgcactgataggaggaagcgtgaccctcctcagcgcttcatcagacgcagggatgatacaccaaggcccggacagcctggtcaagcacctcgtcctgctggtgtaggagctcctgcccgtgcctaaaagcaaatttggagattctcaatgtttcaaaacttaaattccttttgctagttgattttggaaatttcagttttgtgcagggatgttttgttttcttctgctttaatccttggaaacacctacgcatctggttgctataatttggtgcctttgatgagaatagaccttcatatatggtgaattttagcattttgaacttagtaaaaaaagg

SEQ ID NO: 1245 - DNA, 1098 bp, Vitis vinifera
ccacgcagtcctatcagaaaccctagccgagccgacgagagcaagcctcagatctagggtttagaggaggatgacgttcaagcgaaggaatggtggtcgcaacaagcacggccgcggccacgtcaagttcattcgctgctccaactgtggcaaatgctgccctaaggacaaagctattaagaggtttctggtgaggaacattgtggagcaagctgctgttcgtgatgtgcaagaagcttgtgtttatgatacttatactctccccaagttgtatgccaagatgcagtactgtgtttcttgtgcaattcattcgcatgttgttagggttcgttcccgcactgacagaaggaagcgtgatccacctcagcgctttagacgccgggatgacatgccaaaaccaggtcaagcacctcgccctgctggtgcagctgctgctcgtccctgaaaatccgcagcatgttctgctttactgccatgagcttttctgctttggttcagcaatggttcctattgcattttatccataaatgttttgactttgggacttctatttagtttttgtgtggcccagcatcattttatagcatgtaatccattgggaaaagtgacaattgaagagaaacacccgggagaatttcaaatccttttttgtgcttgggaaagaaaaaacttgttgcattcttcaatgtggccttaatccctgttctgttctctgatgctctgagatctcaatttctgtttgggttcagttgtgcaggagtcataggaacataatggtgcttggttgtgggaatgctatgaaatgggttgtgaggctggattttgtgttctggttacgaaggttcatctaggcgcccattctccagcccaacaaccccccctgcatggagggaggaatggcacccctctagctatccctgtaggtggggaactaaccattgacctactactctcaactttggccctgttaaatatgccaattgctttgtttcatcccttggcccactcctatgtctagccataggaaaatgaaaatggtttcattgtcttgtgggatgataaatattaaaaatatgtagtctcatggtagggaatggg

SEQ ID NO: 1246 - DNA, 709 bp, Vitis vinifera
agtcctatcagaaaccctagccgagccgacgagagcaagcctcagatctagggtttagaggaggatgacgttcaagcgaaggaatggtggtcgcaacaagcacggccgcggccacgtcaagttcattcgctgctccaactgtggcaaatgctgccctaaggacaaagctattaagaggtttctggtgaggaacattgtggagcaagctgctgttcgtgatgtgcaagaagcttgtgtttatgatacttatactctccccaagttgtatgccaagatgcagtactgtgtttcttgtgcaattcattcgcatgttgttagggttcgttcccgcactgacagaaggaagcgtgatccacctcagcgctttagacgccgggatgacatgccaaaaccaggtcaagcacctcgccctgctggtgcagctgctgctcgtccctgaaaatccgcagcatgttctgctttactgccatgagcttttctgctttggttcagcaatggttcctattgcattttatccataaatgttttgactttgggactactatttagtttttgtgtggcccagcatcattttatagcatgtaatccattgggaaaagtgacaattgaagagaaacacccgggagaatttcaaatccttttttgtgcttgggaaagaaaaaacttgttgcattcttcaatgtggccttaatccctgttctgttctctg

SEQ ID NO: 1247 - DNA, 646 bp, Liriodendron tulipifera
ctgagaggagaagaaaaaccctagggttagggtttggagagagagcacagctgcgatgacgttcaagcgcaggaatggcggacgcaacaagcacggccgcggccatgtcaacttcattcgctgctccaactgcggaaaatgctgccctaaggacaaggccatcaaaaggtttctcgtgaggaacattgttgagcaagctgctgtcagggatgttcaggaagcatgtgtttatgatggttacactcttcctaaattgtatgcaaagatgcaatattgtgtttcctgcgcaatccattcacatgtggtcagagttcgatctcgcactgctaggaggaatcgtgatccacctccgcgatttagacgtcgggatgatatgccaaagcccgggcaagcaccgcgtccagctggagtggcaaatccagtgcgcccatgatgagagtcatgctgctgtagtgatttctatttttctagtttgaaccttgaggctgggggtgttcacttaaaagaaagcaagcttgatttggattagtaagtttgaagaggccttttgttttaacgtttcaactatttttgctttttcttggttttggttattggcacacagtggtacagcatttatagatttctgcttttaccttaaaaaaaa

SEQ ID NO: 1248 - DNA, 637 bp, Momordica charantia
ttcagccgacgagctctctgcttctcctggtttgctcgttgttctgaaagactagagtcatgactttcaagcgcaggaatggtggacgcaacaagcatggacgcggacacgtgaaatttatccgctgctccaactgcggcaaatgctgccccaaggacaaggccatcaagaggttccttgtcaggaacatcgtggagcaggcagctgttagggatgttcaggaagcctgtgtctatgatcagtacactcttcctaagctgtatgctaagatgcagtactgcgtttcctgtgccattcactctcacgttgtgagggttcgatcacgcactgacaggaggaagcgtgatcctccacagcgcttcattagacgcagggatgacgcaccaaagcctgggcagccaggacaggcccctcgtgttggagctggaactgcaccccgtacttgaagaaactttttatatgcttttaaattttcttatggtttctcaatcatcgtggatttgaattttatttaggatttttgatatatcaaggttttgtttcaagaattgtatgctgcagctacttttgaaatctgattaatttttggttgacatgttcatctttaacattttgttgttagctatgatctaacatg

SEQ ID NO: 1249 - DNA, 647 bp, Pisum sativum
atgacatttaagcgcaggaatggtggtcgtaacaaacatggccgtggccatgtcaaattcattcgttgctcaaactgtggaaccctaatcacttctccagagggactgcggccgaacagctccaacttttcacaacaatgacatttaagcgcaggaatggtggtcgtaacaaacatggccgtggccatgtcaaattcatccgttgctcaaactgtggaaaatgctgccctaaggacaaggctatcaagcgttttcttgtgagaaacattgttgaacaggccgcagtcagagatgttcaggaagcttgtgtttatgatcaatacactcttcctaagctgtatgtcaagatgcaatactgtgtgtcttgtgccatccactctcatgttgtgagggtcagatctcgcactgacaggaggaagcgtgaccctcctcagcgtttcattaggcgcagggatgatgcaccaagacctggccaacctggtcaagctccccgccctgctggacctggagctccccccgcccgtacctagaagaacctgatctgaagcatttttatcttgttgaatcagtttgatatcatgaacctaattttgtttgcttatttttagattccagttttgtgtagccacaacatattatcacctaac

SEQ ID NO: 1250 - DNA, 716 bp, Glycine max
attgggctaatcgagtgagcctggccctagtaaaaactgttttgaaatcgggttttggtcgctattaaaacgaaggtcttcagaattcagaaaccctagatagagagtttcgttcgtcaccatgacttttaagcgcaggaatggaggtcgcaacaaacacggccgtggccacgtcaagttcattcgatgctccaactgcggcaaatgctgtcctaaggacaaggctatcaagaggtttctggtgaggaacattgttgaacaggctgcagtcagagatgttcaggaggcttgtgtctatgaacaatacacgcttccgaagctttatgtgaagatgcagtattgtgtttcctgtgctatccactctcatgttgtgagggttcgatcccgcactgataggagaaagcgtgagcctccacagcgatttatcagacgcagggatgatgcaccaaggcctggtcagcctggtcaagccccacgtcctgctggagtaggagctcctgcccgaacttaaaaaacaaattccaaagttttttggggcttgttggttcagttttatgttacaaacttatactccatttgctgtttattttttaaatttcagttttgtgtagggatattatattttcttctagttgtttgctttagtcctcggagaaaattttctattattatttgatggttttgaggagaatgaaacctgatatattattgatata

SEQ ID NO: 1251 - DNA, 647 bp, Phaseolus coccineus
tggccgggggagcagccgcagcaccgaaaccctagagaggagaggagaggagaggagagcgtgtatcttcccgctaatccaccatgacattcaagcgcaggaatggaggccgcaacaagcacggacgcggtcatgtcaaattcattcggtgctccaactgcggcaaatgctgccctaaggacaaggcaatcaagagatttttggtaaggaacattgttgagcaagctgcagttagagatgtgcaggaggcttgcgtctatgaacaatacactcttcccaaattgtatgtgaagatgcagtactgtgtttcctgtgccatccactcccacgtcgttagggttcgttcccgcactaacaggaggaagcgtgaccctcctcagcgattcatcaggcgcagggatgatgctccaaggcctggtcagcctggtcaagcacctcgtcctgctggtgcaggacctcctgtccgaacctgagagcaagtcattggaaaaaaaggcttcatgttgtgctgaatcaaatttatgagacttttatttgctctacttagttttgaaaatatcagttttgtggaaggttattttctcctattttatttgctctagtcgttggattatatatctttctggctataatatttgcttttttat

SEQ ID NO: 1252 - DNA, 685 bp, Cicer arietinum
acgcgggggaagaaacacagtacagcgtgttgaaaccctatcgcgaaatccagctcggagctcaaccatgacattcaaacgcaggaatggtggccgtaacaagcacggccgtggccatgtcaaattcatccgatgctcaaactgcggtaaatgctgccctaaggataaggcaatcaagaggtttcttgtaaggaacattgttgaacaggccgcagttagagatgttcaggaagcttgtgtctatgatcaatacacacttcctaagctgtatgtgaagatgcagtactgtgtttcatgtgctatccattctcatgttgtgagggttagatctcgcactgataggaggaagcgtgaccctcctcagcgtttcgtcaggcgcagggatgatgccccaaggcctggtcagcctggtcaagcacctcgccctgccgtagctggagctgctcctgcccgtacctgagataatttcaagatttttgatcttttatgtcccaaactcagtttcctttgcttgtttttaaatttttggtttcatgtagacacaatatattgttgctttattgctttagttcttgggcaatacttacatttttgcatctttaatattgtttctttaatgatttgaactttagcatgaatctcacaattccctatttctcttttcaattgatatggtcctacagac

SEQ ID NO: 1253 - DNA, 804 bp, Cicer arietinum
gattagcgtggtcgcggccgaggtgaagaaaccctatcctgaaaccaaactcggggctcaactatgacattcaaacgcaggaatggtggccgcaacaagcacggtcgtggccatgtcaaattcatccgatgctcaaactgcggcaaatgctgtcctaaggacaaggcaatcaagagatttcttgtaaggaacatcgttgaacaggccgcagttagagatgttcaagaagcttgcgtctatgaccaatacacccttcctaagttgtacgttaagatgcagtactgcgtatcatgtgctatccattctcacgttgtgagggttagatctcgcactgacaggaggaagcgtgaccctccacagcgtttcgttaggcgcagggatgatgcaccaaggccgggtcagcctggtcaagcacctcgccctgctgtagctggagctgctcctgtccgtgtctgaaagaaaatatcaagatttttagtcgtgttggatcagttttatgtgccaaacccggtttccttattattcaatttttggtttcatgtagacacattatactgttgctcaattgctttacttcttgcgcaatacctactttttgcattgataatattgggtgtctttaatgaaattgttatttgatgtcatgagcggaatacctactttttgcattgataatgttgggtgcctttaatgaaattgttatttaatatgtcatgaatcttagattttgaactttattatgaatctcccaatctcttgtatcctttttcatttcaatgatatgatcctttgtagttgctttct

SEQ ID NO: 1254 - DNA, 686 bp, Lotus japonicus
gcacactaaccctaatttctgaaaagagcgctcgagaggagaggaggttcttcgggaatcatgacattcaagcgcagaaatggtggccgcaacaagcacggtcgtggtcatgtgaaattcattcgatgctccaactgcggaaagtgctgccccaaggacaaggccatcaagaggttcctcgttagaaacattgttgaacaggctgcagttagggatgttcaggaagcttgtgtctatgatcaatacactcttcctaagctgtatgtgaagatgcagtactgtgtttcctgtgccatccactctcatgttgtcagggttcgttctcgcactgataggaggaagcgtgaccctcctcagcgtttcatcaggcgcagggatgatgcaccaaggcctggtcagcctggccaagctcctcgtcctgctggagttggagctcctccccgtgcttaaaagcaaatgtcaagatttctggccttcttgggatcaagtttgatcatatgaaagcttacttgtctttgttatatttaagaattttggccttgctggatcaattttaagatgttttattttcttctaattgtttgttttagtccttggtcaatagactcccttgcattttggtttgtcatatttttggtggtatgataatggacctggatatattattaattcgcctattcactttt

SEQ ID NO: 1255 - DNA, 682 bp, Lotus japonicus
agccggaaaccctaaatcctgaagagcgagcgagcgagcgagaaagcttctcaccttcaccaaccatgacattcaagcgcaggaatggtggccgcaacaagcatggtcgtggccatgtcaaattcattcgatgctccaactgcggcaaatgctgccccaaggataaggcaatcaagcgattccttgttaggaacattgttgaacaggctgctgttagagatgttcaggaagcgtgtgtctatgatcagtacacactccctaagctgtatgtgaagatgcagtactgtgtttcctgtgctatccactctcatgttgtcagggttcgttctcgcactgataggaggaagcgtgacccaccacagcgtttcatcaggcgcagggatgatgcaccaaggcccggtcagcctggtcaagctcctcgtcctgctggagtgggagctcctcctcgtgcctagaaagcaagttttaagatttttaaccttgttggatcaatttcatattatgaacttgaattccctttgctctatagatttttaaaattccagttttgtgtaggggtactatgatttcttgtagttgttacttgtgtctctggacggtagcaacatttctgttatgatttggttgttttgatgagaatgaacatttataagtcgtacctagtttgatcctttataatgaa

SEQ ID NO: 1256 - DNA, 780 bp, Cajanus cajan
tacgggggactcagcagccgcagcactgaaaaccctagagaagagcgtgcaagtcccggctacccacccaccatgacattcaagcgcaggaatggcggtcgcaacaaacacggccgcggccacgtcaaattcattcgatgctccaactgcggcaaatgctgccctaaggacaaggctatcaagaggtttttggtgaggaacattgttgaacaggctgcagtcagagatgtgcaggaagcctgtgtctatgaacaatacactcttcccaaactgtatgtgaagatgcagtactgtgtttcctgtgctatccactctcatgttgtgagggttcgatcccgcactgacaggaggaagcgtgatcctccacagcgattcatcaggcgcagatgatgcaccaaggcctggtcagcctggtcaagcacctcgtcctgctggggtaggagctcctgctcgaacctaaaagcaaatcccaagaaaagccttgttgttatgctggatcaattttataagataaacttttctttgttgtttaactttgaaaatatcagttttgtggagaggatttgttctagttatctgctttaagtctttggatgatatcttctagttataatttggcggctttaatgaaagtggaacccgatatattattattttcagcaatttgagaatgatatctccagcgtaagttttcattgataacaaaacacataaaaaaaataaaactcaaaggttactctgcgttgataccattgcttattcgaattcccgcggcagcca

SEQ ID NO: 1257 - DNA, 809 bp, Prunus persica
ctgagcagcgaaaaccctagctagcctgagccgacgaccccgaagctccagatctcgtctccctctcctagaaaatcatgactttcaagcgccggaatggtggtcgcaacaagcacggccgtggacacgtcaagttcatccgctgctctaactgcggcaagtgctgccctaaggacaaggccatcaagaggttcttggtgaggaacattgttgagcaagctgcggttagagatgtccaggaagcttgtgtctatgagcaatacaccctgccaaaattgtatgccaagatgcagtactgcgtttcctgcgcaattcactctcacgttgtgagggtgcgatctcgcaccaacaggaggaaccgtgagccaccacagcgattcatcagacgcagggatgatgccccaaggcctggtcagcctggccaaggtcctcgacctgctggtgcccctgttcctgctcgtacttgaataagcatttcaatcctttgattatgtgatcgatgtttcccagtagctacacaattttctggacttgagttttgtgtaggaagtttttgtgattcccatgctattttcatacttttttaaggataaaactaatgttatggatgttttgatttgatgataatgcaaaaccttagaatttgttattatggttttatttcatggtttctcatatcaaattggccctgactatataagcttggtttagaggcacccgaatgtagcaattttccccgttactgtggtgctcaactcccactaacgggtcttgggtcccaagaccctgtttgaactaaataattccca

SEQ ID NO: 1258 - DNA, 813 bp, Glycine max
attctgtttgctgcaatcggattcactccgcagctgcagcactcaaaaccctagagaggacgagagagcgtgcaactttcggcaaccacagaccatgacattcaagcgcaggaatggaggtcgcaacaaacacggccgcggccatgtcaaattcatccgatgctccaactgcggaaaatgctgccccaaggacaaggccatcaagaggtttttggttaggaacattgttgaacaggctgcagtcagagatgtgcaggaagcttgtgtctatgaacaatatacacttccaaaactctatgtgaagatgcagtactgtgtttcctgtgctatccactctcatgttgtgagggttcgatcccgcaccgacaggaggaagcgtgagcctccacagagattcatcaggcgcagggatgatgcaccaagacctggtcagcccggtcaaggacctcgtcctgctggcacagcagcagcacctgtccgaacctaaaagcaagtcctaaggaataagccttgattttatgctggaccaaatttataatataaacttttatttgttgcttaattttgaacatatcagttttgtggagggttatttttttcttccaatcatcagctttagtcttggatgatatctttttggttataatttggcggcttttatgaaaatggaacttggtatgtgataactttcagcaatttcgaaatgacatctcccgattatgttttcatcggaattggttttttttatgtctgttctttttaaattctattgtattgtgcttactgttttttttatcacctctatattatttg

SEQ ID NO: 1259 - DNA, 798 bp, Euonymus alatus
aaaaccctaactgcagccgcagagcgcagaagccttcgtccccttctacatcgtctctctcgaagtcgccggacaaccatgacttttaagcgcaggaacggtggccgcaacaagcacggccgtggccacgtcaagttcatccgctgctccaactgcggaaagtgctgccccaaggacaaggctatcaagaggttccttgtgaggaacattgttgaacaagcggctgttagggatattcaagaggctggagtctatgagcagtacactctacctaagctgtatgcgaaggtgcagtactgtgtttcatgtgctattcactctcatgtggtgagggtgcgttctcgcacaaacaggaggatccgtgagccaccacagcgtttcatcagacgcagagatgatctgccaaagcctggccagcctggtcagcctggccaagcacctcgtcctgctggagctggcaaccctgcccgtgcttgagatccatttagtttctggatactgtttgccttcaaataattctatgaacttcagttctgtcgtggaaaatcatattttatgttggctgaggattgtttattttgagttttgagtttgaatttgagttctgtagttgaagataagtttttacctttgaactttatgtataatggttatagtttacttttctggaagactaaagaaccctacaaaatttctagtcgttcttgtgaacccctttgagtttatagcattgatagatgctttgtgattgtgtggcatatctatctatctattcaatgatataaagagggtggattt

SEQ ID NO: 1260 - DNA, 873 bp, Malus domestica
cgaattccgttgctgtcgggcctcggcagaagaagcagctcagatccagacggcggcttagggtttcacttccctgtaggcaaatcagcaaccatgactttcaagagaagaaacggcggccggaacaagcacggccgcggccacgtgaagttcatccgctgctccaactgcggaaaatgctgccccaaggacaaagctatcaagaggtttctggtgaggaacattgttgagcaggctgcagttagggatgttcaggaggcttgtgtttacgatggttacacccttcctaagctgtatgctaagatgcaatactgcgtttcttgcgccatccactcccacgttgtgagggttcggtctcgcgagaataggaggaaccgtgagccccctcagcgtttcaggcgccgggaggatacacctaggcctggtgcgcctggtgctcctggtcagggtccacgccctgttggagctggagcgccagctcctcgtccatgaaaaggcatatcgcatcacctgcttgattgctttgaggatgtgcattgagtcttttaattttggctgctaccttgctctatttccattttatctttgaatgtttctttgacgccgttatgacttatgtgtactatcgtagtactactttagtcttatatgtcatactatcatgttatgggaagttatttgcagaatgtatcaggagattctaaaccagagatttttcatttttgtgttaattttcatccagtgttggttttcactagatttttattttcgaaaattttggtactctagattttcggctaaattgtacccatggtccttgaacgatgttatgagtttagttttggtccgtgaactctaataatagttgctctc

SEQ ID NO: 1261 - DNA, 754 bp, Prunus persica
gccgccgaagcattagcagcagaaagctcagatcgagacggcttagggttcagttctcggaaatcagtcactatgactttcaagagaagaaacggcgggagaaacaagcatggccgtggccatgtgaagttcatccgttgctctaactgtggcaaatgctgccctaaggacaaagctatcaagaggtttctggtgaggaacattgttgagcaagctgcagttagggatgtccaggaggcttgtgtttatgatgcttacactcttcctaagctgtatgcaaagatgcaatactgtgtttcttgcgccatccactctcacgttgtgagggttcgatcgcgggaaaacaggaggaaccgtgaacccccacagcgtttcaggcgtcgggaggatacacctaggcctgctgctcctggtgcacctggtcaggctccacgcccagctggagcaccagctgctcggccatgaaaagacacaacacctgctgctctattgctttgaggatgtgcattgaggctattacttttggctgctgcctttgccatatttccattttattgttgaaagcgtgtttgactctgattatgactaatgtgtagtatcttgttgagtttaatcttatatgtcatagtatcatcttgtgctaaggtaattggaaaaggtagcaggtgattcaaaacctgagtgttttttttttcaatggctgtagtatgaagtgatattcttacaagtttccatcaattttattcgtttgagc

SEQ ID NO: 1262 - DNA, 869 bp, Humulus lupulus
acatacatttcccaaccttgagagctggttttgatcttgaagtttagggttcagacatgactttcaagcgaaggaatggaggcagaaacaagcatggccgcggccatgtcaagtttattcgctgctctaactgcggcaagtgctgcccaaaggacaaggccatcaagagatttttggtgaggaacattgttgaacaagctgcagttagggatgttcaagaagcttgtgtttatgatggctacacccttcccaagctttacgccaagatgcagtactgtgtttcctgtgcaattcactctcatgttgtgagggttcgttccagggaaaacaggagaatccgtgagccaccacagcgtttcagacgtcgggaggacactgctaggcccggcggtgcaccagggcagcccggtcaacgcccagcaggaggagccccagctgctgctcgcacttaaatgaagtggcatgcaatgttcatttgcttcaaggcttttgcattgaggctttagttatcggatgctactgagtcacttaaattttttggttttctagtgcatttctctttgaggattttaatagtgtcatgtggatttttgtttatcaaaatgactatttatgtattgttttctatagttgctgaagctatcaagtagtattcatactttttttccgcaaagaaaagagaatgttaattcatatttttgttcgatagagatatcctagaaggtattatgctctaatttctaagtcatctttatcacattatgtgtgatgtgacttccctttttgccatggtggaaaatagaagagattccatgttttttcattggatttgaacatatcatagagaaaatatgtgatatatagttgca

SEQ ID NO: 1263 - DNA, 593 bp, Zostera marina
ggggattcacgaaatttgtcattcgccgtcggcagatagtaaacaagggaagacgatctcttcccacccctttctgtcttatccatcatgacgttcaagcgtaggaatggcggccgcaacaagcatggtcgcggccatgtcaatttcatccgttgttctaactgtggaaaatgttgtcccaaggacaaggctatcaagaggtttctcgtgaggaacattgttgagcaagctgccgtgcgagatgtacaggaagcatgcgtgtatgaaggttacactcttcctaagctatatgcaaagatgctgtactgtgtatcttgtgcgatccatgcccatgttgtcagggttcgttctcgtactaacaggaggaacagagatcctccacagcgtttcagacgcagggatgatacaaacaagcctggacaagtcccacctggtggagcacctcgtccagttggagttgtcaccgcgccccgtacttagaaattccatatatgagttttgtctgtttccttttccgttctcttaagacaatttagagttttttcaactctttggcttttgtatcaccaaatcataagtaattttatgtaatc

SEQ ID NO: 1264 - DNA, 1090 bp, Arabidopsis lyrata
aaatggacaggactcatttgcggttttaaagatttaggcaaactctgtttcgaagaaaaaaaggaagcattttttaatggacgcattgggtggttgcggcggcgctggtggtttctggggatggaatggcttcgaacaacggagaaagaagaagtcttccggagatagagataggaaaaggaatactggatcgtcggattccgtcgatgtgagcagagacgccggcggttatcggtttcctttgaagcaagctgtgacggccggggcactcactttcaccggtgacacgattgctcagctatctgggaggtggaaaaagagaaccgctcttaaacaatcatcttctgagcttgacgagggggaattgtggaacattttctcagaacatgactggattcgtgcgctgcggatgagctcttacgggtttcttttgtatggccctggctcttatgcgtggtaccaattccttgatcattctttgcctaaaccaaccgccacaaatctagtgcttaaggttctgcttaaccaagtgatcctcggtccatctgtgattgctgttatatttgcttggaacaacttatggctgggaaaactctctgagctcggaaacaagtatcagaaagatgctcttccaacgcttctttatggatttcgcttttgggttcccgttagcatccttaacttttgggtagtcccgcttcaagctcgtgtagcgttcatgtcaatgggttctgtgttttggaacttctacttatcttcaacaatgagcaagtagttacatatatatttgtattcttcagcctcacagagtgataatatatcattctgaaagttttcaatacaaaagtaaacttatagccaatatatggaaggctcttctgattctcactccttcagttttatttgcatagcgcaactaatgtgttactctgatcaaactcatggaacaaaactatctcctctaaaaacttaagtgtttatttttcttgagtcaactacttgcgggtgttgtggatattagttcattagtatactgtataatttaactctcagtaacagattactttaaacttttgaatcttataactta

SEQ ID NO: 1265 - DNA, 952 bp, Eutrema halophilum
aaatggccaggagaagaagactcatttgcgatttaaagatttggggaaactctgtttcgacggaaaggaatcatttttaaatggacgcattgggtggttgcggcggcgctggcggtttctggggatggaatagcttcgatcatcggaggaagaagaagtcttccggcgatagaggtaatcaacgaaagtctggatcgtcggattccgtcgatgtgagcagagacggtggctatcggtttcccttaaagcaagctgtgacggccggcgcactcacattcaccggtgacacgattgctcagttatctgggaggtggaaaaagagaaacgctcttaaacaatcatcttctgataaaccagacgaggaggaactgtggaacattttctcagaacatgactgggttcgtgcgctgcggatgagttcttacgggtttctcttgtacggccctggttcttatgcatggtatcagtaccttgaccattctttgccgaaaccaaccgcgaagaatctagtgcttaaggttctgcttaaccaagtaatcctcggtccatctgtgatcgctgttatatttgcttggaacaacttatggctgggaaagctctctgagcttggaaacaagtatcagaaagatgctcttccaacgcttctatatgggtttcgcttctgggttcccgttagcatacttaacttttgggtagtgccacttcaagctcgtgtagcattcatgtccatgggttctgtgttttggaacttctacttgtcttcaactatgagcaagtagatacacatattattcgatacggggagacgaagaagacatgaaattataagctttttttttctaaattgtaatacagtataatgttgttggaggataaacatttgttatttagatttttagttttaatttcctttttttaatgaacagatattcatgaaagattttttaaatcc

SEQ ID NO: 1266 - DNA, 930 bp, Thellungiella halophila
ggtttgcgatttaaagatttggggaaactctgtttcgacggaaaggaatcatttttaaatggacgcattgggtggttgcggcggcgctggcggtttctggggatggaatagcttcgatcatcggaggaagaagaagtcttccggcgatagaggtaatcaacgaaagtctggatcgtcggattccgtcgatgtgagcagagacggtggctatcggtttcccttaaagcaagctgtgacggccggcgcactcacattcaccggtgacacgattgctcagttatctgggaggtggaaaaagagaaacgctcttaaacaatcatcttctgataaaccagacgaggaggaactgtggaacattttctcagaacatgactgggttcgtgcgctgcggatgagttcttacgggtttctcttgtacggccctggttcttatgcatggtatcagtaccttgaccattctttgccgaaaccaaccgcgaagaatctagtgcttaaggttctgcttaaccaagtaatcctcggtccatctgtgatcgctgttatatttgcttggaacaacttatggctgggaaagctctctgagcttggaaacaagtatcagaaagatgctcttccaacgcttctatatgggtttcgcttctgggttcccgttagcatacttaacttttgggtagtgccacttcaagctcgtgtagcattcatgtccatgggttctgtgttttggaacttctacttgtcttcaactatgagcaagtagatacacatattattcgatacggggagacgaagaagacatgaaattataagctttttttttttaaattgtaatacagtataatgttgttggaggataaacatttgttatttagatttttagttttaatttcctttttttaatgaacagatattcatgaaagattttttaaatcc

SEQ ID NO: 1267 - DNA, 836 bp, Eutrema parvulum
aaatggtcaggaaaggaggactcatttgcgctttaaagattttggggaactctgttttgacgaaaaggaatcatttttgatggacgcattgggtggttgcggcggcgctggcggtttctggggatggaatggcttcaatcatggaaggaagaagaggtcttccggcgatagaggtaatcaacggaagtctggatcgtcggattccgtcgatgtgagcagagacgccggttatcggtttccgttaaagcaagctgtgacagccggcgcactcacttgcaccggtgatactattgctcagttatctgggaggtggaagaagagaaccgctcttaaacaatcatcttctgataaaccagacgaggaggaattgtggaagattttctcagaacatgactgggttcgtgcactgcggatgagtacttacgggtttctcttgtatggccctggttcttatgcatggtatcagtaccttgaccattcattgccgaaaccaaccgcgaagaatatagtgcttaaggttctgcttaaccaagtaatcctcggtccatctgtgatcgctgttatatttgcttggaacaacttatggctgggaaagctctctgagcttggaaacaagtatcagaaagatgctcttcccacgcttctatatgggtttcgcttctgggttcccgttagcatacttaacttttgggtagtcccgcttcaagctcgtgtagctttcatgtccatgggttctgtgttttggaacttctacttgtcttcaactttgagcaagtagataaaaatatttatcttcggcctcactaactgatgatatattggcatcaaatgctaaa

SEQ ID NO: 1268 - DNA, 1009 bp, Raphanus sativus
tttttgtaatggacgcattgggtggttgcggcggcgctaacggtttctggggatggaacggcttcaatcaacggaggaagaagaagaacaactcttccggcgatagacgcaatcaaaggaactctggatcttccgattccgtcgacgtgagcagagactccagtggctatcgttttccgttaaagcaagctgtgacggccggtgcgctcactttcaccggtgacacgattgctcagttgtctgggaggtggaagaagagagccgccgctcttaaacaatcgtcttctgataaaccagacgaggaggaactgtggaacattttctcagaacatgactgggttcgtgcactgaggatgagtagttatgggtttctcttgtacggtcctggttcttatgcatggtatcagtaccttgaccgttctttgccaaaaccaaccgcgaccaatattgtgcttaaggttgtgcttaaccaagtgatcctcggtccatctgtgatcgctgttatattcgcttggaacaacttgtggctgggaaagatctctgagcttggaaacaagtatcagaaagatgctcttccaacgctcctttatgggttgcgcttctgggttcctgttagcatacttaacttttgggtagtgccgcttcaagctcgtgtagctttcatgtcaatgggttctgtgttttggaacttctacttgtcttcaactttgagcaattagatagataccacaaatattcatcttcagcctcacggactgatgataatatcagagtttccaatgcttaaatggcaggtgaagcaggaactcttcaagaagccctttaaaacatctatcaagtttctcttacgtgtttctatggttttctagagaaatacagtaaaatatattgggaatcaattatctcttttgtagtaattattgcttattttgaagaaaaaatatctaaataatactgttattgaaggataattaagcatttgttagatttatgtatttttaatagatca

SEQ ID NO: 1269 - DNA, 707 bp, Eutrema halophilum
ttgctcatagttgaagacaagtagaagttccaaaacacagaacccatggacatgaatgctacacgagcttgaagtggcactaccctccataccaaaagttaagtatgctaacgggaacccagaagcgaaaccctaagcgttggaagagcatctttctgatacttgtttccaagctcagagagctttcccagccataagttgttccaagcaaatataacagcgatcacagatggaccgaggattacttggttaataaccttaagcactagattcttcgcggttggtttcggcaaagaatggtcaaggtactgataccatgcataagaaccagggccgtacaagagaaacccgtaagaactcatccgcagcgcacgaacccagtcatgttctgagaaaatgttccacagttcctcctgagacgaacctcgtctggtttatcagaagatgattgtttaagagcgtttctctttttccacctcccagataactgagcaatcgtgtcaccggtgaatgtgagtgcgccggccgtcacagcttgctttaagggaaaccgatagccaccgtctctgctcacatcgacggaatccgacgatccagactttcgttgattacctctatcgccggaagacttcttcttcctccgatgatcgaagctattccatccccagaaaccgccagcgccgccgcaaccacccaatgcgtccatt

SEQ ID NO: 1270 - DNA, 925 bp, Brassica napus
aatcattttgtaatggacgcattgggtggtttctggggattgaacggtttcaatcatcggaggaagaagaacaactcttccggcgataggcgcaatcagcggaagtccggatcgtctgattccgtcgacgtgagcagagacgccgccggttatcagtttccgttaaagcaagctgtgacggccggcgcgctcactttcacaggtgacacgatcgctcaattatcagggaggtggaagaagagagccgccgctcttaagcaatcgtcttctgataaaccagaccaggaggaactgtggaaccttttctcagaacatgattgggttcgtgcactacggatgagtacttacgggtttctcttatacggccctggttcttatgcatggtatcagtaccttgaccgttctttgccgaaaccaaccgcgacgaacatagtgcttaaagttctgcttaaccaagtgatcctcggtccatctgtgatcgctgttatatttgcttggaacaacttgtggctgggaaagatctctgagcttggaaacaagtatcagaaagatgctcttccaacgctcctttacgggtttcgcttctgggttcctgttagcatacttaacttctgggtagtaccgcttcaagctcgtgtagctttcatgtcaatgggttctgtgttttggaacttctacttgtcttcaactttgagcaactagtaacacaaatattcatcttcagcctcactgactgatgatagtatcaaagtgaagcaggaactcttcaaaaagctgttcaaaacctctatcaagtttcttacgctttctatggtttttctagagaaattaatacagtaaaaaaattatattgggaaggaattatctctttgcggtaattatagcatttgttattgaaggataataaagcatttgttagatttat

SEQ ID NO: 1271 - DNA, 860 bp, Brassica napus
ggaatcattttgtaatggacgcattgggtggtttctggggattgaacggcttcaatcatcggaggaagaagaacaactcttccggcgataggcgcaatcagcggaagtccggatcgtctgattccgtcgacgtgagcagagacgccgccggttatcagtttccgttaaagcaagctgttacggccggcgcgctcactttcaccggtgacacaatcgctcaattatcagggaggtggaagaagagagccgccgctcttaagcaatcatcgtcttctgataaaccagaccaggaggaactgtggaaccttttctcagaacatgattgggttcgtgcactacggatgagtacttacgggtttctcttgtacggccctggttcttatgcatggtatcagtaccttgaccgttctttgccgaaaccaaccgcgacgaacatagtgcttaaagttctgcttaaccaagtgatcctcggtccatctgtgatcgctgttatattcgcttggaacaacttgtggctgggaaaaatctctgagcttggaaacaagtatcagaaagatgctcttccaacgctcctttacgggtttcgcttctgggttcctgttagcatacttaacttctgggtagtaccgcttcaagctcgtgtagctttcatgtcaatgggttctgtgttttggaacttctacttgtcttcaactttgagcaactagtaacacaaatattcatcttcagcctcactgactgatgatagtatcaaagtgaagcaggaactcttcaaaaagctgttcaaaacctctatcaagtttcttacgctttctatggtttttctagagaaattaatacagtaaaaaaaattatattgg

SEQ ID NO: 1272 - DNA, 959 bp, Brassica oleracea
aaaaggaatcattttgtaatggacgcattgggtggtttctggggattgaacggcttcaatcatcggaggaagaagaacaactcttccggcgataggcgcaatcagcggaagtccggatcgtctgattccgtcgacgtgagcagagacgccgccggttatcagtttccgttaaagcaagctgtgacggccggcgcgctcactttcaccggtgacacgatcgctcagttatcagggaggtggaagaagagagccgccgctcttaagcaatcgtcttctggtaaaccagaccaggaggaactgtggaaccttttctcagaacatgattgggttcgtgcactacggatgagtacttacgggtttctcttgtacggccctggttcttatgcatggtatcagtaccttgaccgttctttgccgaaaccaaccgcgacgaacatagtgcttaaagttctgcttaaccaagtgatcctcggtccatctgtgatcgctgttatattcgcttggaacaacttgtggctgggaaaaatctctgagcttggaaacaagtatcagaaagatgctcttccaacgctcctttacgggtttcgcttctgggttcctgttagcatacttaacttctgggtagtaccgcttcaagctcgtgtagctttcatgtcaatgggttctgtgttttggaacttctacttgtcttcaactttgagcaactagtaacacaaatattcatcttcagcctcactgactgatgatagtatcaaagtgaagcaggaactcttcaaaaagctgttcaaaacctctatcaagtttcttacgctttctatggtttttctagagaaattaatacagtaaaaaaaattatattgggaaggaattatctctttgcggtaattatagcatttgttattgaaggataattaagcatttgttagatttatgtatttttaatagatcagatatacatt

SEQ ID NO: 1273 - DNA, 1007 bp, Brassica rapa
  misc_feature (16)..(16): n is a, c, g, or t
  misc_feature (34)..(34): n is a, c, g, or t
  misc_feature (36)..(36): n is a, c, g, or t
ggttggcctactgggntttcaaaacgaaaagggnancaatcattttgtaatggacgcattgggtggtttctggggattgaacggcttcaatcaccggaggaagaagaacaactcttccggcgataggcgcaatcagcggaagtccggatcgtctgattccgtcgacgtgagcagagacgccgccggttatcagtttccgttaaagcaagctgtgacggccggcgcgctcactttcaccggtgacacgatcgctcagttatcagggaggtggaagaagagagccgccgctcttaagcaatcgtcttctgataaaccagaccaggaggaactgtggaaccttttctcagaacatgattgggttcgtgcactacggatgagtacttacgggtttctcttgtacggtcctggttcttatgcatggtatcaataccttgaccgttctttgccaaaaccaaccgcgaccaatatagtgcttaaggttctgcttaaccaagtgatccttggtccatctgtgatcgctgttatatttgcttggaacaacttgtggctgggaaaaatctctgagcttggaaacaagtatcagaaagatgctcttccaacgctcctttatggctttcgcttctgggttcctgttagcatacttaacttttgggtagtaccgcttcaagctcgtgtagcgttcatgtcaatgggttctgtgttctggaacttctacttgtcttcaactttgagcaagtagatgcacagagatttatcttcagcctcactgactgatgataatatcaaagcttccaatgctaaagtgaagcaggaactcgtcaagaagccctttaaaacctctatcaaatttgtctcgttttctatggttttctagagaaatacagtaaaaatatattgggaagaaattatctcttttgtagtaattattgcttattttaaaaaaaaatctaaataatattgttattgaagaataattaagcatttgttggatttatgtatttttaata

SEQ ID NO: 1274 - DNA, 752 bp, Arabidopsis lyrata
ctaattccccgagagtaaccaacaaaaagcgatcaaagaacttttcccgttagagagagagacgaagaagaagaagaagaaaagttacgcagagagactgaacgaagagtgatcgatcggagaaagatggcgatggaagtagcaacaccggctccggcaccaatcccatcggagaggaacatcgttctcgcccctgcaacaacaacaaccaccgccactgtcgagactcacaagaagaacaggatccaagtctccaacaccaagaaaccattgttcttctacgttaacctcgccaagaggtacattcagcaacacaacgaggtcgagctttctgcacttggaatggcaatcactactgtggtaacaatctctgagatcttgaagaacaatggacttgcaacagagaagaaggtgctaacatcgactgtgggaatgaaagatgagaccaaaggccggatggttcagaaggcaaagattgagatagtgttgggcaagtcagacaagtttgactctttggtgccaccagttactaacggcaagaccccggaggaggaagctagtgcagagacagaggcttctgtggaagcacaagaaaacgttgccgcagccaccgaggtctaggttggagctggctgagagatatactacagaagaaggagtgatttctcttttactatgttttgttggtttttgtttcgtttgtgacatatcgaacataatactctagatatgatagtaattgtttgtttagc

SEQ ID NO: 1275 - DNA, 793 bp, Eutrema parvulum
ctaattccccgagtaaccaaccgaatcgagtcagagagaacttttcccgctagcgagacagagagagagagagagaaagtcttcgagagagaagaagagaactttacgcagagagtcaaagaagaaagagtgatcgaagatggcgatggaagtagctacaccggctccggcaccgatcccagcaccggagagaaacatcgtcctcgcgccggcagtgacggccgctgttgagactcacaagaagaacaggattcaagtctccaatacgaagaaaccattgttcttctacgttaatctcgccaagaggtacatccagcaacacaacgaggtcgaactctctgcgcttggaatggcaatcacaactgtggtaacaatctctgagatcctcaagaacaatggtttggctacagagaagaaagtgttgacatcaactgtgggaatgaaagacgagaccaaaggaaggatggtgcagaaggctaagattgagattgtgttgggcaagtcagacaagtttgactccttggtgccaccagtgactaacggaaaaacgccggaggaggaagccaatgcagagacagaggcggctgttgaagcacaagaagaagctgcagctacagaggcctaggatggagccggttgagaaacaccacagaagaaagatggatgtcgtctcttttactatgttttgttgttttgtttttgcttcgttatgtgacataagcgaacataatacgctagatatatgatagtagttgtttgtgtaggatgatacctatctagtattctcctttct

SEQ ID NO: 1276 - DNA, 757 bp, Eutrema halophilum
ctaattccccgagtaaccaaccaaagcgatcagatacaacttttcccgcgagcgagagagaaagtcttcgagagagagagagagagaagaaaaaagttacgcagagactgaaagaaaagagtgatcgaagatggcgatggaagtagctacaccggcaccggcaccgatcccagcaccggagagaaacatcgttctcgcgccggcaacgacggccattgctgagactcacaagaagaacaggatccaagtctccaacacgaagaagccattgttcttctacgtcaatctcgccaagaggtacattcagcaacacaacgaggtcgaactctctgcacttggaatggcaatcacaactgtggtaacaatctctgagatcttgaagaacaatggtttggctacagagaagaaagtgttgacatctactgtgggaatgaaagacgagaccaaaggaaggatggttcagaaggctaagattgagattgtgttgggcaagtcagacaagttcgactctttggtgccacctgtgaccaacggcaaaactccggaggaggaagctaatgcagacacggaggcggctgttgaagcacaagaagaagctgcagccaccgaggcctaggatttgagccggttgtaaaacaccacagaaggaagatccatctctcttttactatgttttgttgtttttgtttcatttgtgacatatcgaacataatactctagatattgtttgtttagtaatatacctctctagtattct

SEQ ID NO: 1277 - DNA, 747 bp, Brassica napus
acccacgcgtccgaaaccaaccgaaacgatcacagagaacgtttcccgccagcgagagataagagtgaaagaagaaatagtgatggcgatggaagtagcgacaccggctccggcaccgatcaccgcaccggagagaaacatcatcctcgcgccggcgactgttgagactcacaagaagaacaggatccaagtctccaacacgaagaaacctttgttcttctacgttaatctcgccaagaggtacatgcagcaacacaatgaggtcgaactctctgcgcttggaatggcaatcacaactgtggtgacaatctctgagatcctgaagaataatggattggctacagagaagaaagtgttgacatctaccgtgggaatgaaagacgagactaaaggaaggatggttcagaaagcaaagattgagattgtgttgggcaaatcagacaagtttgactctttggtgccacctgtgaccaacggcaaaacgccggaggaggtagctaaagcagagacggaggctgctgttgaagtacaagaagctgcagccacagaggcctaggacggagctggctcagaaacaccacatatgaaagatcaattttcgcttttgttttgctttgctttgctttgttgtttttgtttcttttgtgacatatcgaacataatactcaatagatatgatagtagtttgtttaggaaatactactctagtattctttgtttgaggaatatatttttctcccaaacatt

SEQ ID NO: 1278 - DNA, 730 bp, Brassica napus
caaccgaaacgatcacagagaacgtttcccgccagcgagagataagagtgaaagaagaaatagtgatggcgatggaagtagcgacaccggctccggcaccgatcaccgcaccggagagaaacatcatcctcgcgccggcgactgttgagactcacaagaagaacaggatccaagtctccaacacgaagaaacctttgttcttctacgttaatctcgccaagaggtacatgcagcaacacaatgaggtcgaactctctgcgcttggaatggcaatcacaactgtggtgacaatctctgagatcctgaagaataatggattggctacagagaagaaagtgttgacatctaccgtgggaatgaaagacgagactaaaggaaggatggttcagaaagcaaagattgagattgtgttgggcaaatcagacaagtttgactctttggtgccacctgtgaccaacggcaaaacgccggaggaggtagctaaagcagagacggaggctgctgttgaagtacaagaagctgcagccacagaggcctaggacggagctggctcagaaacaccacatatgaaagatcaattttcgcttttgttttgctttgctttgctttgttgtttttgtttcttttgtgacatatcgaacataatactcaatagatatgatagtagtttgtttaggaaatactactctagtattctttgtttgaggaatatatttttctcccaaacatt

SEQ ID NO: 1279 - DNA, 768 bp, Brassica napus
aatttcgccgagtaaaccaaccgaagcgatcagagagaactttttcccgccagcgatagtgaaagaagaaagagcgatcgaagaagatggcgatggaagtagcgacaccggctccggcacccatcaacgcaccggagagaaacatcatcctcgcgccggcgactgttgagactcacaagaagaacaggatccaagtctccaacacgaagaaaccgttgttcttctacgttaatctcgccaagaggtacatgcagcaacacaatgaggtcgaactctctgcgcttggaatggcaatcacaactgtggtgacaatctctgagatcttgaagaacaatggattggctacagagaagaaagtgttgacatcgactgtgggaatgaaagacgagactaaaggaaggatggttcagaaggcaaagattgagattgtgttgggcaaatcagacaagtttgactctttggtaccacctgtgaccaacggcaaaacgccggaggaggtagctaaagcagagacggaggctgctgttgaagtacaagaagctgcagccaccgaggcctaggacggagctgcttcagaaacaccacatatgaaagatcgattttcgcttttgttttgctttgctttgttgtttttgtttcttttgtgacatatcgaacataatactcaatagacatgctagtagtttgtttaggaaaatactactctagtattttttgtttgagaaatatatttttctcccaaacatttcaatgatatattttctcatt

SEQ ID NO: 1280 - DNA, 658 bp, Brassica napus
agtgaaagaagaagatggcgatggaagtagcaacaccggcttttgcaccgatcacatcaccggagataaacatcgtcctcgctgcgacggcgaagaaggcttccgttgagactcacaagaagaacaggatccaagtctccaacacgaagaaacctttgttcttctacgttaatctcgccaagaggtacattcagcaacacaacgaggtcgagctctctgcgcttggaatggcaataactaccgtggtaacaatctctgagatcttgaagaacaatggattggctacagagaagaaagtgttgacatcgacagtgggaatgaaagacgagactaaaggaaagatggttcagaaggcaaagattgagattgtgttgggaaagtcagccaagtttgactctttggtgccgcctgtgaccaacgacaagactcctgaggaggtagccaaagcagagacggaggcggctgttgaagtacaagaagctgcagccaccgaggcataagactgatctggctcagaaacacaagaaagatcgttccatctttttaatgttttgttgtttttgtttcacttgtgacatatcgaacataatactctagatatgtaaataataagtacattgatggtttaactgtgtttcgtgacaagcagtcatacaga

SEQ ID NO: 1281 - DNA, 662 bp, Brassica napus
gtgaaagaagaagatggcgatggaagtagcaacaccggcttttgcaccgatcacatcaccggagataaacatcgtcctcgctgcgacggcgaagaaggcttccgttgagactcacaagaagaacaggatccaagtctccaacacgaagaaacctttgttcttctacgttaatctcgccaagaggtacattcagcaacacaacgaggtcgagctctctgcgcttggaatggcaataactaccgtggtaacaatctctgagatcttgaagaacaatggattggctacagagaagaaagtgttgacatcgacagtgggaatgaaagacgagactaaaggaaagatggttcagaaggcaaagattgagattgtgttgggaaagtcagccaagtttgactctttggtgccgcctgtgaccaacgacaagactcctgaggaggtagccaaagcagagacggaggcggctgttgaagtacaagaagctgcagccaccgaggcataagactgatctggctcagaaacacaagaaagatcgttccatctttttaatgttttgttgtttttggttcacttgtgacatatcgaacataatactctagatatgtaaataataagtacattgatggtttaactgtgtttcgtgacaagcagtcatacagataaaa

SEQ ID NO: 1282 - DNA, 563 bp, Brassica juncea
ccccgagtaacgaaccaaaacgatcagagagaacgtttcccgcgaagagagtgatcgaagaaagaagatggcgatggaagtagcaacaccggctccggcaccgctcacggcaccggagagaaacatcgttctcgtgccgtcagtgaaggccaccgccgagagtcacaagaagaacaggatccaagtctccaacacgaagaaaccattgttcttctacgttaatctcgccaagaggtacatgcagcaacacaatgaggtcgaactctctgcacttggaatggcaatcacaactgtggtaacaatctctgagatcttgaagaacaatggattggctacagagaagaaagtgttgacatcgactgtgggaatgaaagacgagactaaaggaaggatggttcagaaggcaaagattgagattgtgttgggcaaatcagacaagtttgactctttggtaccacctgtgaccaacggcaaaacgccggaggaggtagctaaagcagagacggaggctgctgttgaagtacaagaagctgcagccaccgaggcctaggacggagctgctt

SEQ ID NO: 1283 - DNA, 745 bp, Brassica napus
gctagataaagagaggagagaagagaagagaagtgaaagaaagaaagcgagtgaaagaagaagatggcgatggaagtagcgacaccggcttttgcaccgatcacatcaccggagataaacatcgtcctcgctgcggcggcgccggcggcgaagaaggcttccgttgagactcacaagaagaacaggatccaagtctccaacacgaagaaacctttgttcttctacgttaatctcgccaagaggtacattcagcaacacaacgaggtcgagctctctgcgcttggaatggcaataactaccgtggtaacaatctctgagatcttgaagaacaatggattggcgacagagaagaaagtgttgacatcgacagtgggattgagagacgagactaaaggaaagatggttcagaaggcaaagattgagattgtgttggggaaatcagccaagtttgactctttggtgccacctgtgaccaacggcaagactcctgaggaggtagccaaagcagagacggaggcggctgttgaagtacaagaagctgcagccaccgaggcttaggaaggatctggctcagaaagaacaatatcttttctttaacatgctttgttgtttgtttcatttgtgacatatcgaacataagactctagatatgtatataataagtaaaatgaaggatggaactgtgtttcgtgacaagcagtcatacagacggcaacgatatatattacaaaaaaattagttatga

SEQ ID NO: 1284 - DNA, 750 bp, Raphanus sativus
ggattttctaatattcccgctatcaaagagaagtttaacgcagagatagagaagaaactgaaagaacgagagtgatccaagaagaagatggcgatgcaaatagcgacaccggcccctgcaccgatcacagcaccggagataaacatcatcctcacgccagcaaagacggagactcacaagaagaacaggattcaagtctccaacacgaagaagccactgttcttctacgttaatctcgccaagaggtacattcagcaacacaatgaggttgaactctctgcactcggaatggcaattacgacggttgtaacaatctctgagatcttgaagaacaatggattggctacagagaagaaagtgttgacatccactgtgggaatgaaggatgagacgaaaggaaagatggttcagaaagcaaagattgagattgtgttggggaaatcagacaagttcgactctctggtgccacctgtgaccaatggcaagacccctgaagaagtagctaaagcagagaccgaggcggctgttgaagtacaagaagctgcagccacccaagtctaggactgatcctgctaacccacataacaatgctcgttccatatttttttttaaatatgtttgttgtttttgtttcagttgtgacaattcgaacataatactactctagatatgtaatataataagtaaaatgatggttgacaacgatatcatttgtttttggaacaaataaacagtttgtgcaaaaaaaaa

SEQ ID NO: 1285 - DNA, 711 bp, Brassica napus
gagtaacgaaccaaaacgatcagagagaacgtttcccgcgaagagagtgatcgaagaaagaagatggcgatggaagtagcaacaccggctccggcaccgctcacggcaccggagagaaacatcgttctcgtgccgtcagtgaaggccaccgccgagagtcacaagaagaacaggatccaagtctccaacacgaagaaaccattgttcttctacgttaatctcgccaagaggtacatgcagcaacacaacgaggtcgaactctctgcacttggaatggcgatcacaactgttgtaacgatctctgagatcttgaagaacaatggattagctatagagaagaaagtgttgacatcgactgtgggaatgaaagacgagactaaaggaaggatggttcagaaggcaaagattgagattgtgttgggcaaatcagacaagtttgactctttggtgccacctgtgaccaacggcaaaacccccgaggaggtagctaaagctgagaccgacgcggctattgaagcacaagaagaagctgcagccaccgaggcctaggacggagcctgtctcagaaacacaccacacacagagaaagatcgcgatatcactcttttattgtgcattgttgtttttgtttcattttgtgtgacatatcgaacgaacataatactctagatatgatagtagttgttactacgagaaatatatgaatttttt

SEQ ID NO: 1286 - DNA, 727 bp, Brassica napus
aacgatcagagagaacgtttcccgcgaagagagtgatcgaagaaagaagatggcgatggaagtagcaacaccggctccggcaccgctcacggcaccggagagaaacatcgttctcgtgccgtcagtgaaggccaccgccgagagtcacaagaagaacaggatccaagtctccaacacgaagaaaccattgttcttctacgttaatctcgccaagaggtacatgcagcaacacaacgaggtcgaactctctgcacttggaatggcgatcacaactgttgtaacgatctctgagatcttgaagaacaatggattagctatagagaagaaagtgttgacatcgactgtgggaatgaaagacgagactaaaggaaggatggttcagaaggcaaagattgagattgtgttgggcaaatcagacaagtttgactctttggtgccacctgtgaccaacggcaaaacccccgaggaggtagctaaagctgagaccgacgcggctattgaagcacaagaagaagctgcagccaccgaggcctaggacggagcctgtctcagaaacacaccacacacagagaaagatcgcgatatcactcttttattgtgcattgttgtttttgtttcattttgtgtgacatatcgaacgaacataatactctagatatgatagtagttgttactacgagaaatatatgaattttttctcaaaactatccagtgattggattctttt

SEQ ID NO: 1287 - DNA, 681 bp, Brassica napus
tggcgatggaagtagcgacaccggcttttgcaccgatcacatcaccggagataaacatcgtcctcgctgcggcggcgccggcggcgaagaaggcttccgttgagactcacaagaagaacaggatccaagtctccaacacgaagaaacctttgttcttctacgttaatctcgccaagaggtacattcagcaacacaacgaggtcgagctctctgcgcttggaatggcaataactaccgtggtaacaatctctgagatcttgaagaacaatggattggcgacagagaagaaagtgttgacatcgacagtgggattgagagacgagactaaaggaaagatggttcagaaggcaaagattgagattgtgttggggaaatcagccaagtttgactctttggtgccacctgtgaccaacggcaagactcctgaggaggtagccaaagcagagacggaggcggctgttgaagtacaagaagctgcagccaccgaggcttaggaaggatctggctcagaaagaacaatatcttttctttaacatgctttgttgtttgtttcatttgtgacatatcgaacataagactctagatatgtatataataagtaaaatgaaggatggaactgtgtttcgtgacaagcagtcatacagacggcaacgatatatattacaaaaaaattagttatga

SEQ ID NO: 1288 - DNA, 760 bp, Raphanus sativus
  misc_feature (751)..(751): n is a, c, g, or t
ggaattcccggagtaacgaaccagagcgatcagagagaacttttcccctccgcaaacgagtgaaagaagaaagagtgattcgaagaacgatggcgatggaagtagcaacaccggctccggcaccgctcacagcaccggagagaaacatcatcctcgcgccgtcggcgaaggcaacaaccaccgtcgagactcacaagaagaacaggatccaagtctccaacacgaagaaaccattgttcttctacgttaatctcgccaagaggtacatgcaacaacacaacgaggtcgaactctctgcacttggaatggcaatcacaactgttgtaacaatctctgagatcttgaagaacaatggattagctatagagaagaaagttttgacatcgactgtgggagtgaaagacgagtctaaaggacggatggttcacaaggcaaagattgagattgtgttgggcaaatcagacaagtttgactctttggtgccacctgtgaccaacggcaaaacccccgaggaggcagctaaagctgagaccgacgccgttattgaagcacaataagctgcagccacctaggcctaggacggagcctttctcagaaacaccacagagaaagatcgatatcacttttattgtgcattgtttttttttcttcattttgtgtgacatatcaaacataatactctagattgatagtagtttgttaatatgagaaatacatgattttcttttctcaaacatttcaatgatttgantcttttcca

SEQ ID NO: 1289 - DNA, 1761 bp, Arabidopsis lyrata
taactttgaggttgaaaaacaatctcatgagtctcttagacttttcctcgagaaaccagagacgaaaggtttccatcaaaacatcaaggaacgtctcttcttctctgttttcttatgtcaagattagaaccaataactgaaagataatatatttttggtcaagaagaggaaatgggaagagcatgtttaccgagatggcgattaggaagactaatggcaggattacaagtaatcttgggattactggtgatcactgtgagcctctcatgtctcttccgattccattccgctggttacttcttgcacaacgaagacgtttgcaacaatatctacacaatcaaagaagtcagcaacgaaggattcgacataaaggcgctacatgatcgcgttgatgaagtactagaaaagatggacaacttgtacgagaagcttgagaagacggtaaaagagatggagaagagcaaagacggaagcaaaaaggagatgaagaagtttcttgaagatgaagtgatgaagccattttattatgctcatatcggattaaggcaaatccggttaccaaaacccgaaggaatcagaaactcgacggaaaaggaagagcctttgatcaataagtttctcattgaggagataaggcagtacattacacccaaggagaatcgggttgggaagataaacatgtttggaacagagagagtttacaacactattggtcatgcttgtgcgttgatgaagatagagctagagaagtatatggattatgacgttggagcgtattgcgatgatgattggaacttagcacagaagctgatgcttaacgggtgtgatccattacctagaagacgatgcttgacaagagcatcgatgacttaccagaaaccttatccgatcaacgagtctttgtggaagcttcctgatgatagaaatgtaagatggggaaattaccaatgcaggaatttcgcgtgtttatcaagcaagaacccgaaaaggggttacacgaaatgcagtggttgttttgaaatggagaaagagggtgataaatgggtcaagaacagtactttgttagttgacttcatgattgaggatgttctgagagtgaagccaggtgagattaggcttggactggattatggtgttgggacagggacatttgcagcaagaatgagagagaagaatgtgactattgtcacaactgctttgaatttgggagctcctttcaatgagatgattgctttgagaggtttgatcccattgtacttatctttgaaccagaggctaccgttcttcgataacacaatggatatgattcacactgccgggttaatggatggttggatcgatcttcttctgatggatttcgtgttatatgattgggaccgagtgctgagaccgggtgggttactgtggattgatagattcttctgtaaaaagaaggatcttgatgattatatgtacatgttcctgcaatttcggtacaagaaacacaagtgggctgtttcacctaaatcaaaggatgaggtttatctctctgcattgctcgagaaacctcctcgtgcaatttaaggattacattattaagtttaagcttcaatgtttgtaattgacattcttactcatttgattggctaatccttgtcttagtttgaatacaacagagattttcagctctgtttcacttgataacttaatcgagactatttgtatcaattcgaaacattgaaagtggccaaaaaggcattttagcgattgctgaacgacatt

SEQ ID NO: 1290 - DNA, 1408 bp, Eutrema halophilum
aatggggagatcatgtttgccgagatggcgattaggaagagtaatggcaggattacaagtaatcttagggttactagtgatcactgtgagcctatcatgtctctatagattccattcttctggctacttcttgcataacgaagacatttgccgcaatatctacacaatcaaagacgtcaaccaccaaggattcgacctaaaggcactgcacgatcgcgttggtgaagtcctcgaaaagatggataacttgtacgagaagctagagaagacggttaaagagatggagaagagcaaagacggaagcaaaaaagagatgaagaagtttcttgaagacgaagtgatgaagccattttactctgctcatatcggtttaaggcaaatccggttaccaaaacccgaaggaatcagaaactcaacggaaaaggaagagcctttgatcaacaagtttctcattgaggagataaagcaatatattaccccaaaggagaatcgagttgggaagataaacatgtttggaacagagagagtttacaacacaataggtcatgcttgtgtgttgatgaagatggagctagaaaagtacatggattatgatgttggagcgtattgtgatgatgattggaatttagcacagaggcttatagtaaatgggtgtgacccgttgcctagaagacgatgcttaacaagagcatccatgacttaccagaaaccttatccgatcaacgagtcattatggaagcttcctgatgatagaaatgtaaggtggggaaattaccagtgcaggaatttcgcttgcttgtcaagtaagaaccctaaaaggggatacacgaaatgcagcggatgttttgaaatggagaaagagattggtaaatgggtcaagaacagttctttgttggttgatttcacgattgatgatgttttgagagtgaagcaaggtgagattaggattggattggattatggtgttgggacaggaacatttgcagcaagaatgagagaaaagaatgcgacttttgtcacaactgctttgaatttaggagcccctttcaacgagatgattgcgttgcgaggattgatcccgttgtacatctctgtgaaccagaggctgcctttcttcgacaatactatggatatgattcatactgctgggttaatggatggttggatagatcttcttctgatggatttcgtgttatatgattgggatcgagtgctgagaccgggtgggttactgtggattgatagatttttctgcaaaaagaaggatcttgatgactatatgtacatgttcctgcagtttaggtacaagaaacacaagtgggctatttcacctaagtccaaggatgaggtttatctctctgcattgcttgagaaaccacctcgtgcaatttaaagaagacaatacaaa

SEQ ID NO: 1291 - DNA, 1725 bp, Eutrema halophilum
taactttgaggttgaaaaacaaactcatgaaatctcttctacttttcttggagaaaccagagtggaaaggtttccatcaaaacatcgaggaatatctctatttactctgttttctcaggtcaggattagaaccattcaattaaagaaatttagtattagaagaagaagaagtaatggggagatcatgtttgccgagatggcgattaggaagagtaatggcaggattacaagtaatcttagggttactagtgatcactgtgagcctatcatgtctctatagattccattcttctggctacttcttgcataacgaagacatttgccgcaatatctacacaatcaaagacgtcaaccaccaaggattcgacctaaaggcactgcacgatcgcgttggtgaagtcctcgaaaagatggataacttgtacgagaagctagagaagacggttaaagagatggagaagagcaaagacggaagcaaaaaagagatgaagaagtttcttgaagacgaagtgatgaagccattttactctgctcatatcggtttaaggcaaatccggttaccaaaacccgaaggaatcagaaactcaacggaaaaggaagagcctttgatcaacaagtttctcattgaggagataaagcaatatattaccccaaaggagaatcgagttgggaagataaacatgtttggaacagagagagtttacaacacaataggtcatgcttgtgtgttgatgaagatggagctagaaaagtacatggattatgatgttggagcgtattgtgatgatgattggaatttagcacagaggcttatagtaaatgggtgtgacccgttgcctagaagacgatgcttaacaagagcatccatgacttaccagaaaccttatccgatcaacgagtcattatggaagcttcctgatgatagaaatgtaaggtggggaaattaccagtgcaggaatttcgcttgcttgtcaagtaagaaccctaaaaggggatacacgaaatgcagcggatgttttgaaatggagaaagagattggtaaatgggtcaagaacagttctttgttggttgatttcacgattgatgatgttttgagagtgaagcaaggtgagattaggattggattggattatggtgttgggacaggaacatttgcagcaagaatgagagaaaagaatgcgacttttgtcacaactgctttgaatttaggagcccctttcaacgagatgattgcgttgcgaggattgatcccgttgtacatctctgtgaaccagaggctgcctttcttcgacaatactatggatatgattcatactgctgggttaatggatggttggatagatcttcttctgatggatttcgtgttatatgattgggatcgagtgctgagaccgggtgggttactgtggattgatagatttttctgcaaaaagaaggatcttgatgactatatgtacatgttcctgcagtttaggtacaagaaacacaagtgggctatttcacctaagtccaaggatgaggtttatctctctgcattgcttgagaaaccacctcgtgcaatttaaagaagacaatacaaaagtttgagcttatacatttgtatcagacattcttactcatttggttgtctaatatttgttttaactagaaaacaattagagattttccagctctgtttcactttattatagttgaggattttcagctcgataactaaattcaagg

SEQ ID NO: 1292 - DNA, 1408 bp, Eutrema parvulum
aatggggagatcatgtttgccgaaatgccgattaggaagactaatggcaggattacaagttgtcttcgggttactactgatcactgtgagcctatcatgtctctatagattccattctgcgggttacttcttgcacaacgaagacacttgccgcaatatctacagaatcaaagaagtcaacagcgaaggatttgacttaaaggcgctgcgtgatcgcgttgatgaagtccttcaaaagatggataacttgtatgagaagctagacaagacggtaaaagaaatggagaagagcaaagacggaagcaaaaaagagatcaagaaatttcttgaagatgaagtgatgaagccattttactatgctcatatcggtttaaggcaaatccgtttaccaaaccccgaaggaatcagaaactcgacggaaaaggaagagcctttgatcaacaagtttctcattgaggagataaggaagtacattacccccaaggagaatcgggtcgggaagataaacatgtttggaacagagagagtttacaacacaataggtcatgcatgtgtgttgatgaagatggagctagagaagtatatggattatgatgttggagcatattgcgatgatgattggaatttagcacagaagcttatagttaatgggtgtgacccgttgcctagaagacggtgcttaacaagagcatcgatgacttaccagaaaccttatcctatcaatgagtcattatggaagcttcctgatgataggaatgtaaggtggggaaattaccaatgcaggaatttcgcgtgcttgtcaagtaaaaaccccaaaagaggatacacgaaatgcagcggatgttttgaaatggagaaagagagtggtaaatgggtcacaaacagtactttgttggctgatttcacgattgcagatgttttgaaagtgaagccaggtgagattaggattggattggattttggtgttgggacaggaacatttgcagcaagaatgagagagaagaatgtgactattgtcactactgcactgaatctgggagctcctttcaatgagatgatcgcattgcgaggtttgatccctttgtacatctctgttaaccagaggctaccgttcttcgataatactatggatatgattcatactgctgggttaatggacggttggattgatcttcttctgatggatttcgtgttatatgattgggatcgagtgctgagaccgggtgggttactgtggattgatagattcttctgtaaaaagaaagatcttgatgactatatgtacatgttcctgcagtttaggtacaagaaacacaagtgggctatttcacctaaatcaaaggatgaggtttatctctctgcattgcttgagaaacctcctcgtgcaatctaaaacaaaaaatacaaa

SEQ ID NO: 1293 - DNA, 5119 bp, Eutrema parvulum
agaaacctgcaaatggcaccggttaggaagtcgaggagtgtgaacaagcgtttcaccaatgaaacctcgccaagaaaagatgttggaaactcgagaaaaaataagcagcgtaagaaattgtctgacaagctgggacctcagtggaccagagtagagcttgagcgtttttatgacgcctaccggaagtacgggcaggactggagaaaggtggctgccgcaattcggaatagcaggtctgttgacatggtggaagccctttttaatatgaatcgggcatatttatctcttccggagggaactgcctctgtagctggccttattgctatgatgaccgatcactatagtgtcatggaagggagtggcagcgaaggagaaggccatgatgtttcagaagtaccgaggaaacagcaaaagcgcaaacgtgcaaaagctcagcttagtgattctcgagaggaagatgatagacaacatccagttgcctcatctgatggatgtctcacgtttttaaagcaagcacgagctaatggaactcatcgacgtgccactggcaaacgtacacctcgagttcctgtacaaacttcacacatgagggatgacagagaaggctctactccaccaaataaaagagccagaaagcaactcgatgccaatgatgatgttgcacattttttagcattagcattaacagacgcatccagaaggggagggtctccaatagtttctgaatcaccaaatagaagaacagaactcagtgacaactcgccaataaagagctgggggaaaatgtcacgaacgagaaaagctcaatcgtgggtgggaagtagccgagataggaagcttgaatctgatagagatgctgcgttgttgatggatatggaaggggttggcgaaatggaggttccacggaaggggaaaaggttctacaagaaaaaagtgaaagttgaagaagcagagggtaactattctgatgacaatggagaagcaggcagtgctactgaggggctcagaattaaatcacagagacgaaaggcaggtgttgaagcctcaagagggacatattcaccacgcagcccaaagaaaagagataacaaacttacttccggagatgaatttgatgctctgcaagccttggctgaattgtcagcttcattgcttccggcagcattgatggaatcagaatcatctgctcagttaaaggaagagagaatagaaaacgacattgacgagaaatctagctcaccagaaactacatccacaagcagtcatggggaaaaagcaaattcagaaccagatgatagtctgcttcatgcaatatctgctattgggaatgctgcttgcaatagaaaaccaaaaccttcaaggcaagcatccaccgattataatgttgttcccaccgggaagctacaaccggaaactactagtggcagtttaagaagaaaacgtaaaccaaagatgctaggggatgaagctccaactgattctactcaggaaaaatccataaacaagaaggaattggctcaagaagaccataatatgaagtcttcgcttagaacaaaacgcgttggtcaaggtcctcctcagtcaaaacagttgaaaactgttaagcagttggaggaatctactgcaatgagcgataagaaaagatctgcgatggatgtagtaatgtcaactaaacaagtttctgattcgggtccagccagtttaccgcagaaacctccaaacaggcgtaagatgagcctgaagaaaagcttgcaagaaagggctaaaacttctgaaaatattcataaagcttcgcgtagttcgagatctctttcagaacaggaattgttattaaaggataagctttctacttctatgtcgtattccttggcacgtcgaaggtgtatatttgaatggttttatagtgctattgaccatccctggtttgcaaagatggagtttgtggattacctaaatcacgtaggacttggtcacattccaagacttactcgtcttgaatggagcgtcattaaaagctctcttggtagaccccgaagattctctgagagatttttacaggaagagcgggagaaactcaaacagtaccgtgagtctgtgagaaagcattatacagagcttcgaacaggggctagggaagggcttcctacagatttggctcggccattagcagttggaaatagagtcattgccatccatcccaaaacacgagagattcatgatgggaaaattctcactgttgaccatagccaatgcaatgttctgtttgacgacttgggcgttgagttagttagggacattgactgcatgccttcaaatccattggaatacatgccagagggtctaaggaggcaaattgataagtgcttgtccatgaagaaagaagcacagctaagcgggaattcaaaccctggcgtgtctgttatattccctccatgcggacttgaaaatgttgacttctccatgaatccttctctcaatcagggtgatatgattgctcccattctgcatggtaaagtatcaaccaacactagtagtccacatcagacgaatcagtcatatatcatcaattatagcaaaggacgagaagctgagattcaacaggcatttgcgctacagcatgatttagatgaaaaggaaatggagccagagatgctagaaattgtcaagggttcaaagaagagagcgcaagcaatggtggatgcagctattaaggcttcatcatctgtgaaggaaggagaagatgcgagcaaaatgatccaagaagccttggacttgattggcaaacatcagccattacgcagctctatggccaaacatcaagagcatgcaaatggcagcatagagcatcaccacaacggatctccctcagacgcatcaaagcctgtggctaacagcgatttcatctcacaagatggttcagagaaaaacgaggctcaaatgccttcggagctaatcacctcctgtgttgccacttggctcatgattcagatgtgcacggagagacagtaccctcccgctgatgtggcacagcttatagacacagcagtcacgagcttgcagcctcgatgcccccagaacctaccgatctacagagaaatccaaatgtgtatgggacgaatcaaaactcaaatcctgtctctagtaccaagttgaaaggccaactcatttgggttagtgtttttttttagtctcttttaggtaagtccattctccttttaacttagagtagatgatggcatcttcacctgagaaaatggtgttagaagttcatgggttcaagaaaacagcttgaccagaggtatattagttacttaaaacattcattggctttggtagttaaccattggttctgtaacttgagctgatgtttatggttttttctaattttccatcagtgtcctttttggccagtttcaagttctcgagcagaaaatcctcaactagtaaagtgaaacagagctggaaatttctaattgttttcgaagtaaatacaaagggtagacaatcaaatgaatagaacgtctaatacaaatatataagcttaaccttttgtattttttgttttagattgcacgaggaggtttctcaagcaatgcagagagataaacctcatcctttgatttaggtgaaatagcccacttgtgtttcttgtacctaaactgcaggaacatgtacatatagtcatcaagatctttctttttacagaagaatctatcaatccacagtaacccacccggtctcagcactcgatcccaatcatataacacgaaatccatcagaagaagatcaatccaaccgtccattaacccagcagtatgaatcatatccatagtattatcgaagaacggtagcctctggttaacagagatgtacaaagggatcaaacctcgcaatgcgatcatctcattgaaaggagctcccagattcagtgcagtagtgacaatagtcacattcttctctctcattcttgctgcaaatgttcctgtcccaacaccaaaatccaatccaatcctaatctcacctggcttcactttcaaaacatctgcaatcgtgaaatcagccaacaaagtactgtttgtgacccatttaccactctctttctccatttcaaaacatccgctgcatttcgtgtatcctcttttggggtttttacttgacaagcacgcgaaattcctgcattggtaatttccccaccttacattcctatcatcaggaagcttccataatgactcattgataggataaggtttctggtaagtcatcgatgctcttgttaagcaccgtcttctaggcaacgggtcacacccattaactataagcttctgtgctaaattccaatcatcatcgcaatatgctccaacatcataatccatatacttctctagctccatcttcatcaacacacatgcatgacctattgtgttgtaaactctctctgttccaaacatgtttatcttcccgacccgattctccttgggggtaatgtacttccttatctcctcaatgagaaacttgttgatcaaaggctcttccttttccgtcgagtttctgattccttcggggtttggtaaacggatttgccttaaaccgatatgagcatagtaaaatggcttcatcacttcatcttcaagaaatttcttgatctcttttttgcttccgtctttgctcttctccatttcttttaccgtcttgtctagcttctcatacaagttatccatcttttgaaggacttcatcaacgcgatcacgcagcgcctttaagtcaaatccttcgctgttgacttctttgattctgtagatattgcggcaagtgtcttcgttgtgcaagaagtaacccgcagaatggaatctatagagacatgataggctcacagtgatcagtagtaacccgaagacaacttgtaatcctgccattagtcttcctaatcggcatttcggcaaacatgatctccccatttcttctttttaaccaaagaagctagtttcttttagtgattggctctaatcttaacctgaataaaaagagatattacttgatgttttgatggaaacctttcctctctggtttctccaggaaaagtcgaagagattcatgagtttgcttcacaacctcaaagtta

SEQ ID NO: 1294 - DNA, 3216 bp, Arabidopsis lyrata
tctattgatttatttttctaacttagtttccaaaatatggataatgaaatcgcgaagaaagtcacggcgatatttgatcaccggaggttaaaccgctctggatcatcactctacacagcgtttgcttccacggttatagctctggtcgttttcaccatcgttctcgtctctaatttatcggtgagaggagatttctcggcgaaagtggtgacaatagagatcaagacagttgttccttacttattacctctaagctcagagaaggaggtaagtgatcaaggcaacagtaactattcgatcaagcaacaaatcatagtcaaagagattgataacaatcttcaagttattgaagattttggaggcaaaggcgtgtcggagaagtttcaagagagagcaacagagtttttaagagatgattgtgaggtcaagttcatgatgacatggatctcacctgcggaattgttcggtaagagagagattttgtctgtcgaaagcgtctttaaatctcatcctcgaggttgtttgatgattttatcatccacaatggattctcctcaagggtttagtatcttgaaaccgtttcttgatcgaggttacagagtaatggcggtcacaccggatttgcattttcttctcaaggacacagccggagaatcatggcttgaagagattcagacaggtaaaagagatcccggaaagatctctctagctcaaaatctatcaaacctcatgcgactcgcttatctgtataaattcggaggtgtttatttagacacggacatgattgttttaaagagctttaaaactcttaggaacgtgatcggtgcacagactctcgaaccggtttcgagaaagtggacaagattgaacaatgcggttttgatcttcgacaagaatcatcctttcttgctcaaatccattgaagaattcgcgttgacttttaatggaaacgtttggggtcataacggaccgtatcttgtttctcgagtggctcgagccgtggaaggaaccgatggctataactttaccatcatgacacctcctgcgttttatccagtgaattgggttgagattgagaagctattcaaggttccaagaaccgagaaagattcaaagagggttcaagtcaaggttcttgaaatgcaaaagagaagctatggattgcatttgtggaataagtttagcagtaaatttgaaattgaacaaggaagtaccatggatcaactaatttcagatcactgtataatctgtgatagtgttgtctctgtatcgtgacttttattcctttttcattttgtgagttaatttaatttcaatgtagaatagcttgtaactaacaatgaaaccctgaactttttcatttctttcaattaaagccctgattaaaatcaatcccatttctatatataaaatcccatcaggattgttcggctttttatatttgggttgataataattatccaataaagattagtccaggcccatataagttgtcacgtcatcaatacaattacaattacgtttttcttcctatagtccaattggtaaaaaacggttcaagctgaaatcgaaactcgaaccggactgtgatggtggttttcgatggcggcgagcgagtgaagctcaacgttggcggcgaaatcttcgaaaccaacgcgtcaacaattcagtcatcttgcccagactctcttcttgcggctctatcgactccaacctcccatggctcgaatccggttttcatcgatcgtgacccagaaattttcgccgtcattctcaatctcctccgtactggtcgacttccagctaattcctccggcgttttctccaagcaagagctactcgatgaggctatgtattacggcgtcgaatcactcctcagattggcgatgttacctccgccgctgctaggtttcgatgcgtctctagtctccacaatcgtaccggctgctgatggagttccgtctgctttaaccgccactgctggagacgcttctctgtggatcgctcacggcggtcagatctccgtttacgattggagtctttctcatgctggaaccgtccgtacgcatctcaatgatatcacatcgatctgccgtgtgtggagtgaagcggctgcaatcggatctggatccgcgtcggggcttcacttctacgatctctctggaggtcgatacgtcggatctacgcattggactgatccggaggatccgaggatccataaggcacgcgtggctgcgattgccgattcggtcggtggagttttcgcatcctttgattgcctgcacagagagaacagtattctccagatcgacaaatccacgctccaagtagccgccgtgattggccagcaatctggaaactcggctaaaaccacagtaccggagaaactccggtggctgccaacgaacggtcttttggtcggatcagccgttcaacgcggagtgtttggttgctctggctacatccggatttgggacccaaggtccaggaacatcgtatgggaaacgagtgagccaggatcgggacgaagcactaggtttggagacgccttagctgatatggacgtggacgttgaagaattgatcctcttcaaggtatgttccaagtcaggagacctcggaatggcagacattcgtaaattgggcgaagatccatgggtatatatgtcagacgagaatcccggggcgtggaaggccggtgacggaggcggttacagcgtggtacattgttatagaaagcaagtgttggccgcgagaggtggtgcattagaggtatggtcaagtgttaaggagaagacaagtgttgatccaattcgcagaagaaactttgtagacaaggaagatgattccaagagagggatgatttcgaaaattgaagcaggaggtgatcggctctttgtttctcgggaatttatggaaggtgttgaggtctgggaaacttctaatttctcaggtgtgatatcggttgagtaataatagtttccagaagaacggtgaccaccctctgttttcccgggaaaatcttgatagtttcagattttcaaactttccagggtctagtagactagtggtactgattgtctgcagaatgaagaacagctgaacagaatgaagaacatcatcaagattcaaactttaccctcttatgttgtaaatagatccatagattttgtctttgtaaagtttggttctagtggataaataattacagtcacaa

SEQ ID NO: 1295 - DNA, 2980 bp, Eutrema parvulum
atttcttctcctaccttcatctccaaaaaaaagaaaaaaatggataacgaaatcgcaaagaaagtcatggtgatgtttgatcatcggcggttaaaccgctcaggatcatcactgttcacagcgtttgctgcctcagtaatagctctgatcgttttcacgatcgttatcgtctctaatttatcggtgagagatttctcggaggtgttgacaatagagatcaaaacagttgttccaaacttagctctgagttcagagaaagagctaagcgtaggaggaagcaataactatccgatcaagcaacttatcaaagtcaacgagaataatagtcttcaggttctcgagatttttggaggcaaaaacgtgtcggagaagtttcatcagagagcaacagagtttctgagagatgattgtgaagtcagtttcatgatgacgtggatctcgcctgccgaaatgtttggtaagagagagattttgtctgtagaaagcgtctttaaatctcatcctcgaggttgtttgatcattttatcatccactatggattctcctcaagggattagaatcttgagaccgtttcttgatcgaagttacagagttatggcggtaactcctgatttgccttttcttctcaaggacacggccggagaatcgtggcttgaggatattcagacagggaaaagagatcctggaaagatccctttagctcagaatctgtcaaatctcatgagacttgcgtatttgttcaaatttggaggtgtttatttggacactgatatgattgttctgaagagctttaaaagtctgaggaatgtgatcggtgcgcagactctcgaacccgtttcgagaaactggacgagactgaacaatgcggttttgatcttcgacaagaatcatcctctcttgctcaaatgcattgaagaatttgcgttgactttcaacggaaacgtttggggtcataacggaccgtatctagtttctcgagtggctcgagccgtggaaggaaccgatggctataacttcaccatcatgacacctcctgcgttttattcggtcaattgggttgagattgagaagctcttcaaggttccaagaacagagaaggactcgaagagagtcaaagtcaaggttcttgagatgcagaggagaagctacgggttgcatttgtggaataagtttagtagaaaacttgagattgagcaaggtagtgccatggatagaattgtttcagatcactgtgtcatctgtgacaaagtctctgtatcgtaagactctgtttcgctttgttagttatttccattgtaggatagctggtaaaactgtaattaacaatgaaaacctctttttttggaataaaccatgccgaatcaagaaactttgaacgagctgtaattaatcaatatctctatcaaacatttatatatccaatacaaattgggccaggcccatatattaacaacgtcatcaatcacaatttacgtttcttctctcagcccaattgacaaaacagctcagctgaatcgaagctcaaaccgggaaatgatggtgctttccggtggaagcgagcgcgtgaagctcaacgtcggcggcgagatcttcgaaaccaacgcatcgaccattcaatcgacctgcccagactctctcctcgctgctctctcgaacccaacctcccatggatcgactcctgtgttcatcgaccgtgacccggagattttctccgtcatccttagtctcctccgaactgggcggctcccagctaactcctccggcattttctccaagcaggagctactcgatgaggctctgtattacggagtcgagtcagtcctccggtcggcgatgttgcctccgccgctgctaggtttcgatgctgctctagtctccaccatcacaccggccaccgacggagttccgtccgctttcactgcaactgccggagatgcttctctgtggatcgctcacggcggacagatctccgtctacgattggagcctttcacacgctggaaccgtccgtacgcatctcactgacatcacatctatctgtcgcgtgtggtccgaggcggcggctatcggatctggatccgcgtcgggacttcacttctacgatctctccggaggtcgatatgtcggatctacgcactggacggatccagaggatccgagaatccataaggcacgagtcgctgccgttgccgattcggccagtggagtgttcgcatcctttgattgcttgcacagagagaacagcgttctccagatcgacaaatccactctccaagtcgccgccgtcatcggccagcaatctggaagctccgctaaaacgaccgtgccggagaaactgcgttgggtgccaaggaacggtcttttggtcggatctaccgtccaacgcggagtgtttggatgctctggctacatccgtatctgggaccctagatccaggaacattgtgtgggagacgagcgagccaggttcgggacgaagcagcaggttcggagacgccgtagctgacgtggacgtagacgttgaagactcgattctcttcaaggtatgctcaaagtcaggtgatctcggaatggcagacattcgtaaattaggtgaagatccatgggtatatgtgtcagacgagaatcacggcgcgtggaaagccggagccggagaccgaagcggcggttacaatgtcgtacattgttatagaaaacaagtgttggccgcgagagctggcgcgttagaggtgtggtcaagggttaaggagaatacatgtggtgatccaattcgcagaagaaacttggtagacaaggaagaagattccaagagagggatgatttcgaagattgaagccggaggtgatcggctgtttgtttctcgagaacacatggaaggtattgaggtctgggcaagttctaatttctcaagtgtgatatccgtcgagtaatgtttacccaagaaagtaacggcggagaagagtgatcatcaagcggctctgt

SEQ ID NO: 1296 - DNA, 3167 bp, Eutrema halophilum
tttctccgcatcacccatattcaaaaaaaaaaaaaaatggataacgaaatcacgaagaaaatcacggctatgtttgatcaccggcggttaaaccgctctggatcatcattgttcacagcgtttgctgcctcagttatagctctgatcgttttcacgatcgttatcgtctctaatttatcggtgagagatttctcagaggtggtgacaatagagatcaagacagttgttccttacttacctctgagatcagagaaggagctaagccaaggcaacaacaacaacaacaagtattcgatcaagcagcgtgtcacagtcaacgaggataacaatcttcaggtcctcgagatttttggaggcaaaggcgtgtcggaaaagtttcaactgagaacaacagagtttttgagagatgattgtgaggtcaacttcatgatgacgtggatctcccctgcggaattgttcggcaagagagagattttatccgtcgaaagcgtctttaaatctcatcctcgaggttgtttgatcattttatcatcgacaatggattctcctcaagggtttagaaccttgagaccgtttcttgatcgaggttacagagttatggcggtgacaccggatttgccttttctgctcaaggacacggctggagaatcgtggcttgaggaggttcagacagggaaaagagatcccgggaagatctcgttagcacagaatctgtcaaatctcatgagactcgcgtatctgttcaaatacggaggtgtttatctggacacagacatgattgttctgaagagttttaaaagtctgaggaacgtgatcggtgcgcagactctcgaaccggtttcgagaaactggacgagattgaacaatgcggttttgatcttcgacaaaaatcatcctctcttgcgaaaatgcattgaagagttcgcgttgactttcaacggaaacgtttggggtcataacggaccgtacctcgtatctcgagtggctcgagctgttgaaggaactgatggctataacttcaccatcatgacacctcctgcgttttattctgtgaattgggttgagattgagaagctcttcaaggttccaagaacagagaaggactcgaagagagtccaagtcaaggttcttgaaatgcagaggagaagctacgggttgcatttgtggaataagtttagtagcaaattcaaaattgagcaaggaagtgccatggataaaattgtttcagatcattgtgtcatctgtgagaaatcctctgtatcataatactctttcactttgtaagttaattacattgtagaatagcatgtaaactgtaattaaaaatcaattcctcaatttttttctccaactgaaacacatgtcaaaaataagaaaaatattcaatcatgaaactgatcccagctgcacaactggtcggcgttttaagtttgggccgataaatatccaataaagactggcaaggcccatatattgacacgtcatcagtcacaataccccagcccaattgacaaagtagctcagctgaatcgaagctcaaaccggccagtgatggctcccgatgacggcgagcgcgtgaagctcaacgtcggcggcgagatattcgaaaccaatgtatcgaccattcaatcaacctccccagattctctccttgctgctctcacgattccaacctcccatggttcgattcctgtgttcatcgatcgtgacccggagattttcgccgtcatcctcaatctcctccgtactggacggctcccagctaattcctccggcgttttctccaagcaggagctactcgatgaggctctgtactacggcgtggagtcactcctccggtcggcgatgtttccgtccccgctgctaggtatcgatgcttctctagtctccaccatcacacccgcggctgacggagttccctccgctttcaccgccaccgccggagacgcctctctgtggatcgctcacggcggacagatctccgtctacgattggagtctttctcactctggaaccgtccgtacgcatctcaacgatatcacgtcgatctgccgcgtgtgggccgaggcggcggctatcggatctgaatccgcgtcgggacttcacttctacgatctctccggaggtcgttacgtcggatctacccactggacggatccggaagatccgaggatccataaggcacgagtcgccgccgttgccgattcgtccggtggagtgttcgcatctttcgattgcctgcacagagagaacagcgttctccagattgacaaatccactctccaagtcgccgccgtcatcggccagcaatctggaagctccgccaaaaccagcgtaccggaaaaactgcggtgggtgccaacgaacggtcttttagttggatccgcggtccagcgcggggtgtttggatgctccggctacatcaggatctgggacccgagatccaggaacattgtgtgggagacgagcgagccaggttcgggacgaagcagcaggttcggagacgccttggctgacgtggacgtcgacgttgaagattcgattctctacaaggtatgttccaagtcaggtgacctgggaatggcagaccttcgtaaattaggtgaagatccatgggtatatgtgtcagacgagaatcccggcgcgtggaagtccgacgacggaggaggagggggttacagcgtcgtacattgttacagaaagcaagtgtgggccgcgagaggtggcgcattagaggtatggtcgagtgttaaggataatatacgtggcgatccgattcgtagaagaaactttgtagacaaggaagaagattccattagagggatgatctcgaaaattgaagccggaggtgatcggatgtttgtttctcgggaatatatggaaggtgttgaggtctgggaaagttgtaatttctcaagtttggtatcggtcgagtaatgttttcccaaacagggaagaacattgatcaagcggctctgttttcccgggaaaataggaaagagtcaaattttcaaactttccagggtctgatactgatcgcctacctgaagagtgaagaacaacatcaatattcaaactttactgttgtaaaattcaccagagccctcttatgttgtaaatggattcatagtctttgtaaatttctgattctagtggatatttacggt

SEQ ID NO: 1297 - DNA, 1828 bp, Brassica napus
ctaacgtttggcgttttgcgtttggaatgaaataacaattgggccaggcccatatatagtcagcgtcatcagttacaattacatttcttccctcagcccaattgacataaccggctcgagctgaatcgtagatcagaccggaaagtgataatggtttccgacggaagcgagcgcctgaagctcaacgtcggcggcgaaatcttcgaaaccacggcatccaccattcaatcaacctgcccagactctctccttgctgctctctcaacaccaacctctcacggatcgaaccccgtcttcatcgatcgcgacccggacgcttttcttccgtccatcctcaacctcctccgaaccggaccgtctcccacgctaactcctcctccgtcttctccaaacaagagctactcgatgaagctctttatttacggcgtcgagtcactcctccggtcggcgatgctgcctccgccgctgcttggtttcgacgcttctctagcttcgaccatcacgccggcgaccgacggagttccgtcagctttcaccgcaaccgccggagacgcttctttatggatcgcgcacggcggacagatctccgtctacgattggagtctctcccacgccgtaaccgtccgcacgcatctcagtgacgtcacgtcgatctgccgcgtgtgggacgaggcggcggcgatcggatccggatccgcgtcggggcttcacttctacgatctctcgagcggacgttacgtcggatccacgcactggactgatccggaagatccgaggatccacaaggcgcgagtcgccgccgttgcggattctcccggcggagtcttcgcatcgtttgattgcttgcatagagagaacagcgttctacagatcgataagtccactctccaagtcgccgccgtcatcggccagcaatccggaagctcagctaaaaccgccgtaccggagaagctccggtgggtggcgaataacggtcttttagtcggatccgcggtccaacgaggagtgttcggatgctccggtacatccggatctgggatccacgatcaaagaacattgtgtgggagacgagcgagccaggctcgggacgaagcagcaggttcggagacgcgttagctgacgtggacgtggacgttgaagagtcaactctcttcaaggtgtgttcaaagtcaggtgatctcggaatggcagatcttcgtaaattaggtgaagatccgtgggtatatgtgtcagatgataatcctggcgcgtggagtgcagacgacggagagagaagcggaggttacagcgttgtgcattgttatagaaagcaagtgttggctgcgagaggtggagcgttggaggtgtggtcgagtgttgaggggaagaggagtggtgatctgattcgtagaaggaactttgtagacaaggaagaagactccaagagagggatggtttctaaaattgaggcaggaggtgataggctgtttgtttctagggagtatatggaaggtgttgaggtctgggagagttctaactcctcaagtatgatagaactgtgatcaagcggctctgtagtgtcatattctcaggaaaatgttttgtttcctgggagaacagttgaacatattgtaatgaagaacaggaagattcaaacttcactgttgtcacattcaccagctatctcttctgttgtaaatggattcatagagtttttctcattgtaaggttatggttgtagttgataactgataagaaactaggttaggttctagttgagtgggaaaatcaagttcaaaaacaataaagtgaaatgcaggctctgctgtggataaaggtctactcatag

SEQ ID NO: 1298 - DNA, 1411 bp, Arabidopsis lyrata
taagaggagcgaatctcggcgatggcaatcaaagacctgacggcgacgaccggtgattcatctcttcctttgataaaacctccgccgtctgaaacaaccggcggtgacagaacctctgctcttcagacgcttggtaacattatcgtctccatcgtcggtacaggcgtccttggtcttccttacgcattccgcgtcgccggttggttcgccggatctctcggcgtcattatcgtcggattcgccacctattactgcatgctcctcctcattcaatgtagagataagctagaatcggaacaaggagaagaagaatcgaaaacttatggtgatttaggtttcaaatgtatgggaacaaaaggtcgatacttaaccgaattcctcattttcactgctcaatgtggtggatcagtagcttatctagtgttcataggacgaaacttgtcatccatatttagttcatatgggttaagtatggtgtctttcatcttgattctggttccaatcgaagttggattgtcctggatcacttctttatcagctctctcacctttcagtatctttgctgatatatgcaacattatagcaatgtgtttcgttgtcaaagaaaatgtggaaatggtgattgaaggtgacttctcgtttagtgatagaaccgctatttcgtctaccattggtggtttaccttttgctggaggagttgcggtcttctgttttgagggttttgcaatgacgttggctttagaaaattcaatgagggacagagaagctttccctaagttgttagctaaagtgcttgccgggattacatttgtctatgtcttgtttggtttttgtggttatatggcttatggcgatcaaacaaaggatattatcacacttaacctcccaaataattggtctgccattgctgtgcagattgggttatgtgtgggattgacgtttacattcccgattatggtacatccgcttaatgagatcatagagcagaaactgaagaagatagattggcttcaaaagcatcatcatgggtacaacaacgaaacaggttcagtctcaaaatgtgcaatctttatgacgaggacgcttttggtggtaggacttgctgcaatcgcgagtttagtcccagggtttggtacatttgcatctcttgttggaagtactttgtgtgcactcatatcctttgtgttgccggcttcttatcacctcacgctgctcggtccatcactaaatgtatggaacaaatccgtcgatgtattcatcgtgatttgcgggttgctctttgctgtttatggtacgtacaacacaatcgtcggagtgtgaaaatggaaagcaagtgatctgtgtaaagcaatgaatacaactacaagaagtttggtaagacaaacaaaaaaaatgtatagatcttttacat

SEQ ID NO: 1299 - DNA, 1521 bp, Eutrema parvulum
gtacgtctccatagcaatcgagaaaccttccagcaaaaataaaaaataaagagtgattctcggcgatggcgatcaaggacctggcggtgaacgatgatgcatctcttcctttgataaattctccgtcgtctgcaacggccggagacagaacctcgcctattcagacgctaggaaacattatcgtctctatcgtcggtactggcgtccttggacttccttacgcattccgcgtcgccggatggttcgccggatctctcggcgtcattatcgtcgggttcaccacctattactgcatgctcctcctcattcagtgcagagacaagctagaatcggaagaagggaaagaagaatcgaaaacgtatggtgatttaggattcagatgtttgggaacaaaaggtcgatacctgaccgagtttctcatattcactgctcaatgtggtggatcagtagcgtatctagtgttcataggccgaaatttgtcatccatattcgaatcatatggattaaatatggtctcttttatcttgattctggttccgatcgaagttggattgtcgtggatcacttctttatcggctctctcacctttcagcatctttgctgatatatgcaacatcatagcgatgtgtttcgttgtgaaagaaaatgtggaaatggtgattgaaggagacttctcgtttagtgacagaacagccatatcgtctaccattggaggtataccgtttgcaggaggagttgcagtgttctgttttgaaggttttgcaatgactctggctcttgaaggttctatgagagagagagaagctttccctaagttgctggctaaagtgcttgccgggattacgtctgtctacgtgttgttcgggttctgcggttatatggcttacggcgatgaaacaaaggatatcatcaccctcaacctcccaaataattggtctgccattgccgtgcagattggcttatgtgtgggattgacgtttacattcccgatcatggtacatccgctgaacgagatcatagagcagaaactgaaaaggatcgattggcttcaaaagcatcatcaccatcagtacagcaacgaaacaagttcagtctctaaatatgtaatcttcatcacgaggacgcttttggttgtaggactcgcagcaatcgcatccttagtcccgggctttggtacgtttgcatctcttgttggaagtactctgtgtgcactcatatcctttgtgttgccggcctcttatcacctcacactgctcggtccatctctaaatgtatggaacaaatccgttgatgtgttcatcgtgatttgcgggttgctcttcgctgtctatggtacatacaacacaatcgttggagtgtaaaaagggaaagtaagtgagaatctgtgtaaaatgaagacggcgatataaagttgctcagaccaaaagtaaaaatgtatagctgttttacatgaatctgaaatcggaagatagtgagaaatcaaattgttgtatgatcatttaatggatgtcaagagaaatg

SEQ ID NO: 1300 - DNA, 1612 bp, Eutrema halophilum
gtacgtctccttaaaaacaaaaatagaagaaaaacaaaaaacaagaggagtgaatctcggcgatggcgatcaaggacctggcggcgaacgacgattcatctcttcctctgataaaatctccgccgtctacaacgaccggagacagaaccacggctcttcagacgctcggaaacattatcgtctccatcgtcggtacaggcgtccttgggctcccttatgctttccgtgtcgccggatggttcgccggatctctcggcgttattatcgtcggattcgccacctattactgcatgctcctcctcattcagtgcagagacaagctcgaatcggaagaaggaaaagaagaatcaaagacatatggtgatttaggattcaaatgtatgggaacaaaaggtcgatacctaaccgaattcctcatattcactgctcaatgtggtggatcagtagcatatctagtgttcataggccgaaatatgtcgtcgatattcaaatcatgtggattaagtatggtctccttcatcttgatcctggttccaatcgaggctggactgtcttggatcacttctttatcagctctctcgcctttcagcatctttgctgatatatgcaatatcatagcaatgtgtttcgttgtgaaagaaaacgtggagatggtgatcgaaggagacttctcgtttggtgacagaacagccatttcgtctaccattggaggcttaccgtttgctggaggagttgcagtgttctgttttgagggttttgcgatgacgttggctcttgaaggttctatgaaggagagagaagctttccctaagctgttagctaaagtgcttgccgggattacgtttgtctacgtgttgttcggtttctgcggttatatggcttacggcgatgaaacaaaggatatcatcacacttaacctcccaaagaattggtctgccattgccgtgcagattggcttatgtgtgggattgacgtttacattccccatcatggtacatccgcttaacgagatcatagagcagaaactgaaaaggattgattggcttcaaaagcatcatcatcatcagcagcagcatcagtacagcaacgaaacagtttcagtgtcaaaatatgtaatcttgatcacgaggacgcttttggtggtaggactggcagcaatcgcgtcattagtgccgggctttggcacatttgcatctctggttggaagtactctgtgtgcactcatatcatttgtgttgccggcttcttatcacctcacgctgctcggtccatcgctaaatttgtggagcaaatccgttgatgtgttcattgtgatttgcgggttgctctttgctgtttatggtacttacaacacaatcgtcggagtgtgaaaaggagagtaagttaatctgtctgtaaaatgaacacagcaaacagaaagttgctcagaccgacaagaaaaaaaaatgtatatagctgttttacgtgaatctaatttaaatcggaaggcagtcagaaaaatcatattgttgtatgatcatttaatgggtgtaatgggaaatggtgacaacttttaaaattttcgcagcaaaagcttgaatttggttctaattaatattacttggattggatg

SEQ ID NO: 1301 - DNA, 1552 bp, Raphanus sativus
  misc_feature (118)..(118): n is a, c, g, or t
  misc_feature (132)..(132): n is a, c, g, or t
  misc_feature (136)..(136): n is a, c, g, or t
  misc_feature (226)..(226): n is a, c, g, or t
  misc_feature (538)..(538): n is a, c, g, or t
  misc_feature (985)..(985): n is a, c, g, or t
  misc_feature (1372)..(1372): n is a, c, g, or t
  misc_feature (1452)..(1452): n is a, c, g, or t
gggactccattattagtattttcagagagaggagcgaatctcggagatggcgatcaaggaccaccaccttgcgtcgcacggcgatgcatcatctctccctctgataaaatctccacgntctggagagaccgncggnggagatagaacatcggctattcagacgctcgggaacattatcgtctccatcgtcggtacaggcgtccttggacttccttacgcgttccgnatagccggatggttcgccggatctctcggcgtcgttatcgttggattcgccacctattactgcatgctccttctcattcaatgcagagacaagctagaagcagaagaaggacaagaagaatcgaaaacgtatggtgacttggggttcaaatgcatgggaacaaaaggtagatacctaacagagttcctcatattcaccgctcaatgcggtggatcagtagcctatctagtcttcataggccggaacatgtcctccatcttcgcatcatacggtttaagcatggtctctttcatcttgatcctggttccgatngaagtcgcgttgtcatggatcacctctctatcagctctctcgcctttcagcatcttcgctgatatatgcaacatcatagccatgtgtttcgttgtgaaagagaacgtggagatggtgattggaggagacttctcgtttggtgacagaacagctgtttcgtctagtattggagggttaccgtttgctggaggtgttgctgtgttttgttttgagggttttgcgatgacgttggctcttgagaattctatgaaggatagagaagctttccctaagctgttggctaaagtgcttgctgggattacgtttgtttatgtgttgtttgggttctgtggttatatggcttatggagatgaaactaaggatattattacactcaacctcccaaagaattggtctgccattgccgtgcagattggcttatgcgtgggactgacgtttacgttcccnatcatggtacatccgcttaacgagatcatagagcagaaactgaaaaggatagattggcttcaaaagcatcatcatcatgagtacagcaacgaaacaggttcggtctctaaatatgtaatattcaccacgagaacgcttttggtggtaggactcgcagcaatagcgtcattagtcccggggtttggtacgtttgcatctctggttggaagtactctgtgtgcactcatatcatttgtgttaccggcttcttatcacctcacgctgctcggtccatcgctaagtctgtggaacaaatcagttgatgtgttcatcgtgatttgcgggttgctctttgctgtctatggtacatacaatacaatcgttggagtgtaacaaagcgaagtaagngagtctgtgtttaaagaacacgccaacagaaagttggtcagagactcagaccaagaaccattgtatagctgttttacatnaatttgatatcagaagatagtgggattgggaaaatccaaattgttgtataataattacaggttttaaatgtttggcaaaagcatgtttggttttgtttta

SEQ ID NO: 1302 - DNA, 1443 bp, Brassica napus
gcgaatctcgtcgcgatggctgcgaacggtgatgatgcatctctccctctaataaaacctccaccgtctgcagcgacgggagatagaacatctgctattcagacgctagggaacattatcgtctccatcgtcggtacaggcgtccttggactcccttacgcgttccgcatcgcaggatggtttgctggatcacttggtgtcattatcgttggattcgctacctattactgcatgctccttctcattcaatgcagagacaagctagaatcggaagaaggacaagaagaatccaaaacgtacggtgacttaggatacaaatgcatgggaacaaaaggtcgttacctaaccgagttcctcatattcaccgctcagtgcggtggatcagtagcctatctagtcttcataggccggaacatgtcttccatcttcacatcatacggtttaagcatggtctcattcatcttgatcctagttccaatcgaagttgcgttgtcatggatcacttctctatcggccctctcgcctttcagcatttttgccgatatatgcaacatcatagccatgtgtttcgtcgtgaaagaaaacgtggagatggtgatcgaaggagacttctcgtttggtgatagaacggctgtttcgtctaccattggaggtttgccgtttgctggaggtgttgctgtgttttgtttcgaggggtttgcgatgacgttggctcttgagaattctatgaaggatagagaggctttccctaagctgttggctaaggtgcttgctgggattacgtttgtttatgtgttgtttgggttctgtggttatatggcttatggagatgaaacaaaggatattatcacacttaacctcccaaagaattggtctgccattgccgtgcagattggtttatgtgtgggattgacgtttacgttcccgatcatggtacatccgcttaacgagatcatagagcagaaactgaaaagggtagattggcttcaaaagcataatcataactacagcaacgaaacaagttcggtttctaaatatgtgatcttcaccacgaggacgcttttggtggtaggactggctgcaatagcgtcattagtcccggggtttggtacatttgcatctctggttggaagtactctgtgtgcactcatatcattcgtgttgccggcttcttatcacctcacgctgctcggtccatcgctaagtctatggagcaaatcagttgatgtgttcatcgtgatttgtgggctgctctttgctgtttatggtacatacaacacaatcgttggagtgtaacaagggagtctgtgtaaaacaaacacggcaacagaaagttggtcagaggctcagaccatgaaccatgtatagcagttttacatgaatttgatatcggaagatagtgggttgggaatatccaaattgttgtatgataatgacagcttt

SEQ ID NO: 1303 - DNA, 1527 bp, Brassica napus
ctccattattttcgagagaggagcgagcgaatctcggcgcgatggctgcgaacggtgatgatgcatctctccctctaataaaacctccaccgtctgcagcgacgggagatagaacatcggctattcagacgctcgggaacattatcgtctccatcgtcggtacaggcgtccttggactcccttacgcgttccgcatcgcaggatggtttgctggatcacttggtgtcattatcgttggattcgctacctattactgcatgctccttctcattcaatgcagagataagctagaatcggaagaaggacaagaagaatccaaaacatacggtgacttaggattcaaatgcatgggaacaaaaggtcgttacctaaccgagttcctcatcttcaccgctcaatgcggtggatcagtagcctatctagtcttcataggcacgaacatgtcatccatcttcacatcatacggtttaagcatggtctctttcatcttgatcctagtcccaatcgaggtcgcgttgtcatggatcacttctctatcggctctctcgcctttcagcatctttgccgatatatgcaacatcatagccatgtgtttcgtcgtgaaagaaaacgtggagatggtgatcgaaggagacttctcgtttggtgacagaacggctgtttcgtctactattggagggttgccgtttgctggaggtgttgctgtgttttgtttcgagggctttgcgatgacgttggctcttgagaattctatgaaggatagagaagctttccctaagcttttggctaaagtgcttgctgggattacgtttgtttatgtgttgtttgggttctgtggttatatggcttatggagatgaaacaaaggatattatcacactcaacctcccaaagaattggtctgccattgccgtacagattggcttatgtgtgggattgacgtttacgttcccgatcatggtacatccgcttaacgagatcatagagcagaaactgaaaagggtagattggcttcaaaagcataatcataactacagcaacgaaacaagttcggtctctaactatgtaatcttcaccacgaggacgcttttggtggtaggactggcagcaatagcgtcactagtaccgggatttggtacatttgcatctctggttggaagtactctgtgtgcactcatatcatttgtgttgccggcttcttatcacctcacgctgctcggtccatcgctaagtctatggagcaaatcagttgatgtgttcatcgtaatttgcgggttgctctttgctgtttatggtacatacaacacaatcgttggagtgtaacaagggagtctgtgtaaaacgaacacggcagcagaaagttggtcaagaatctcagaccaaagaacaaggatgtataggttttacatgaatccgaaatcgaaagatactggattgagaaaatccaaattgttgtatgataatgacagctttaaatttcgcaaatgcagcttggtcctgtttaaatgtggaaacatgttaaacagac

SEQ ID NO: 1304 - DNA, 1542 bp, Brassica napus
gaatctttggcgcgttataaagattgcggcggagtatttcgttacgtcttccattattttcgagagaggagcgagcgaatctcggcgcgatggctgcgaacggtgatgatgcatctctccctctaataaaacctccaccgtctgcagcgacgggagatagaacatcggctattcagacgctcgggaacattatcgtctccatcgtcggtacaggcgtccttggactcccttacgcgttccgcatcgcaggatggtttgctggatcacttggtgtcattatcgttggattcgctacctattactgcatgctccttctcattcaatgcagagataagctagaatcggaagaaggacaagaagaatccaaaacatacggtgacttaggattcaaatgcatgggaacaaaaggtcgttacctaaccgagttcctcatcttcaccgctcaatgcggtggatcagtagcctatctagtcttcataggcacgaacatgtcatccatcttcacatcatacggtttaagcatggtctctttcatcttgatcctagtcccaatcgaggtcgcgttgtcatggatcacttctctatcggctctctcgcctttcagcatctttgccgatatatgcaacatcatagccatgtgtttcgtcgtgaaagaaaacgtggagatggtgatcgaaggagacttctcgcttggtgatagaacggctgtttcgtctactattggagggttgccgtttgctggaggtgttgctgtgttttgtttcgagggctttgcgatgacgttggctcttgagaattctatgaaggatagagaagctttccctaagcttttggctaaagtgcttgctgggattacgtttgtttatgtgttgtttgggttctgtggttatatggcttatggagatgaaacaaaggatattatcacactcaacctcccaaagaattggtctgccattgccgtacagattggcttatgtgtgggattgacgtttacgttcccgatcatggtacatccgcttaacgagatcatagagcagaaactgaaaagggtagattggcttcaaaagcataatcataactacagcaacgaaacaagttcggtctctaactatgtaatcttcaccacgaggacgcttttggtggtaggactggcagcaatagcgtcactagtaccgggatttggtacatttgcatctctggttggaagtactctgtgtgcactcatatcatttgtgttgccggcttcttatcacctcacgctgctcggtccatcgctaagtctacggagcaaatcagttgatgtgttcatcgtaatttgtgggttgctctttgctgtttatggtacatacaacacaatcgttggagtgtaacaagggagtctgtgtaaaacgaacacggcagcagaaagttggtcaagaatctcagaccaaagaacaaggatgtataggttttacatgaatccgaaatcgaaagatactggattgagaaaatccaaattgttgtatgataatgacagctttaaatttcgcaaatgcagcttgg

SEQ ID NO: 1305 - DNA, 1981 bp, Arabidopsis lyrata
ttgtttgttcaaataaggtttgaaaaatgagcgcggtgagttttctatatagctcgaaaaaccccaaatttcgaggggctttcaatgggatttgtgctctggttctgttttgcttcttctttgatcggagcgatattctcaggaaccctttgtttaggaactcatctctcgtcaatggtggtagtggctcaacctcccgaggtaaattcaataatggtttcacgttaattcgtagaaatgtgaggcaaattgaaacgaatgattctggcaatagcagcttgagtagcactagtactgttttattctcagggttacacaaacacattggttatgctgatcaatgcgacttcttaaaagcaaacccaatttgttcccctgatggattctttgattacctcaacttcttctactgctcctgcagagatttcagtatcttgggttacatgatgttaggtgtttggcttgttgcattgttttatctcttgggtaatactgctgctgattacttttgttgttcattggagaagctttcaaagcttttgaggctacctccaactgttgctggtgttactttacttcctcttgggaatggagcaccagatgtgtttgctagtatagccgcttttgttggaacagataaaggagaagttggtcttaacagcgtcttgggtggtgctgtgtttgttacttctgttgttgttggcattgtttcgctttgtgttgcggataaggatgtcaagatcgataagaaatgcttcatcagagacttgagtttcttccttttcacgcttgtgtctttgctggtgattttgatggttggtaaagtgacagtccggattgccatcgcctttgtctcgatatatgtgatttatgctttccttgtggcagcgaatgtcattctgataaaacatgctaagaggtttaaactagaggctcttactcctttgctacctatgcaaggaagcatgttttccccgagtgttggagaggatatgccaatgaatacccccttgatagaaactgaccctgaggatggtccacctcggctacagagtcttcctcagtggatgtgggcgtcaaatgtggccatctattccaaccatttcgcgaaagttagtgtacatgatgaagacaggccaccttggggatggattgatgacagtgcagaagttgagagctcctcatgtactaaattcacttccttgttggaaattccgctgacgattccaaggaggttaacaattccgtcggtcgaggaagatacatggtcaaagacatatgctgtggccagcgttacattagctcctgtccttttggcgtctctctggagtagccaagacgatgtgagtccccaagcttgtggtgtcgcatactttattggtgttgctataggctctactctgggctttcttgcttacaaaaacacagaacccgatcacccacctcgaagattcttgatcccttgggtccttggtgggtttatcatgagcatcgtatggttctacatgattgcaaacgaacttgtagctcttctggtgacatttggtgagatttacggaattaacccgtcgatacttgcgctaacagtacttgcttggggaaactcaatgggtgacttagtgtcgaatatcgcattgacgatgaacggtggtgatggtgtacaaatcgctctatcgggatgctacgcaggtccaatgttcaacacactcgtcgggctcggtatgtcaatgctttttggcgcatggtccaagagtcctgacacatacatgctaccagaagacaaaagcctgttctacacacttgggtttctagtactcggtttggtttgggctatggtgatactcccgcgcaacgacatgcgacctaacagaaccttaggtatgggactcattgcaatatatctgatattcgtcactttcaggctcagttgcgccatgggattcataccatgggctgcttaaagagctatatataatcttgt

SEQ ID NO: 1306 - DNA, 2075 bp, Eutrema halophilum
tggttgattggtaataaaacgtttgaaatgagccttgtaaattttctttgtagctcgaaaaatcccaaatttcgagggatttttaatgggatttgtgctgtgattctatttgtcttcttctttgatcggagcgacatactcaggaaccctttgttaagaagtaacgcgtctttcgtcgatggtggtagtggtggttcgacctccaaagctaatttcaacaatggttttagccaatttacggtagttcgtcgacatatgagcgaagctgacacaaacgtttctaagctaatcaacggttctggtaataacagcttgagtagcactagtactgtattatgctcgggtttacacaatcacatgggttacgctgatcaatgcgagttcttaagagcgaatccgatttgctcccctgatggattctttaattacctcaacttcttttactgctcctgcagagatttcaagatcttgggttacatgatgttgggtgtttggcttgtcgcgttgttttatctgttgggtaatactgctgcagattacttttgctgttcgttggagaagctttcaaagcttttgaggctgcctccaactgttgctggtgttacgctactcccacttgggaatggagcaccagatgtgtttgcaagtatagctgcttttgttggaactgataaaggagaagtgggtcttaacagcgtcttgggtggtgctgtgtttgttacttcagttgttgttgggattgtctcgctttgtgttgcggacatggaagtcaagatcgataagaaatgcttcatcagagacttaagtttcttccttttcacactcgtgtctttatcaattattttgatggtcggtgaagtcacagtacgggtcgccatagcgtttgtctcgatatatgtggtttatgctttcctcgtggcggcaaatgttgttctgagaaagcatgctaagaggtttaagctagaagctattactcctttgctacctatgcaaggaagtgtgttttccccgagtgttgaagaggatattccaatgcatagccccttgatcgaaactgacactgaggatggtccacctcggctacagaactctcttcctcaatggatgtgggcttcgaatgtggccatctactcaaaccatttcgcgagagttagtgtacaagatgatgacaggccaccttgggggtggattgacgacagtgcagaagttgagagctccttgtgtactaaactcacttccttgttggaaattccactgacgattccaaggaggttaacaattccatcggtcgaggaagatacatggtcaaagacatatgccgtggctagcgtttcattagcccctgtactcttggcatctctctggagtagccaagacaatgtgagtccccaagcttgtgttgtggcttactttatcggcgttgctataggctcagctcttggttttcttgcttacaaaaacacagaaccggatcacccacctcgaagattcttgatcccttgggttcttggtgggtttatcatgagcatcgtatggttctacatgattgcaaacgaactcgtagctcttctggtgacatttggtgagatctatggaatcaacccgtcgatacttgcactaacggtactcgcttggggaaactcaatgggtgacttagtgtcgaacatcgcattgtcgatgaacggtggggacggtgtgcaaatcgctctatcgggatgctatgcaggtccaatgttcaacacactcgttgggctcggtatgtcgatgcttctcggcgcatggtccaagagtcctgacacgtacattgtaccagaagataaaagcttgttctacacacttgggtttctagtactcggtttggtttgggctatggttgtgctcccacgcaacgacatgcgacctaataaaaccttgggtgttggactcattgctctgtatctgatattcgtcacattcaggctcagttgcgccatgggattcataccatgggctgcttaaaagctatgtaaccttgtttgatctgtaaccaacgactaattagaggccaatgtatatcaaaacttgtaatgagcgtt

SEQ ID NO: 1307 - DNA, 1967 bp, Eutrema parvulum
gtttgaaatgagcgcagcgagttttcttcttacctcgaaaaatcccaaatttcgagggatttttaatggcctttgtgctgtgattctgtttgtcttcttctttgatcgcagcgacatactgaggaaccctttgttaaagaacgcgtatttcgtcgatggtggtactagtggttcggcctccaaaggtaaattcaacaatggtttcacccattttacggttgttcgtcgacatatgagcgaagggtctcggtaataacagcttgagtagcactagtaccgtgttatgctcggggttacacaatcacattggttacgctgatcagtgcgacttcttaagagcgaatccaatttgctcccctgatggattctttgattacctcaacttcttttactgctcctgcagagatttcaagatcttgggttacatgatattgggtgtttggcttgttgcgttgttttatctgttgggtaatactgctgctgattacttttgttgttcgttggagaagctctcgaagcttttgaggctgcctccaaccgttgctggtgttactttgcttccacttgggaatggagcaccagatgtgtttgcaagtatagctgcttttgttggaacagacaaaggagaagtgggtcttaacagcgtcttgggtggtgctgtgtttgttacttcagttgttgttgggattgtctcgctttgtgttgcggacatggaagtcaagatcgataagaaatgcttcatcagagacttgagtttcttccttttcacgctcatgtctctctcggtgattttgatggtcggtaaagtgacagtacggattgccattgcgtttgtctcgatttatgtggtttatgctttcctcgtggcagcaaatgtgattctgagaaagcatgctaagaggtttaaactagatgctattacccctttgctacctatgcaagggagcgtcttttccccaagtgttgaagaggatattccaatgcatagccccttgatcgaaagtgactctgaggatcgtccacctcggctacagaactctcttcctcagtggatgtgggcttcaaatgtggccatctactcaaaccatttcgcaagaggtagtagtgtacaagatgatgaaaggccaccttggggatggattgacgacagtgcagaagttgagaactccctatgtactaaattcacttccttgttggaaattccactgacgattccaaggaagttaacaattccgtcggtggaggaagatacatggtcaaagacatacgctgtggccagcgtttcattagcacctgtgcttctggtgtctctctggagtagccaagagaatgtgagtccccaagcttgtggtgtagcttactttatcggccttggtattggctctactcttggtttttttgcttacaaaaacacagaacctgatcacccacctcgaagttttttgatcccttgggttctcggtgggtttatcatgagcattgtatggttctacatgattgcaaacgaactcgttgctcttctggtaacatttggtgagatctacggaatcaacccgtcgatacttgcgctaacagtacttgcttggggaaactcaatgggtgacttagtgtcgaatatcgcgttgacgatgaacggcggggatggtgtgcaaatcgctctatcgggatgctatgcaggtccaatgttcaacacactcgtcggcctcggtatgtcaatgcttctcggcgcttggtccaagagtcctgattcatacatggtcccggaagacaaaagcctgttctacacacttgggtttctcgtactcggtttggtttgggctatggttattctcccgcgcaacgacatgcgacctaacaaaaccttaggtattggactcattgctctatatctgatattcgtcactttcaggctcagttgcgccatgggattcataccatgggctgcttagaagctattgtaaacatgt

SEQ ID NO: 1308 - DNA, 2189 bp, Eutrema parvulum
aacagaatctgggtaccctagggtttttcaaaagttccttatctcaccttgttcgtttggatgccctaggtctctttctggttcggggaggtctggggtttatggttggttggtaaccaaacgtttgaaatgagcgcagcgagttttcttcttacctcgaaaaatcccaaatttcgagggatttttaatggcctttgtgctgtgattctgtttgtcttcttctttgatcgcagcgacatactgaggaaccctttgttaaagaacgcgtatttcgtcgatggtggtactagtggttcggcctccaaaggtaaattcaacaatggtttcacccattttacggttgttcgtcgacatatgagcgaagctgacacaaacgttgcgaagttaatcaacggtctcggtaataacagcttgagtagcactagtaccgtgttatgctcggggttacacaatcacattggttacgctgatcagtgcgacttcttaagagcgaatccaatttgctcccctgatggattctttgattacctcaacttcttttactgctcctgcagagatttcaagatcttgggttacatgatattgggtgtttggcttgttgcgttgttttatctgttgggtaatactgctgctgattacttttgttgttcgttggagaagctctcgaagcttttgaggctgcctccaaccgttgctggtgttactttgcttccacttgggaatggagcaccagatgtgtttgcaagtatagctgcttttgttggaacagacaaaggagaagtgggtcttaacagcgtcttgggtggtgctgtgtttgttacttcagttgttgttgggattgtctcgctttgtgttgcggacatggaagtcaagatcgataagaaatgcttcatcagagacttgagtttcttccttttcacgctcatgtctctctcggtgattttgatggtcggtaaagtgacagtacggattgccattgcgtttgtctcgatttatgtggtttatgctttcctcgtggcagcaaatgtgattctgagaaagcatgctaagaggtttaaactagatgctattacccctttgctacctatgcaagggagcgtcttttccccaagtgttgaagaggatattccaatgcatagccccttgatcgaaagtgactctgaggatcgtccacctcggctacagaactctcttcctcagtggatgtgggcttcaaatgtggccatctactcaaaccatttcgcaagaggtagtagtgtacaagatgatgaaaggccaccttggggatggattgacgacagtgcagaagttgagaactccctatgtactaaattcacttccttgttggaaattccactgacgattccaaggaagttaacaattccgtcggtggaggaagatacatggtcaaagacatacgctgtggccagcgtttcattagcacctgtgcttctggtgtctctctggagtagccaagagaatgtgagtccccaagcttgtggtgtagcttactttatcggccttggtattggctctactcttggtttttttgcttacaaaaacacagaacctgatcacccacctcgaagttttttgatcccttgggttctcggtgggtttatcatgagcattgtatggttctacatgattgcaaacgaactcgttgctcttctggtaacatttggtgagatctacggaatcaacccgtcgatacttgcgctaacagtacttgcttggggaaactcaatgggtgacttagtgtcgaatatcgcgttgacgatgaacggcggggatggtgtgcaaatcgctctatcgggatgctatgcaggtccaatgttcaacacactcgtcggcctcggtatgtcaatgcttctcggcgcttggtccaagagtcctgattcatacatggtcccggaagacaaaagcctgttctacacacttgggtttctcgtactcggtttggtttgggctatggttattctcccgcgcaacgacatgcgacctaacaaaaccttaggtattggactcattgctctatatctgatattcgtcactttcaggctcagttgcgccatgggattcataccatgggctgcttagaagctattgtaaacatgtttctaccttaacgaaacaactaatctgaggctatattgtatgtaatacctgaacttgtaatgatgagcttt

SEQ ID NO: 1309 - DNA, 2143 bp, Brassica napus
caaccaatctgaatatatcctagggtttttcaaaaacttcaatttcgtatctttgttcgttcggaaaccctagccccctttcttgttcggcgcgaggtctcttggagtccatgtacgttgaaatgaacgctgtgaattttcttaacacgaaaaaccctaagtttcgaggatttcaacggcctccgcgctttgattctattcttcttcttcttcgatcggagcgaaatctcaagaaccctttgttaagaaagcgtctttcgtctccaaaggtaaactcaacaccaatggtttcacccaattcacgctagttcgtcgacacatgatcgaagaagatgtttcgaagttcggtaatgacaccttgagcagcactagtactgtcttatgctcgggtttaccattaaccacatcggttacgctgatcaatgtgacttcttaaaagcgaatccgagctgctcacctgatgggttctttgactacctcagcttctttactgctcctgcagagacttcaagatcttgggttacatgatcctcggcgtttggctcgttgccttgttttatctcttgggtaacaccgctgctgattacttttgttgctccttggagaagctctctaagcttctgaggctgcctcctactcttgctggcgttactctgcttcctctcgggaacggagcgccggatgtgtttgcgagtatagctgcttttgtcggttcggataaaggtgaagttggtcttaacagcgtccttggcggtgctgtttttgtcacttccgttgttgttgggattgtttcgctttgtgttgcggatatggaagtgaagcttgataagaagtgctttatcagagacttgagtttcttccttttctcgcttgtgtctctgatggtgattctgatggttggggaggtgacggtgcggattgctgttgcgtttgtttcgatatatgttgtttatgcttttctggtggcggcgaatgtgattctgagaaagcatgctaagaggtttaagatagaggcgatcactcctttgttacctatgcaagggagcgttttttcgccgagtgttggagaggatgttccgattcatagcccgttgattgagagtgactctgaggatggtccgcctcggctgctgaactctcttcctcagtggatgtgggcttcaaacgtggctatctattcaaaccatttcgccagaggtagtagcgtgcaagatgatgacaggccacttggggatggattgaagacggtgcggaagctgagagctccttctgtaataaattcacttcgttgttggagatcccactgacggttccgaggaagttaacaattccatctgtggaggaagatacatggtcgaagacatacgctgtggccagcgttacgttagcgcctctgcttctggcgtctctatggagtagccaagacaatgtgagtccacaagcttgtggtgtggcttactttatcagcctagctattggctctactcttggctttttggcttacaaaaacacagaaccggatcacccgcctcggagattcttgatcccttgggttctcggtgggtttatcatgagcatcgtatggttctacatgattgcaaacgagctcgttgcgcttctagtaacatttggtgagatctacggaatcaacccgtcgatacttgcgttaacagtactcgcttggggaaactcaatgggcgacttagtatcaaacattgcattgtcgatgaacggtggggatggtgtacagatcgctctatcgggatgttacgcaggtccaatgttcaacacactggtcggactcggtatgtcaatgcttcttggcgcatggtctaaaagtcctgacacatacatggtcccggaagacaaaagcttgttctacacacttgggtttctagtactcggtttggtttgggctatggtgatgcttcctcgcaacgacatgcaacctaacaaaaccttaggtattggactcattgctctgtatctgatattcgtcactttcaggctcagctgcgccatgggatttataccatgggctgcttagaagctattatatgtaaacaatgtttctaccttaaccaaaacaactaatcagacgctgtaactgtttgtaatatcaaaacttgcaatgatgagcttt

SEQ ID NO: 1310 - DNA, 2266 bp, Arabidopsis lyrata
gatttcgagaatgagagctgtgaattttctatatagctcgagtaatcccaaatttcgggggatttttaatgggctttgtgcaatagtcctattcatcttcttctttgatcagagcgatatactcaggaaccctttgttaaagaatctgtctttcgttgattctagcggtcaattcagtaatgggtttagccagtttactgtaattcgtcgacatttgagtggttcttttggtaatagcagcttgagtggtgatactactgtatcttgctctgggttacatgaacacagaggttatgttgatcaatgcgagttcttgatatcgaatccgatttgttctccagatgggttctttgattacctcaagtacttttactgctcctgcagagattttaagatcttgggttatttagtgttaggggtttggcttgttgctttgttttatcttttgggtaatactgctgctgattacttttgttgttcgttggagaagctttctaagcttttgaggttgcctccaactgttgctggtgttactttgcttccacttggtaatggagctcctgatgtgtttgcgagtatagctgcttttgttggttcagataaaggggaagtgggtcttaacagcgtcttgggtggtgcggtgtttgtaacttgtgttgttgttgggattgtttcgctttgtgttgcggataaagaagttaagatcgataagaaatgtttcatcagagacttgagtttcttccttttcacattggcggctttgatggtgattttgatggtcggtaaggtgactgttcgtatcgccattgcgtttgtctcgatctatgtcctttatgcttctctcgtggctgcgaatgagattttgaggaaacattcaaggaggttgaagcttgattctattacgcctttgctcccaatgcagggaagtgtcttctccccaagtgttgaagaggatattcctatgtacagcccgttgctagaacttgagaccgaggaaggtccacctcggctacatgattctctaccacagtggatgtgggctacaaatgtagccatctattcaaaccatttcgcaaaagccaatgtacatgatgaagaaagacctccatggggatggaccgaagatggtgcagaagtcgagagctcgttatgttctaaattcacatctttgcttgaaactccactgactgttcctagacggttgacaatcccgttgattgaggaagatagctggtcaaagacgtatgctgtggctagtgtctcgttggctcctgtcctactttcctttctttggagcagccaagatgatacgagtcttcaagctcggattgtagcctattttatcggaattgcgattggatctactcttggttatctcgcgtacaaaaacacagagtccgatcgtccgcctcaaagatacttaatcccttgggtactcggtggattcatcatgagcatcgtatggttctacatgattgcaaacgaacttgttgcacttttggttacatttggtggaatctacggaatcaacccgtcgatactcggtctaaccgtacttgcttggggaaactcaatgggtgatttagtgtcgaacatcgcattgtcgatgaacggtggagatggggtacaaatcgcattatcgggttgctacgcaggtccaatgtttaacacgcttgttgggttaggtatgtcgatgtttcttggtgcttggtcgaagagtccagagacatacatgatccctgaggacaatagcttgttctacactctagggtttctaatattcggattgatttggtctcttgtgatgctcccacgcaacgaaatgcgaccgaacaaagtgatgggaattggtctgattgcactgtatctgatattcgtcactttcaggctcagctcagccatgggattcgtaccttgggcttcttaaaacgccattgttgccagtttattgtatactactatacatgttgttagagatagccactggttctgaagtaaatgttgtttgtagtttgtactatgttgatgcaagtgataatgaatctgagccgttgaatctaggtcgttgtggtagatctcgatcgtagattgggacaaatggataatgtattcgaaaatggagactaatgggccttgttaaatgggccaagtcttaataaactcaataatgttgccccacttgtttcgttttcttccacttgtacatcgtcgtcacatggtaggtagtgagatattcatattcgtatcgaaaaattaattgtttatc

SEQ ID NO: 1311 - DNA, 2270 bp, Arabidopsis thaliana
gatttcgaaatgagagctgtgaattttatgtatagctcgaataatcccaaatttcgagggattttcaatgggctttgcgctataatcctattcatcttcttctttgatcagagcgatatttacaggaaccctttgttgaagaatctttctttcgttgattctagtggtaaattcaatcgtgggtttagccagtttactgtacctcgtcgacatttgagtgaagttgacactaatggctcttctggtaatagcagcttgagtggtgatagtactgtatcctgctctgggttacatgaacatagaggttatgctgatcaatgcgaattcttgaaatcgaatccaatttgttctccagatggcttctttgattacctcaagttcttttactgctcctgcagagattttaagatcttgggttatatactgttaggtgtttggcttgttgctttgttttatctgttgggtaatactgctgctgattacttttgttgttcgttggagaagctttctaagcttttgaggttgcctccaactgttgctggtgttactttgcttccacttggtaacggagctcctgatgtgtttgcgagtatagctgcttttgttggttcagataaaggggaagtgggtctcaacagcgtcttgggtggtgcagtgtttgtgacttgtgttgttgttgggattgtttcactttgtgttgcggataaagaagttaagattgataagaaatgtttcatcagagacttgagtttcttccttttcacattggtggctttgatggtgattttgatggttggtaaggtgactgtgggtattgccattgcgtttgtctcgatctatgtgttttatgcttctctcgtggctgcgaatgagattttgaggaaacattccaggaggttgaagctggattctattacgcctttgctcccaatgcaaggaagtgtgttctcctccccaagtgttgaagaggatattcctatgtacagcccgttgatggagcttgacaccggtgaaggtccacctcggctacatgattctctaccacagtggatgtgggctacaaatgtagccatctattcaaaccatttcgcaaaagccaatgttcatgatgaagaaagacctccatgggggtggaccgaagatggtgcagaagtcgagagctcgttatgttctaaaatcacatctttgctggaaactccactgactgttcctagacggttgacaatcccattgattgaggaagatagctggtcaaagacgtatgcggtggctagtgtctcgctggcgcctgtcctactttcctttctttggagcagccaagatgatacgagtcttcaagctcgcattgtagcctattttatcggaattgcgattggatctactcttggatatctcgcgttcaaaaacacagagcccgaccgtccacctcaaatatatttaatcccttgggtacttggtggattcatcatgagcatcgtatggttctacatgattgcaaacgaacttgttgcacttttggttacatttggtggaatctatggaatcaacccgtcaatactcggtctaaccgtacttgcttggggaaactcaatgggtgacttagtgtcaaacatcgcattgtcaatgaacggtggagatggggtacaaatcgcgttgtctggttgctacgcaggtccaatgtttaacacgcttgttgggttaggtatgtcgatgtttcttggtgcttggtcgaaaagtccagagacttacatgatcccggaggacaatagcttgttctacactctagggtttctaatattcggattgatttggtctcttgtgatgctcccacgcaacgaaatgcgaccgaacaaagtgatgggcattggtcttattacactgtatctgatattcgtcactttcaggcttagctccgccatgggattcataccttgggcttcttgaaacgccattgttgccagcttattgtatacatcatgttgttagagatatagcccactggttctgaagtaaatgttgtttgtattattatgctgatgtaactgaatgaatctgagccattggatctagatagttgtggtagatctcgatcgtagattgggacaaatggattatgtattcgaaaatggggactaatgggccttagtataaatgggccacggcttaactcaatagtgttgccccacttgtttcgttagcttccacttgtagttgtacatcgtcgtcacgtggtagtgcgatattcgtatcggaaaaattaattgtttatc

SEQ ID NO: 1312 - DNA, 918 bp, Eutrema parvulum
gtagacaatattgtaacatcaacatatagtcaaccaatttcccgagacagagattacatattatgtaacgtagctacttaatgttttttaaacataatgatacacaaacagcctcaaatatagagactagtcctctacaaaagggtgcacctgttcatcaccaatctcaactggatcatcaccgttgatctggtcaagcacaaggaccaaacccatcgcaaaagctccgtcgaaaccgggtttgatctcgagagtgaacacatctcgtccaagcatcacgttcgttgacgcgtccactttgcgtttgatctcagccacaattcgcttctctgtgtcgtatatgaagcagtttcgttgcgagaagtctccgtcgatgatgtactcttctccggttccgtcgtaaacctctacttccatcgtgcaccgtccgattatcgacgatctccggacgctgaagatcggtttctgaccttccgatctctctccgagaaaaccttcccatctctggtgcagagtaggtctctttacctttcgtttaacggtgaggagacactttccggtagcgttcatgagcacaaactcatcgttatctctcgtgtcgggtccgtacgaatcgaccctgaagatgatatcgccgttacagtcgtaggcggcgaaaccatcgccggtgtagaagagagaagttttgcagacggtgagtggtttgtcttcttcgtagagataagctttgtccaccacaattctttttcccatcttatttccttctttttgaaaggtctcttcaactaattccatttttttttgtgtatgtgtgtgtttgcggaagttagatttttttttttgtggtttgattaacgaatgattatgaatttatgatatggacactcttctcctccttcctcaatgtctctatttata

SEQ ID NO: 1313 - DNA, 1042 bp, Arabidopsis lyrata
gaaggaagagaagagtgtccatatcatagattaaaaatcattcgttaagtaaaccacaaaatctaacttccacacacaaaacacacatacaaagaaaataaaaagaaaaaatggaattagttgaagagaccattccaaaagaagggaaaaagatgggagaaagaattgtggtggacaaagcttatctctaccaagaagacaaaccactcaccgtctgcaagacttctctcttctacaccggcgatggtttcgccgcctatgattgccacggtgatatcatcttcagggttgattcttatggacctgacacaagagataacgatgagattgtcctcatggacgctaccggaaagtgtctccttaccgttaaacgaaagagaccaactctacaccaaagatgggaaggttttctcggagagagatcggaaggtcagaaaccaatcttcagcgttcggagatcttcgataatcggacggtgtacgatggaagtagaagtttacgacggaacaggagaagagtacattattgatggagacttctcgcaacgaagctgtctcatatacgacacggagaaacgtactgtggctgagatcaaacgcaaagtagacgcgtcaacgaacgtgatgcttggtcgagatgtgttcactctagagattaaaccgggttttgatggcgctttcgctatgggtttggtcgttgtgcttgaccagatcaacggtgatgatccagttgagatcggtgatgaacaggtacacccttttgtagaggattaatctcccacctctcacaatggtcttcacgttaacatatcgaatctaatctttagtttttcaatctttggatttggaccatatgattatgggagtctgtttttatcattctgtgttaaatcatttaagttgctacgttacataatgttctagtctctgtctcgggaaatttgttgagtattatatgttgatgttacaaaattagttgtgtgttctaaatttgtgtacacacgctattagaaaatatcgtaaaattatgaagatccaaaatc

SEQ ID NO: 1314 - DNA, 1001 bp, Eutrema halophilum
gaaggggaggagaagagtgtccatatcataatcatttgtaaaatcaaaccacaaaatctaacttcctcgcacacacacacacacacaaaaaaaaaagagaagaaaatgggattagttgaagagaccttttcaaaagaagagaataatatgggaaaaagaattgtggtggacaaagcttatctctacgaagaagacaaaccactcacagtttgcaaaacctctctcttctccaccggcgatggtttcgccgcctacgactgtaacggcgatattatcttcagggtcgattcgtacggacccgatacaagagataacgatgagtttgtcctcatgaacgccaccggaaagtgtctcctcaccgttaaacgaaaggtaatagagaccgactctgcatcagagatgggaaggttttctcggcgagagatcggagggtcagaaaccgatcttcagcgtccggagatcgtcgataatcggacggtgtacgatggaagttgatgtttacgacggaaccggagaagagtacacgatcgatggagacttctcgctacgaagctgcctcatatacgacacggagaagcgaactgtggctgagatcaaacgcaaagtggacgcgtcaacgaacgtcatgcttggacgcgatgtgttcactctcgagattaaacccggtttcgacggagctttcgcgatgggtttggtccttgtgcttgaccagatcaacggtgatgatccggttgagattggtgatgaacaggtgcacccttttgttgaggattagtctctctctctttcacctctattaaacggtcaaatctatgttccggtttaacgaatcgaatctaaaatctttggggtttttccaatctttggattcggatatttgcggctgtttctgtatcattatgtgtaaaaaacataaagttgctacgttacatgataatatatagtctctgtctagaaatttgatttgactataagttgatgttacaaatctattctttcta

SEQ ID NO: 1315 - DNA, 974 bp, Raphanus sativus
  misc_feature (925)..(925): n is a, c, g, or t
gggtccatatcataatcattcgttaaacaaaccacaaaatctaaacttcctcacaccaaataaaaaaaatggaattagttgaagagaaggctccaaaagaagaaaacaagataggagaaagaagaattgtggtggacaaagcttatctctacgatgaagacaacccactgaccgtatgcaaaacctctctcttccacaccggcgatggtttcaccacctacgactgtaacggcgatatcatctttagggttgattcatacggaagagataacgacgagtttgtcctcatggacgccaccggaaagtgtctgctcaccgttaaacgcaagagaccgactctgcaccagagatgggaaggttttgtcggggagagacaagaaggtcagaaaccgatcttcagcgtccggagatcgtcgataatcggacggtgcacgatggaagtagaagtatacgacggaacaggagaagagtacacgatagacggtgacttctcgctacggaaatgcgtcatatacgacacggagaagcgaactgtggctgagatcaaacgcaaagtggacgcgtcaacgaacgtgatgcttggacgagatgtgttcactctcgagataaaacccggtttcgacggtgctttcgcgatgggtttggtcctcgtgcttgaccagatcaacggtgatgatccagttgagattggtgatgaacaagtacacccttttgtggaggattagtttcttcatctctcactttcacctcgtcaagtctttgttccggttttaaccaatcgaatcgaatctttgggttttgtcaaatctttggatttggacatttgaggttgtttgtatgtcatttaagttgttacgttacataatctatagtctctgtctcgtgaactttgttgactatatgttgatgttacaaagttcttgtntgctttctaattcatacatactacattatatcagaaattgttcaaacca

SEQ ID NO: 1316 - DNA, 1229 bp, Eutrema parvulum
taagagatatttcgtcgttaaaatatagaatatatacgcgtcgcgggcgtgtataaatagagacattgaggaaggaggagaagagtgtccatatcataaattcataatcattcgttaatcaaaccacaaaaaaaaaaatctaacttccgcaaacacacacatacacaaaaaaaaatggaattagttgaagagacctttcaaaaagaaggaaataagatgggaaaaagaattgtggtggacaaagcttatctctacgaagaagacaaaccactcaccgtctgcaaaacttctctcttctacaccggcgatggtttcgccgcctacgactgtaacggcgatatcatcttcagggtcgattcgtacggacccgacacgagagataacgatgagtttgtgctcatgaacgctaccggaaagtgtctcctcaccgttaaacgaaagagacctactctgcaccagagatgggaaggttttctcggagagagatcggaaggtcagaaaccgatcttcagcgtccggagatcgtcgataatcggacggtgcacgatggaagtagaggtttacgacggaaccggagaagagtacatcatcgacggagacttctcgcaacgaaactgcttcatatacgacacagagaagcgaattgtggctgagatcaaacgcaaagtggacgcgtcaacgaacgtgatgcttggacgagatgtgttcactctcgagatcaaacccggtttcgacggagcttttgcgatgggtttggtccttgtgcttgaccagatcaacggtgatgatccagttgagattggtgatgaacaggtgcacccttttgtagaggactagtctctatctctcacctctactaaacggtcaagtctttgttccggtttaacgaatcgaatctaatctttgggttttttatttcaaatctttggatttggacatttgaggctgtttgtgtatcattatgtttaaaaaacattaagtagctacgttacataatatgtaatctctgtctcgggaaattggttgactatatgttgatgttacaatattgtctacctttaattgatatatacattgtatcagaaaatgctttaaaatattatagatctagattcatacgttgacaatatgttgtaaaaaataacaataagatcatacgttataaaagtttataagcttacttaatactatgtatatggtattagtcgcaatatagatctatcgaagta

SEQ ID NO: 1317 - DNA, 1221 bp, Eutrema halophilum
taagagatatttcgacgttaaaatataaacgcgtcaagcgcgtgtatgtatataaatagaggcattgggaaggggaggagaagagtgtccatatcataatcatttgtaaaatcaaaccacaaaatctaacttcctcgcacacacacacacacacaaaaaaaaaagagaagaaaatgggattagttgaagagaccttttcaaaagaagagaataatatgggaaaaagaattgtggtggacaaagcttatctctacgaagaagacaaaccactcacagtttgcaaaacctctctcttctccaccggcgatggtttcgccgcctacgactgtaacggcgatattatcttcagggtcgattcgtacggacccgatacaagagataacgatgagtttgtcctcatgaacgccaccggaaagtgtctcctcaccgttaaacgaaagagaccgactctgcatcagagatgggaaggttttctcggcgagagatcggagggtcagaaaccgatcttcagcgtccggagatcgtcgataatcggacggtgtacgatggaagttgatgtttacgacggaaccggagaagagtacacgatcgatggagacttctcgctacgaagctgcctcatatacgacacggagaagcgaactgtggctgagatcaaacgcaaagtggacgcgtcaacgaacgtcatgcttggacgcgatgtgttcactctcgagattaaacccggtttcgacggagctttcgcgatgggtttggtccttgtgcttgaccagatcaacggtgatgatccggttgagattggtgatgaacaggtgcacccttttgttgaggattagtctctctctctttcacctctattaaacggtcaaatctatgttccggtttaacgaatcgaatctaaaatctttggggtttttccaatctttggattcggatatttgcggctgtttctgtatcattatgtgtaaaaaacataaagttgctacgttacatgataatatatagtctctgtctagaaatttgatttgactataagttgatgttacaaatctattctttctatttaaaaacaaaaaaaaacaaatcactgtattataaaatgtcttagaaatctgtagatctggtcatctagatttatccgttgaccagagtatatgattgtagaaataatacgctaatcatacgttataaaaaatttcaagttcaaataatatatgtagt

SEQ ID NO: 1318 - DNA, 940 bp, Thellungiella halophila
ggtgtccatatcataatcatttgtaaaatcaaaccacaaaatctaacttcctcgcacacacacacacacacaaaaaaaaaagagaagaaaatgggattagttgaagagaccttttcaaaagaagagaataatatgggaaaaagaattgtggtggacaaagcttatctctacgaagaagacaaaccactcacagtttgcaaaacctctctcttctccaccggcgatggtttcgccgcctacgactgtaacggcgatattatcttcagggtcgattcgtacggacccgatacaagagataacgatgagtttgtcctcatgaacgccaccggaaagtgtctcctcaccgttaaacgaaagagaccgactctgcatcagagatgggaaggttttctcggcgagagatcggagggtcagaaaccgatcttcagcgtccggagatcgtcgataatcggacggtgtacgatggaagttgatgtttacgacggaaccggagaagagtacacgatcgatggagacttctcgctacgaagctgcctcatatacgacacggagaagcgaactgtggctgagatcaaacgcaaagtggacgcgtcaacgaacgtcatgcttggacgcgatgtgttcactctcgagattaaacccggtttcgacggagctttcgcgatgggtttggtccttgtgcttgaccagatcaacggtgatgatccggttgagattggtgatgaacaggtgcacccttttgttgaggattagtctctctctctttcacctctattaaacggtcaaatctatgttccggtttaacgaatcgaatctaaaatctttggggtttttccaatctttggattcggatatttgcggctgtttctgtatcattatgtgtaaaaaacataaagttgctacgttacatgataatatatagtctctgtctagaaaaaaa

SEQ ID NO: 1319 - DNA, 1198 bp, Brassica rapa
  misc_feature (66)..(66): n is a, c, g, or t
catatcataatcattcgttgatcaactacaaaatctaacttccaccaaagaaaagaaaatggaatnagttgaagagatgggtgaaaaaagagttgtggtggacaaagcatatatctacgaagaagacaaaccacttactgtctgcaaaacctctcttttctacactggtgatggcttcgccgcctacgactgtcacggcgatatcatctttagggtcgattcatacggacccgacacaagagataacgacgagtttgttctcatggatgtcgccggaaagtgtctcctcaccgttaaacgaaagagaccaactctgcaccaaagatgggaaggttttctcggggagagatcagacggtcagaaaccaatattcagtgtccgaagatcgtcaataatcggacggtgcacgatggaagtagaggtttacgacggaacaggagaagagtacaccatagatggtgacttctcgcaacgtagctgcctcatatacgacacgaataagcgaactgtggctgagatcaaacgcaaagtggacgcgtcaacgaacgtgatgcttggacgagatgtgttcactctcgagattaaacctggtttcgacggggctttcgtgatgggtttggtccttgtgcttgaccagatcaacggtgatgatccagttgagattggtgatgaacaggtgcacccttttgttgaggactagtctctgacatttgaggttgtttgtgtatcattatgtgtaaaaacataaagttgctacgttacataatatatagtccgtctcttgaaatttgttgactatatatatatgtgatgtttaaaaaaataaaagagatgtgatgttgatttttttacactgtaagacactttctatctttcgaattactttcttagacactgtttatcgttaaccggtcttcttgggtttctctcagataataaaaaacataacttgatagtacacaaacctccacaggttctatttacagacaagggatctaaaagtgtgttcgtttcaagcttgcccatgtctgtatcttcttcattagcaccttaaaatgttgttccttttagggtctttcttcatattcacatggctgaagtactgaacaaggcatagagcgccattgacccccattgttgttgatctcgccatttgaagttgatgtgggtattccctcagttgatgttcttcgagatg

SEQ ID NO: 1320 - DNA, 1030 bp, Brassica napus
ggtccatatcataatcattcgttgatcaaactacaaaatctaacttccaccaaagaaaagaaaatggaattagttgaagagatgggtgaaaaaagagttgtggtggacaaagcatatctctacgaagaagacaaaccacttactgtctgcaaaacctctcttttctacactggtgatggcttcgccgcctacgactgtcacggcgatatcatctttagggtcgattcatacggacccgacacaagagataacgacgagtttgtcctcatggatgtcgccggaaagtgtctcctcaccgttaaacgaaagagaccaactctgcaccaaagatgggagggttttctcggggagagatcagacggtcagaaaccaatattcagcgtccgaagatcgtcaataatcggacggtgcacgatggaagtagaggtttacgacggaacaggagaagagtacaccatagatggtgacttctcgcaacgtagctgtctcatatacgacacgaataagcgaactgtggctgagatcaaacgcaaagtgaacgcgtcaacgaacgtgatgcttggacgagatgtgttcactctcgagattaaacctggtttcgacggagctttcgtgatgggtttggtccttgtgcttgaccagatcaacggtgatgatccagttgagattggtgatgaacaggtgcacccttttgttgaggactagtcgctgatctttggatttggacatttgaggtactgtttgaggttgtttgtgtatcatttatgtgtaaaaacataaagttgctacgttacataatatatagtccgcctctggaaatttgttgactatatatatgtgatgtttaaaaaaataaaagagatgtgatgttttacaagtttactttgtctacttttaaattatatatacactatatcagaaaatgttttaaaattaaaaaaaaaaaaaaaaaaagggcagccgctcgcgatgaagaactagcggacgcttcctcgacccaatattccggaccggtaccgcaggcgtccgt

SEQ ID NO: 1321 - DNA, 1117 bp, Brassica napus
ggtccatatcataatcattcgttgatcaaactacaaaatctaacttccaccaaagaaaagaaaatggaattagttgaagagatgggtgaaaaaagagttgtggtggacaaagcatatctctacgaagaagacaaaccacttactgtctgcaaaacctctcttttctacactggtgatggcttcgccgcctacgactgtcacggcgatatcatctttagggtcgattcatacggacccgacacaagagataacgacgagtttgtcctcatggatgtcgccggaaagtgtctcctcaccgttaaacgaaagagaccaactctgcaccaaagatgggagggttttctcggggagagatcagacggtcagaaaccaatattcagcgtccgaagatcgtcaataatcggacggtgcacgatggaagtagaggtttacgacggaacaggagaagagtacaccatagatggtgacttctcgcaacgtagctgtctcatatacgacacgaataagcgaactgtggctgagatcaaacgcaaagtgaacgcgtcaacgaacgtgatgcttggacgagatgtgttcactctcgagattaaacctggtttcgacggagctttcgtgatgggtttggtccttgtgcttgaccagatcaacggtgatgatccagttgagattggtgatgaacaggtgcacccttttgttgaggactagtcgctgatctttggatttggacatttgaggtactgtttgaggttgtttgtgtatcatttatgtgtaaaaacataaagttgctacgttacataatatatagtccgcctctggaaatttgttgactatatatatgtgatgtttaaaaaaataaaagagatgtgatgttttacaagtttactttgtctacttttaaattatatatacactatatcagaaaatagttttaaatttagattgttagatcatattaaatagttttgttaagaaagaacagtttgtatcttaccctaaaaactaattttgggtaagttagtttcgtatagccactaaaaaaactaaactatcttctcttttcttcctttgttcactcttcttttctttctactatctctctaactcatagttagtattc

SEQ ID NO: 1322 - DNA, 913 bp, Raphanus sativus
gggtccatatcataatcattcgttaatcaaaccacaaaatctaacttccaccaaaggaaaaaaagaatggaattagttgaagagatgggtgaaaaaagagttgtggttgacaaagcttttctctacgaagaagacaaaccacttaccgtctgcaaaacctctctgttccacaccggtgatggtttcgccgcctacgactgtcacggcgatatcatctttagggtcgattcatacggacccggcacaagagatgacgatgagtttgtcctcatggacgtcaccggtaactgtctcctcaccgttaaacgaaagaggccgactcttcaccagagatgggaaggttttctcggggagagatcagatggccagaaaccgatcttcagtgtccggagatcgtcgataatcggacggtgcacgatggaagtagaggtttacgacgaaaccggagaagagtacaccatagatggtgacttctcgcaacgaagctgtctcatatacgacacgaagaagcgaactgtggctgagatcaaacgcaaagtggacgcgtcaacgaacgtgatgcttggacgtgatgtgttcactctagagattaaacctggtttcgacggcgctttcgcgatgggtttggtccttgtgcttgaccaaattaacggtgatgatccagttgagattggtgatgaacaggtgcacccttttgtagaggacatttgaagctgtttgtgtatcattatgtgtaaaaacacaaagttgttacgttgcatattatatagcctgtctctataaatttgttgactatatgtgatattttacaagtttattttgtcaactaattttatgatatatacagaaactgttttaaagtttgatttgtagatctagattcatatgttgaccattataaactgtttctaga

SEQ ID NO: 1323 - DNA, 965 bp, Brassica oleracea
ataatcattcgttaatcaaattgcaaaatctaacttccgcacacccacaaaggccacacaccaaataaaaaaaatggaattagttgaagagaagaaggctccaaaagaagaaaagaagatgggagaaagaagagttgtggtggacaaagcttatctatacgatgaagacaaaccacttaccgtctgcaaaacatctctcttccacaccggcgatggtttcaccgcctacgactgtaacggcgatatcatctttagggtcgattcctacggtagagataacgacgagttggtcctcatggacgccaccggaaagtgtctcctcaccgttaaacgcaagagacctactctgcatcagaggtgggaaggttttctcggggagagatcggagggtcagaaaccgatcttcagcgttcggagatcgtcgataatcgggcggtgcacgatggaagtagaagtatacgacggaagcggagaagagtacaccatagacggcgacttctccttacgaagctgtctcatatacgacacggagaagcgaaccgtggctgagatcaaacgcaaagtggacatgtcaacgaacgtgatgcttggacgagatgtgttcgctctcgagatcaaacccggtttcgacggcgctttcgcgatgggtttggtcctcgtgcttgaccagatcaacggtgatgatcccgttgagattggtgatgaacaagtacacccttttgtcgaggattagtttctctctatctctcactttcacctcgtcaagtctttgttcaggttttaaaccaatcgaatctaatctttgggttttgtcaaatctttggatttggacatttgaggttgtttgtatgtcagtcattaatgttgttacgttacataatatatagtctatgtctcgtgaactttgttgactatatgttgatgttacaaagttcttgtcttctttttaatagatgtatacatgc

SEQ ID NO: 1324 - DNA, 976 bp, Brassica napus
atatcataatcattcgctaatcaaattacaaaatctaacttccgcacacccacaaggccacacaccaaatattaaaaaatggaattagttgaagagaagaaggctccaaaagaagaaaagaagatgggagaaagaagagttgtggtggacaaagcttatctatacgatgaagacaaaccacttaccgtctgcaaaacatctctcttccacaccggcgatggtttcaccgcctacgactgtaacggcgatatcatctttagggtcgattcctacggtagagataacgacgagtttgtcctcatggacgccaccggaaagtgtctcctcaccgttaaaagcaagagacctactctgcatcagaggtgggaaggttttctcggggagagatcggacggtcagaaaccgatcttcagcgttcggagatcgtcgataatcggacggtgcacgatggaagtagaagtatacgacggaagcggagaagagtacaccatagacggcgacttctccttgcgaagctgtctcatatacgacacggagaagcgaaccgtggctgagatcaaacgcaaagtggacatgtcaacgaacgtgatgcttggacgagatgtgttcactctcgagatcaaacccggtttcgacggcgctttcgcgatgggtttggtcctcgtgcttgaccagatcaacggtgatgatcccgttgagattggtgatgaacaagtacacccttttgtcgaggattagtttctctctatctctcactttcacctcgtcaagtctttgttccggttttaaaccaatcgaatctaatctttgggttttgtcaaatctttggatttggacatttgaggttgtttgtatgtcagtcattaatgttgttacgttacataatatatagtctctgtctcgtgaactttgttgactatatgttgatgttacaaagttcttgtcttctttttaattcatatatacatgcatcata

SEQ ID NO: 1325 - DNA, 908 bp, Brassica rapa
  misc_feature (79)..(80): n is a, c, g, or t
agtgtccatatcataatcattcgctaatcaaattacaaaatctaacttccgcacacccacaaggccacacaccaaatannaaaaaatggaattagttgaagagaagaaggctccaaaagaagaaaagaagatgggagaaagaagagttgtggtggacaaagcttatctatacgatgaagacaaaccacttaccgtctgcaaaacatctctcttccacaccggcgatggtttcaccgcctacgactgtaacggcgatatcatctttagggtcgattcctacggtagagataacgacgagtttgtcctcatggacgccaccggaaagtgtctcctcaccgttaaaagcaagagacctactctgcatcagaggtgggaaggttttctcggggagagatcggacggtcagaaaccgatcttcagcgttaggagatcgtcgataatcggacggtgcacgatggaagtagaagtatacgacgaaagcggaaaagagtacaccatagacggcgacttctccttgcgaagctgtctcatatacgacacggagaagcgaaccgtggctgagatcaaacgcaaagtggacatgtcaacgaacgtgatgcttggacgagatgtgttcactctcgagatcaaacccggtttcgacggcgctttcgcgatgggtttggtcctcgtgcttgaccagatcaacggtgatgatcccgttgagattggtgatgagcaagtacacccttttgtcgaggattagtttctctctatctctcactttcacctcgtcaagtctttgttccggtttaaaccaatcgaatctaatctttgggttttgtcaaatctttggatttggacatttgaggttgtttgtatgtcagtcattaatgttgttacgttacataatatagtctctgtctcgc

SEQ ID NO: 1326 - DNA, 988 bp, Brassica napus
gggagagtgtccatatcataatcattcgctaatcaaattacaaaatctaacttccgcacacccacaaggccacacaccaaatattaaaaaatggaattagttgaagagaagaaggctccaaaagaagaaaagaagatgggagaaagaagagttgtggtggacaaagcttatctatacgatgaagacaaaccacttaccgtctgcaaaacatctctcttccacaccggcgatggtttcaccgcctacgactgtaacggcgatatcatctttagggtcgattcctacggtagagataacgacgagtttgtcctcatggacgccaccggaaagtgtctcctcaccgttaaaagcaagagacctactctgcatcagaggtgggaaggttttctcggggagagatcggacggtcagaaaccgatcttcagcgttcggagatcgtcgataatcggacggtgcacgatggaagtagaagtatacgacgaaagcggaaaagagtacaccatagacggcgacttctccttgcgaagctgtctcatatacgacacggagaagcgaaccgtggcagagatcaaacgcaaagtggacatgtcaacgaacgtgatgcttggacgagatgtgttcactctcgagatcaaacccggtttcgacggcgctttcgcgatgggtttggtcctcgtgcttgaccagatcaacggtgatgatcccgttgagattggtgatgagcaagtacacccttttgtcgaggattagtttctctctatctctctcactttcacctcgtcaagtctttgttccggtttaaaccaatcgaatctaatccttgggttttgtcaaatctttggatttggacatttgaggttgtttgtaatgtcagtcattaatgttgttacgttacataatatatagtctctgtctcgtgaactttgttgactatatgttgatgttctccaaatatgggtctctgtctcgtgaactgtgtgacaatgtg

SEQ ID NO: 1327 - DNA, 734 bp, Brassica napus
ctacgaagaagacaaaccacttactgtctgcaaaacctctcttttctacactggtgatggcttcgccgcctacgactgtcacggcgatatcatctttagggtcgattcatacggacccgacacaagagataacgacgagtttgttctcatggatgtcgccggaaagtgtctcctcaccgttaaacgaaagagaccaactctgcaccaaagatgggaaggttttctcggggagagatcagacggtcagaaaccaatattcagtgtccgaagatcgtcaataatcggacggtgcacgatggaagtagaggtttacgacggaacaggagaagagtacaccatagatggtgacttctcgcaacgtagctgcctcatatacgacacgaataagcgaactgtggctgagatcaaacgcaaagtggacgcgtcaacgaacgtgatgcttggacgagatgtgttcactctcgagattaaacctggtttcgacggggctttcgtgatgggtttggtccttgtgcttgaccagatcaacggtgatgatccagttgagattggtgatgaacaggtgcacccttttgttgaggactagtctctgacatttgaggttgtttgtgtatcattatgtgtaaaaacataaagttgctacgttacataatatatagtccgtctcttgaaatttgttgactatatatatatgtgatgtttaaaaaaataaaagagatgtgatgtttacaagt

SEQ ID NO: 1328 - DNA, 1809 bp, Arabidopsis lyrata
gtttaagaaagaatggaaggtacagacgatgcttgtgcacttcaagagcctcctgaccccgaagtgctcgaagttgatccaacttttcgatatatacggtataaagaggttattggaaaaggcgcattcaagactgtttataaggcattcgatgaagtagatgggattgaagtcgcttggaaccaagtacgaatagatgatgttttgcagtcaccgaattgccttgagaggctgtattctgaagtgcgtctgttgaaatcattgaagcacaataatattattaggttctataattcatggatcgatgataagaacaagacagttaacataataactgagctattcacttcagggagcctccgacactaccgcaagaaacacaggaaggtgaacatgaaggccgtgaagaattgggcgaggcagattttaatgggtttgagatatcttcacggtcaagagccaccgattatacatcgggatctcaaatgcgataacatttttatcaatggaaaccatggagaagtgaaaataggagatcttggtctagccactgtcatggagcaagctaacgccaaaagtgtgattggaaccccggagtttatggcacccgagctttacgatgagaactacaacgaattggctgatatttattcatttgggatgtgtatgttggagatggtgacatttgaatatccctactgtgaatgcaaaaactctgctcagatatacaagaaggtttcatcgggaataaaacctgcttcactctccagggttaaagacccagaagtaaaacagtttattgagaaatgcttacttcctgcatccgagaggctgtcagcaaaagagcttttactggacccttttctgcaactaaatggtttaacaatgaacaatcctttgccgcttcccgacattgtaatgcccaaagaaggcgcatttggagaccgttgccttatgtctgaaggccctcctacaacacggcctagtaaaaccttgtctatagatctcgatgaagacagtaacctgcctattgttacttttagcgacaattcaggatccaggtgtattgaggttagacgcgcaaagagaggaaatttctttgtcctcaagggtgaagaaaatgatgagcagtctgtgtccctaattcttcgtatagtagatgagaatgggcgtgtaaggaacattcattttctgttctatcaagaaggtgacactgcttctaaggtgtcgagtgagatggttgagcaactcgagttaactgaccagaacgtcacgtttatagccgagctgattgatatactactcgtcaacatgatacccacctggaaaactgatgtcacagtcgatcatctcatccattcgcaactgaatcagaactcaagaagtcatcataacgaagcaaagccacagaaacaagaggagactactttccatgatgcttgtgagtcggttagtcactcgtggaactcagattgcccacgatcagaagaggaagataagcaatgcgtcgatgccaccaaaggagaaaacgggagctccaatcaagaagcagaagaagcaaccgaaccagtaagtttggaggaagaagaaaggttaagacaggaactggaggagatagaagctaagtatcaggaagagatgaaagagatagcaacgaaaagagaagaagccattatggagacaaagaaaaagttgtctctcatgaagctgaagtaaaagccaaaaagctcaaacaaatcaaagacgctcttcgttaactttttttcttaatctctgtgtttaatttgttggttggagaagaagaagaag

SEQ ID NO: 1329 - DNA, 1912 bp, Eutrema halophilum
gtggattcttttcaaggtgtaggaaagtatggatggctcagaggatgcttctgtacttcaagagcctcctgacccagaagtgctcgaagttgatccaacttatcgctatataaggtataaagaggttatcggaaaaggcgcattcaagacagtgtataaggcattcgatgaagtagatggaattgaagtcgcgtggaaccaagttcgaatagatgatgttttgcagtcaccgaattccttggagaggctgtattctgaagtgcgtcttttgaaatcactgaagcacagtaatatcattaggttctataactcatggatcgatgataagaacaagacagttaacataattaccgagctattcacttcagggagcctcagacattaccgtaagaaacacagaaaggtgaatatgaaggccgtgaagtgttgggcgagacagattttaatgggtctgagatatcttcatagtcaagagccaccgattatacatcgggatctcaaatgtgataacatctttatcaatggaaatcatggagaagtgaaaataggagatcttggtcttgccactgtgatggagcaagctaatgccaaaagtgtgattggaacccccgagtttatggcacccgagctttacgatgagaactacaacgagctggctgatatttattcatttgggatgtgtatgttggagatggtgacatttgaatacccttactgtgaatgcagaaactctgctcagatatacaagaaggtctcatcgggaataaaacctgcttcactctctagggttcaagacccagaagtaaagcagtttattgagaaatgcttgcttcctgcatccgagaggctgtcagcaaaagagcttctattggacccttttcttcatgtgaatggtttaacaatgaacaaccctttgccacttccggacattgtaatgcccaaagaaggtgcgtttggagaacgttgccttatgtctgaaggccctcctacaacacggcgtagtagagccatgtctatagatctcgatgaagacaacaacctgccgattgttacttttagcgacaactctggatccaggtgtattgaggtcagacgtgcaaagagagggaatttttttgtcctcaagggtgaagaaaacgatgaacactctgtgtcgctaattcttcgtatagtagatgagaatggacgtgtgaggaacattcatttcctgttctatcaagacggtgacactgcttccaaggtgtcgagtgagatggttgagcaactcgagttaactgaccagaacgtcacgtttatagctgaactgattgatatattacttgtcaacatgatacccacctggaaaaccgatgtcacagtcgatcatctcattcattcgcaactgaatcagagttcaagaagtcaccagaacgaagcaaagccacagaaacaagaggagaccgcttttcatgatgcttgtgagtcggttagtcactcttggacctcggattgtccacgatcagacgaggaagataagcagggtgtggatgccattaaaggagaggacgggagctccaatcaagaagcagaagaagcaacggaaccagcaagtgtggaggaagaagaaagtttaagacaggaactggaggagatagaagctaagtatcaggaagaaatgaaagagatcgcaaagaaaagagaagaagcaataatggagacaaagaaaaagctgtcactgaagaaagtagaacaagctgagtagccaaaaaacacggcaaagacgccctttgttttttctgctttatgagttgatttgttcgtaagaagaagaagcacttcgcttaggatgaagagtttctatgcgttttactgtttcttcattgtggttgaggattttgatttggtagaatgattatacggatgatgttagaaa

SEQ ID NO: 1330 - DNA, 2066 bp, Brassica napus
ccccagattattttttctcaattagggttttctgatcattgttcctctccgtctccttctcacgttggcgatttgatcataaacacagcaaacgcttcatctctaggtggataccttttcaaattgtgagaataatatggaaggtgcggaggatactgctccaattcatgagcctcctgaccctgaagtcctcgaagttgatcctactcttcgttatattcggtataaagaggttatcggaaaaggcgctttcaagacagtttacaaggctttcgatgaagttgatgggattgaagtcgcgtggaaccaagtccgaattgatgatgttttgcagtctccaaactccttggagaggctctactctgaagtgcgtcttttgaaatcgttgaagcacagtaacatcatcaggttctataactcttggatcgatgataagaacaagactgttaacatcataactgagcttttcacttcagggagtctcaggcattaccgcaagaaacacaggaaggtgaatatgaaggccgtcaagtgttgggcgagacagattttaatgggtttgagatatctccacactcaagtgccacccattatacacagagatctcaagtgcgataacatctttatcaatggcaaccatggagaagtcaaaataggagatcttggcctagccactgtcatggagcaagctcatgccaagagtgtcattggaacccctgagtttatggcacctgagctttacgatgagatctacaccgagctagctgatatctattcatttgggatgtgtatgttggagatggtgacatttgaatacccatattgtgagtgcagaaactctgctcagatctacaagaaggtctcatcggggataaaacctgcctcactctccagggttcaagacccagaagtaaagcagttcattgagaagtgcttactccctgcatccgagaggctatcagccaaagagcttctattggacccttttcttcaggtgaatggtttaacgatgaacaaccctctgccactacccgacattgtaatgcctaaagaaggtgcgtttggagagcgttgccttatgtctgaaggccctcctgcaacacggcctagtaaacccacgtctatggatctcgatgaagacagtaacctgccgattgttacttttagcgacaactcgggatccaggtgtatcgaggtcagacgcgcaaagagagggaatttctttgtcctcaagggtgaagaaaacgatgagcagtctgtctcgctgattcttcgtatagtcgatgagaatggacgagtgaggaacattcatttcctgttctatcaagaaggtgacactgcttccaaggtgtcgagtgagatggttgagcaactcgagttaactgaccagaacgtcacgtttatagcggaactgatcgacatactgcttgtcaacatgatacccacatggaaaactgatgtcacggtcgatcatctcatccattcgcagcttaatcagagctcgagaagtcatcagaacgaagctaagccacagagtcaagaggagagcacttttcacgatgcttgcgagtcggttagacactcttggacttcggattgcccacgttcagaagaggaggaaaagcagtttgtcgatgcaattaaaggagaaaacgggagtgacaaccaagaagcagaggaggcaaccgaaccggtgagtttggaggaagaagagaggttaagacaggaactggaggagatagaggctaagtatcaggaagagatgaaagagatagcaaagaaaagagaagaagcaataatggagacgaagagaaagttatctcagaagaaggtagaacaagctggttaagtagttaaaaaaaaaaacaacacaacaaagacatcattggtggttttcttttttattttccgagtttaatttgtttcttgaacaagaacaagcacttcgctctccctgaaaagtgtagaaagtttcctacagtgtgaagagttttgcattgttttgttgtttcttaaatgttggaggttggaagcttttttgatttcgtcaaatgatgttagaacat

SEQ ID NO: 1331 - DNA, 2026 bp, Brassica napus
ggtccggaattccgggtcacccacgcgtccgacaaacacttgttggttctattcccccagattatttttttctcaattagggttttctgatcattgttcctctccgtctccttctcacgttggcgatttgatcataaacacagcaaacgcttcatctctaggtggataccttttcaaattgtgagactaatatggacggtgcagaggatgctgctccaattcatgagcctcctgaccctgaagtcctcgaagttgatcctactcttcgttatattcggtataaagaggttatcggaaaaggcgctttcaagacagtttacaaggctttcgatgaagttgatgggattgaagtcgcgtggaaccaagtccgaattgatgatgttttgcagtctccaaactccttggagaggctctactctgaagtgcgtcttttgaaatcgttgaagcacagtaatatcatcaggttctacaactcgtggatcgatgataagaacaagactgttaacatcattactgagcttttcacttcagggagtctcaggcattaccgcaagaaacacaggaaggtgaatatgaaggccgtcaagtgttgggcgagacagattttaatgggtttgagatatctccacactcaagtgccacccattatacacagagatctcaagtgcgataacatctttatcaatggcaaccatggagaagtcaaaataggagatcttggcctagccactgtcatggagcaagctcatgccaagagtgtcattggaacccctgagtttatggcacctgagctttacgatgagatctacaccgagctagctgatatctattcatttgggatgtgtatgttggagatggtgacatttgaatacccatattgtgagtgcagaaactctgctcagatctacaagaaggtctcatcggggataaaacctgcctcactctccagggttcaagacccagaagtaaagcagttcattgagaagtgcttactccctgcatccgagaggctatcagccaaagagcttctattggacccttttcttcaggtgaatggtttaacgatgaacaaccctctgccactacccgacattgtaatgcctaaagaaggtgcgtttggagagcgttgccttatgtctgaaggccctcctgcaacacggcctagtaaacccacgtctatggatctcgatgaagacagtaacctgccgattgttacttttagcgacaactcgggatccaggtgtatcgaggtcagacgcgcaaagagagggaatttctttgtcctcaagggtgaagaaaacgatgagcagtctgtctcgctgattcttcgtatagtcgatgagaatggacgagtgaggaacattcatttcctgttctatcaagaaggtgacactgcttccaaggtgtcgagtgagatggttgagcaactcgagttaactgaccagaacgtcacgtttatagcggaactgatcgacatactgcttgtcaacatgatacccacatggaaaactgatgtcacggtcgatcatctcatccattcgcagcttaatcagagctcaagaagtcatcagaacgaagctaagccacagagtcaagaggagagcacttttcacgatgcttgcgagtcggttagacactcttggacctcggattgcccacgttcagaagaggaggaaaagcagtttgtcgatgcaattaaaggagaaaacgggagtgacaaccaagaagcagaggaggcaaccgaaccggtgagtttggaggaagaaaagaggttaagacaggaactggaggagatagaggctaagtatcaggaagagatgaaagagatagcaaagaagagagaagaagcaataatggagacaaagaggaagttatctcagaagaaggtagaacaagctggttaagtagttaaaaaaaaaaaaaacacaacaaagacatcattggtggttttcttttttatttttcgagtttaatttgtttcttgaacaagcacttcgctctccctgaaagtgtagaaagtttccta

SEQ ID NO: 1332 - DNA, 2090 bp, Brassica napus
ggtccggaattccgggtcacccacgcgtccgacaaacacttgttggttctattcccccagattatttttttctcaattagggttttctgatcattgttcctctccgtctccttctcacgttggcgattttgatcataaacacagcaaacgcttcatctctaggtggataccttttcaaattgtgagactaatatggacggtgcagaggatgctgctccaattcatgagcctcctgaccctgaagtcctcgaagttgatcctactcttcgttacattcggtataaagaggttatcggaaaaggcgctttcaagacagtttacaaggctttcgatgaagttgatgggattgaagtcgcgtggaaccaagtgcgaatagatgatgttttgcagtctccaaactccttggagaggctctactccgaagtgcgtcttttgaaatcgttgaagcacagtaatatcatcaggttctacaactcgtggatcgatgataagaacaagactgttaacatcattactgagcttttcacttcagggagtctcaggcattaccgcaagaaacacaggaaggtgaatatgaaggccgtcaagtgttgggcgagacagattttaatgggtttgaggtatctccacactcaagtgccacccattatacacagagatctcaagtgcgataacatctttatcaatggcaaccatggagaagtcaaaataggagatcttggcttagccactgtcatggagcaagctcatgccaagagtgtcattggaaccccagagtttatggcacctgagctgtacgatgagatctacaccgagctagctgatatctattcatttgggatgtgtatgttggagatggtgacatttgaatacccgtattgtgaatgcagaaactctgctcagatctacaagaaggtctcatcgggaataaaacctgcctcactctccagggttcaagacccagaagtaaagcagttcattgagaagtgcttactccctgcatccgagaggttatcagcaaaagagcttttattggacccttttcttcaagtgaatggtttaacgatgaacaaccctctgccactacccgacattgtaatgcctaaagaaggtgcgtttggagaacgttgccttatgtctgaaggccctcctgcaacacggcctagtaaacccacgtctatggatctcgatgaagacagcaacctgccgattgttacttttagcgacaactcggggtccaggtgtatcgaggttagacgcgcaaagagagggaacttcttcgtcctcaagggtgaagaaaacgatgagcagtctgtctcgctgattcttcgtatagtcgatgagaatggacgagtgaggaacattcatttcctgttctatcaagaaggtgacactgcttccaaggtgtcgagcgagatggttgagcaactcgagttaactgaccagaacgttacgtttatagcggaactgatcgacatactgcttgtcaacatgatacccacgtggaaaactgatgtcacggtcgatcatctcatccattcgcagcttaatcagagctcaagaagtcatcagaacgaagctaagccgcagagtcaagaggagagcacttttcacgatgcttgcgagtcggttagacactcttggacctcggattgcccacgttcagaagaggaggaaaagcagtttgtcgatgcaattaaaggagaaaacgggagtgacaaccaagaagcagaggaggcaaccgaaccggcgagtttggaggaagaaaagaggttaagacaggaactggaggagatagaggctaagtatcaggaagagatgaaagagatagcaaagaagagagaagaagcaataatggagacgaagagaaagttatctcagaagaaggtagaacaagctggttaagtagttaaaaaaaaaaaaacacaacaaagacatcattggtggttttcttttttatttttcgagtttaatttgtttcttgaacaagcacttcgctctccctgaaagtgtagaaagtttcctacagtgtgaagagttttgcattgttttgttgtttcttaaatattggaggttgaagctttttttat

SEQ ID NO: 1333 - DNA, 1903 bp, Brassica napus
atggatggttcagaggatggtgcggttcttcaagagcctcctgacccggaggtgctcgaagttgatccaacaaatcgatatatacggtataaagaggttatcggaaaaggcgcattcaagactgtttacaaggccttcgatgaagtagatgggattgaagtagcgtggaaccaagtacgaatagatgatgttttgcagtcaccaaactccctggagaggctatactctgaagtgcgtcttttgaaatcattgaagcacagtaatatcatcaggttctataactcatggatcgatgataagaacaagacagttaacatcataactgagcttttcacttcagggagtctcagaaattaccgcaagaaacaccgaaaggtgaacatgaaggcggtcaagtgttgggcgagacagatactaatgggtttgagatatcttcacactcaagtgccacccattatccacagggatctcaaatgtgataacatctttatcaatggaaaccatggagaagtgaagataggtgatcttggtctagccactgtcatggagcaagctaacgccaaaagtgtcattggaaccccagagttcatggcacctgagctttacgatgaggactacaccgagctagctgatatctattcatttgggatgtgtatgttggagatggtgacgtttgagtacccatactgtgaatgcaaaaactctgctcagatatacaagaaggtctcatcgggaataaaacctgcttcactctctagagttcaagaccctgaagtaaagcagttcattgagacatgcttacttcctgcatcagagaggttatcagcaaaggagcttctcttggatcctttccttcaagtgaatggtttaacgatgaacaaccctttgcctcttcctgacattgtaatgcctaaagaaggcgcgtttggagagcgttgtcttatgtctgaaggccctcctacaacacggtgtagtagatccatgtctattgatcttgatgaagacaacaacctgcctattgttacgtttagtgacaactcagggtctaggtgtattgaggttagacgtgcgaagagagggaacttctttgtactcaagggtgaagaaaatgatgaacactctgtctcgttgattctacgaatagtagatgagaatggaagagtgaggaacattcatttcttgttctatcaagaaggtgacactgcttctaaggtgtcgagtgagatggttgagcagcttgagttaactgaccagaacgtcacgtttatagccgaactaattgatattctccttgtcaacatgatacccacgtggaaaactgatgttacggttgatcatctcattcactcgcaactgaatcagagctcaagaagccatcagaatgcacatagacaagaggagagtgctgcttttcatgacgcttgtgaatcggttcgacactcgtggaactctgattgtcgaaggtcggaggaggaatataagcagtgtgtggatggtgttaaaggggaagacgggagccgcaatcaagaagaagcagaggaggcaattgatccggtgaggttggaggaggaagagaggttgagagaggaactggaggagatagaagctaagtatcgggaagagatgaaagagataggaaggagaagagaagaagcgataatggagacaaggaaaaggttgtctcagaagaagacagaacaggttgaatgagtagcttaagaatacaacaaagacgtcactggtggtttttcttttcagagttaatttgtttcttgaacgccaagaaaacacttggctccctgaaagtgtagagtttatcagcgtctggttgtttcttaatggttgtggttaaagatttttgtatatggttcggatgttatgaacacaaggatgatgttagaaa

SEQ ID NO: 1334 - DNA, 1956 bp, Eutrema parvulum
gtggaaacttttcaaggtgtaggaaagtatggatggttcagaggatgctgctgttcttcaagagcctcctgaccccgaagtgctcgaagttgatccaacttatcgatatatacggtataaggaagttattggaaaaggcgcattcaagacagtttataaggcatttgatgaagtagatgggattgaagtcgcgtggaaccaagtacgaatagatgatgttttgcagtcaccgaattccctggagaggctgtattctgaagtacgtcttttgaaatcattgaagcacagtaatatcattagattctataactcatggatcgatgataagaacaagacagttaacataataacggagctgttcacttcagggagtctcagacattaccgtaagaaacacagaaaggtgaatatgaaggctgtgaagtgttggtcgagacagattttaatggggttgagatatcttcacagtcaagagccaccgattatacatcgagatctcaaatgcgataacatctttatcaatggaaaccatggagaagtaaaaataggagatcttggtctagcaactgtcatggagcaagctaatgccaagagtgtgattggaaccccagagttcatggcacctgagctttacgatgagaactacaatgagctggctgatatttattcatttgggatgtgtatgctggagatggtgacatttgaatatccatactgtgaatgcaaaaactctgcgcagatatacaagaaggtctcatcgggaataaaacctgcttcactttctagggttcaagacccagaagtaaagcaatttattgagaaatgcttacttcctgcatccgagaggttatcagcaaaagagcttcttctggacccttttcttcatgtgaatggtttaacaatgaacaaccctttgccgcttcccgacattgtaatgcccaaagaaggtgcgtttggagaacgttgccttatgtctgaaggccctcctacaacacggcgtagtaggcccatgtctatagatctcgatgaagacaataacctgccgattgttacctttagcgacaactcaggatccaggtgtattgaagtcagacgtgcaaagagagggaatttctttgtcctcaagggtgaagaaaacgatgagcactctgtctcgctaattcttcgtatagtagatgagaatggacgtgtgaggaacattcatttcctgttctatcaagaaggtgacactgcttctaaggtgtcaagtgagatggttgagcaactcgagttaactgaccagaacgtcacatttatagccgagctgattgacatattacttgtcaacatgatacccacctggaaaaccgatgtcactgtcgatcatctcatccattcacaactgaatcagagctcaagaagtcatcagagcgaagcaaagccacagaaacaagaggaaactgctttccatgatgcttgtgagtcggtaagtcactcgtggacctcggattgcccacgatcagaagaggaagataagcagtgtattgatgccactaaaggtgaagacaggagctccaatcacgaagcagaagaggcaaccgaaccagtaagtctttaggaagaagaaagtttaagacaggaactggaggagatagaagccaagtatcaggaagagatgaaagagatagcaaagaaaagagaagaagcaataatggagacaaagaaaaagttgtctcagaagaagacagaacacgttaagtagccaaaacacataacaaagaccccattggtagtttttctttttcttttttgagttaatttgtttcttgaacaagaagaagcacttcgctccctgaaagtgtagaaagtttcctacaggatgaagagtttctctgcgttttgttgtttccattggtggtggttaaagatttttgatttggtcgaacgttaagaacaaaaaggatgatgttagaaaat

SEQ ID NO: 1335 - DNA, 1668 bp, Arabidopsis lyrata
agcttgtctctatctgccccacaaacaacacctctctttgctggactctctttttcttcctttccttgagtctattttaactcagaatcctctgcttttctgtagagagaaggtaagaaatgggtgttgatttgaggcaagtagtggctggtattctcaccattaccatgtttgtcatgcttggacagatgcttcatagagattactttgattctcttcaggagaaagctcagggagatgcacaagatattgaatttgaaggatctaaagtctctgtgaaagatggtcttgtcggaaccgttgaaggcagtaagggactttggatggaggataacactgatcttaatccttgttggccaacattactatcagatgaagcggtatcatcgaaagggtatgttacattctcactaaccaatggtcctgagtaccatatctctcagatttctgatgctgtaatggtggcaaagcatcttggagcaactctagtacttcctgatataagaggaagcaaacctggtgatgaaaggaattttgaagatatctatgatgcggataaactaattaaaagcttggaaaatgttgttaaagttgtgaaacaattgcctgaagaagtttctcttaggaacatggccattgtgaaggtccctaccagagttacagaagattacattaaggagcacattgatcccatcttcaaatcgaaaggaaacattcgagtcgcatcatactttccttctgtaaacttgaggaaatcctcacaagatggcgaaactgatccagtagcatgtttagcaatgtttgggtcattggagctgcaacccgaagtgaatgcagtggctgaatcaatggttgagcggttgaggactcatagccggaaatcaggtggccgtttcatagcagtagaccttagaatcgacatacttgagaagaaaaattgtcatacaacgggtgtagtaggctccaagacttgttacaacgcgcaagagattgctttgttcttgaggaagcttgggtttgccagcgacacaactatctatctgactcagccaagatgggacagtagcctcaatatccttaaggatatcttcccgaaaacattcacaaaggaggcaataatgccggcaagtaagaggtcaaagtaccttgaatcagagagttctgagtacgaaaatgttatcgacttttacataagctcaagaagcgatgtctttgttccagccatatccggtctgttttacgcaaacaccgttggcaaaaggatagctttaggtaagcctcaagtgctagttccagcagaaatctcagagacatctggccgtgctacagatttcatctctccgtacatttcaaagaagaatcacttggcttattcatgcttttgctgaccttctcgcatttctaaagtaatctccacgcatacttcctcggaagggacttctcagttttcatcaagtgtaagcaatttaattattttcttgtttttaatttgtaagtttgtttcaatatatgttggttttttggggcgagtgagattcacagtttgaatctgttggctcatagcttttgcattctataaattttgctctatagtaagaaatacatagattgtttgtaagattgattttagtgttgagggtttctaatgaaggaagaaccatgtgaact

SEQ ID NO: 1336 - DNA, 1758 bp, Eutrema halophilum
aatcaaaaggggaactgagatttcgtatttgaggaagatagcttgtctctatctgccccacaaacacaacataccaactctctctctttgttggactttctttttctttccttccttgtctatttcacaactcatcttctcagagtcctctgttttctctacttcacaatccagttttggagagagagagagaagaaatgggtgtggatttgaggcaagtggttgctggtattctcaccattaccatgtttgtgatgcttggacagatgcttcatcgagattactatgattctcttcagaagaaagtacagggagatgcacacgatatggaattcgaaggatccagagtatctgtgaaagatagtcttgttggagccgtcgaaggcagcaaaggaccttggatggatgataacagtgaccttaatccttgttggccaacattgctaccagatgaagctgtatcgtccaaaggctatgttacattctcgctaacgaatggtcctgagtaccatgtctctcagatcactgatgctgtaatggtggcaaagcatcttggagcaacactagtacttcctgatataagaggaagcaaacctggtgatgaaaggagtttcgaagatatttatgattctgataaattaatcaaaagcttggaaaacgtagtcaaagttgtgaaacaattgcctgaagaagtatctctaaggaatatcgcaattgtaaaggttcctactcgagttacagaagattacattaaggaacatatagatccaatcttcaaatcaaaaggaaacattcgagttgcatcctacttcccttctgtgaatttgaggaaatccttacaagacggcgaaactgatcccgtcgcctgtttggcaatgtttggttcattagagttacaaccagaagtgaatgcagtggttgaatcaatggttgagcggttaagaactcatagccggaaatcaggtggtcgtttcatagctgtagacctcagaatcgacatacttgagaagaaaaattgccattcaactggtgtagtagggtccaagacatgttacaatgcacaagagattgctttgttcttgaggaagcttggatttgccggggatacaactatctatctgactcagccaagatgggacagtagcctcaatatccttaagaatatcttccccaaaacgttcacaaaggaggcaataatgccagcaagtaagagatcaaagtaccttgaatcagagaattctgagtatgaaaatgttatcgacttctacataagctcgagaagcgatgtgtttgttccagccatatccggtctgttttatgcaaatacagttggaaaaaggatagctttaggtaaacctcaggtgctagttccagcagaaatctcagagacatctggcattgctacagatttcatctctccttacatctcaaagaagaaccacttggcttattcatgcttttgttgaccttcttacatttctagtccaagcatcggccttctcagttttcaccaagtgtaagcaaattaatttttaattattcattccttgtttttccttatgtaagtttgtttcaatacaagttggttttttcttagagttttttttttttttttggtttgccttgtgtaggaaagaaaactattgaggtttacaatttgattctgttggctcatagccttttcatcttaaactttttgctctgtattacgaaacacataaaaattgtttgtaagattggttttcgtgttgaaagttt

SEQ ID NO: 1337 - DNA, 1444 bp, Brassica rapa
aatcaaaaaggaaactgagatatcatatttgaggaagataacttgtctcttacctgcccccacaacacaacacctctttttgttggtctttctttttctttacttccttctctatttcaactcatctgattcttctgttttctctgtttcatcataagcaagagagaaagaagaaatgggtgtggatttgaggcaagtggttgctggtatcctcaccattaccatgttcgtgatgctcggacagatgcttcatagagattactttgattctcttcaggagaaagctcagggagatgcacacgatattgaatttgaaggatctagagtatctgtgaaagatagtcttgtcggagccgtagaaggcagtaaagggccttggatggatgataccaatgaccttaacccttgttggccaactttactatccgatgaggcggtatcatcaaaagggtatgttacattctcactaacgaatggtcctgagtaccatatctctcagatcactgatgctgtaatggtggcaaagcatcttggagcaacattagtgcttcctgatataagaggaagcaaacctggtgatgaaaggaactttgaagacatttatgatgctgataaactgatcaaaagcttgaaaaacgtcatcaaagttgtcaaacaattgcctgaagaagtatctctaagggacatcgccattgtaaaagtccctaccagagttacagaggactacattaaggagaacattgacccaatcttcaaatcaaaaggaaacatccgagttgctacgtacttcccttctgtaaacttgagaaaatcctcgcaagaaggcgaaaccgatcctgtggcttgtttggcaatgtttggttccttggagttgcaacctgagctgaatgcagtagttgaatcaatgattgagaggttaaggactcatagcaggaaatcagctggccgtttcatagctgtagaccttagaatcgacatacttgagaagaaacattgccactcaactggtgtagttgggtccaagacatgttacaacgcgcaagagattgctgtattcttgaggaagcttggatttgctggtgacacaactatctatctgactcagccaaggtgggacagtagcctcaatatccttaaggatatcttcccaaaaacgttcacaaaggaggcaataatgccagcaagcaagaaatcaaagtaccttgaatcagagagttcagagtatgaaaatgttattgacttctacataagctcgagaagcgatgtgtttgttccagccatatctggtttgttttatgcaaacatagttgggaagaggatagctttaggtaagccacaagtgctagttccagcagagatctcagagacatctggccttgctacagatttcatctctccttacatctcaaagaagaaccacttggcttattcatgtttttgctga

SEQ ID NO: 1338 - DNA, 1519 bp, Brassica napus
agaaagaagaaatgggtgtggatttgaggcaagttgttgctggtatcctcaccattaccatgttcgtgatgctcggacagatgcttcatagagattactttgattctcttcaggagaaagctcagggagatgcacacgatattgaatttgaaggatctagagtatctgtgaaagatagtcttgtcggaggcgtagaaggcagtaaagggccttggatggatgataccaatgaccttaacccttgttggccaactttactatccgaagaagcggtatcatcaaaagggtatgttacattctcactaacgaatggtcctgagtaccatatctctcagatcactgatgctgtaatggtggcaaagcatcttggagcaacattagtgcttcctgatataagaggaagcaaacctggtgatgaaaggaactttgaagacatttatgatgccgataaactaatcaaaagcttgaaaaacgtcatcaaagttgtcaaacaattgcctgaagaagtatctctaagggacatcgccattgtaaaagtccctaccagagttacagaggactacattaaggagaacattgacccaatcttcaaatcaaaaggaaacatccgagttgctacgtacttcccttctgtaaacttgagaaaatcctcgcaagacggcgaaaccgatcctgtggcttgtttggcaatgtttggttccttggagttgcaacctgagctgaatgcagtagttgaatcaatgattgagaggttaaggactcatagcaggaaatcagctggccgtttcatagctgtagaccttagaatcgacatacttgagaagaaacattgccactcaactggtgtagttgggtccaagacatgttacaacgcgcaagagattgctgtattcttgaggaagcttggatttgctggtgacacaactatctatctcactcagccaaggtgggacagtagcctcaatatccttaaggatatcttcccaaaaacgttcacaaaggaggcaataatgccagcaagcaagaaatcaaagtaccttgaatcagagagttcagagtatgaaaatgttattgacttctacataagctcgagaagcgatgtgtttgttccagccatatctggtttgttttatgcaaacatagttgggaagaggatagctttaggtaagccacaagtgctagttccagcagagatctcagagacatctggccttgctacagatttcatctctccttacatctcaaagaagaaccacttggcttactcatgtttttgctgaacttctcacatttccaaagtggtctttaagcatggcccttctcagttttcaccaagtgtatgcaatttaaaaaaaaattcttgtcttatttgttatgtaaggttgtttcaacataagttgggttttttcaggtgagtttatttttgtttgccatgtgtaggaaagaaaactattgaggtttacaatttgattctgttggctctcgtagcctttgcattctataaaaaaaaattatataa

SEQ ID NO: 1339 - DNA, 2358 bp, Eutrema parvulum
tgttttgtttgcgtaagacttcaacttctacaatcaacactgataataacactccccagaagaaaaaaaggaactttttggcaaagctttaattacaaataaatcaaaagggaactgagatttcatatttgaggaagatagcttgtctctatctaccaacacaacacagcacctctctctgttggactttctttttctttccttccttctctacttcaactcatcttctcaagatcctctgttttctctatctcacaatccagttctgtggagagaacacagaagaaatgggtgtggatttaaggcaagtggttgctggtattctcaccattaccatgtttgtgatgcttggacagatgcttcatagagattactttgattctcttcaggagaaagctcaggtagatggacaggatattgagttcgaaggatctagagtagctgtgaaagatagtcttgttggagccgtagaaggcagtaaaggaccttggatggatgataacaatgaccataatccttgttggccaacattgctatccgatgaagcggtatcatcaaaagggtatgtaacattctcactaacgaatggccctgagtaccatatctctcagatcactgatgctgtaatggtggcaaagcatcttggagcgactctagtgcttcctgacataagaggaagcaaagctggtgatgaaaggaattttgaagatatttatgatgctgataaactaatcaaaagcttggaaaatgttgtcaaagttgtgaaacaattgcctgaagaagtctctctaatgaatatcgcaattgtgaaggtccctaaccgagttacagaagattacattaaggagaacattgctcccatcttcaaatcgaaaggaaacattcgagtagcaacatacttcccttctctgaatttgaggaaatcctcacaagatggcgaaactgatcctgtggcttgtttggcaatgtttggttccttggagttacaacctgaagtgaatgcagtggttgaatcaatgattgagcggttgaggactcatagtcggaaatcaggcggccgttttatagcggttgaccttagaatcgacatacttgagaagaaaaactgccattcaactggtgtagtagggtccaagacatgttacaatgcacaagagattgctttattcttgaggaagcttggatttgctggtgacacaactatctatctgactcagccaagatgggacagtggcctcaatattcttaaggatatcttcccaaaaacgttcacaaaggaggcaataatgccggcaagtaagaaatcaaagtaccttgaatcagagaattctgagtacgaaaatgttattgacttctacataagctcaagaagtgatatgtttgttccagctatatccggtctgttttatgcaaacacagttggaaaaaggatagctttaggtaagcctcaggtgctggttccagcagaaatctcagagacatctggccttgctacaaatttcatctctccttacatctcaaagaagaaccacttggcttattcatgcttttgttgatcttctcacgtttctataatgatctccaagcatgggccttctcagttttcaccaagtgtaagcaatttaatttttattttatttttcttgtttttggttatgtaaggttgtttcaatataagttgggtttatttcaggcgagtgagtttacatttgtttgccttgtgtaggaaagaaaactattgaggtttacaatttgattctgttggctcatagactctgcattttataaattttgctctatagtctgaaacacataaaacttaactttagtgtcgagggtttctgatgaaggaagaaccatatgatctgtactacgataagaaattatatttactatgtccattgttttccccaaatctagcttctttgcagacagagagcaacgatttttggttggtatgaacacagagaatcctctatgtcaaatacaacactttttgagggaccaaagactgagccaaacttccatcagtacaaccccaaatccaattcaattcacagttgcacttttacatcatacaaaaagaagaaatatgaaaagggacaaaagaattggatcgtgcagtatacatttgaaaatactattaccatttaaaagaaagaaaggttaagaggtttaggccattgtcacaggttttatctgttattgcttctgtagttgcagtacgaggaagatgaatatctagtaatgttttatgcatttcttgaggctttgtatttacggaacggtttcttgaagtagacgctcatcggagtcttgggtacaggaatcagtttcccaacaactgcaagtggccag

SEQ ID NO: 1340 - DNA, 1513 bp, Brassica napus
ttccttcctttcttctctctatttccaactctgttttcacgatccagttttgtaagaaagtactagaaatgggtgtggatttgaggcaagtggttgctggtattctcaccatcaccatgtttgtgatgctcggacagatgcttcatcgagattactatgattctcttcaggagaaagctcagggagatgcacatgatatcgaattcgaaggatcaagagtatctgtgaaagatagtcttgttggagccttagaaggaaataaaggaccttggatggatgataacaatgaccttaatccttgttggccaacattactatccgatgaagcggtatcatcaaaagggtatgttacattctctctaacgaatggtcctgagtaccatatctctcagatcactgatgctgtaatggtggcaaagcatcttggagcaacactagtgcttcctgatataagaggaagcaaacctggtgatgaaaggaactttgaagacatttatgatgctgataaactaatcaaaagcttggacaatgtcatcaaagttgtcaaacaattgcctgaacaagtatctctaagagacatcgccattgttaaagtccctacaagagttacagaagactacatcaaagaacacattgaacccatcttcaagtccaaaggaaacattcgagtagctacatacttcccttctgtcaacctgaggaaatcctcacaagacggcgaaaccgatcctgtggcctgtttggcaatgtttggttccttggagttgcaacctgagctgaacgcagtagttgagtccatgattgagaggttaaggactcacagcaggaaatcagatggccgtttcatagctgttgaccttagaatcgaagcactcgagaagaaaaattgtcattcaactggtgtgggagggtccaagacttgttacaacgcacaagagattgctgtgttcttgaggaagcttggatttgctggtgacacaaccatctatctgactcagcctagatgggacagtagcctcaatatccttaaggatatcttcccaaaaacgtttacaaaggaggcagtaatgccagcaagtaagagatcaaagtaccttgaatcagagagttctgagtatgaaaatgttattgacttctacataagctcaagaagcgatgtgtttgttccagccatatctggtttgttctatgcaaacacagttgggaaaaggatagctttgggtaagcctcaagtgctagttccagcagagatctctgagacttcttcccttgctacagatttcatctctccttacatctcaaagaagaaccacttggcttattcatgcttttgctgaaccttgtcaccttttctaaagtgatctctccaaacatgggctttctcagttttcaccaagtgtaagctatatttaatttgatgttttctctgtttttctttatttaaggttgccttgtgtaggaaagaaaacaattgaggtttacaatttgattttgttggcttatatccttttgc

SEQ ID NO: 1341 - DNA, 1621 bp, Brassica napus
gataccttgtctctatctgcccccacaccacactctctttgttggactttctttttctttctttccttccttccttccttctctctatttcaactctgttttcacgatccagttttgtaagaaagaagaaatgggtgtggatttgaggcaagtggttgctggtattctcaccatcaccatgtttgtgatgctcggacagatgcttcacagagattactatgattctcttcaggagaaagctcagggagatgcacatgatatcgaattcgaaggatccagagtatctgtgaaagatagtcttgttggagccttagaaggaaataaaggaccttggatggatgataacaatgaccttaatccttgttggccaacattactatccgatgaagcggtatcatcaaaagggtatgttacattctctctaacgaatggtcctgagtaccatatctcccagatcactgatgctgtaatggtggcaaatcatcttggagcaacactagtgcttcctgatataagaggaagcaaacctggtgatgaaaggaactttaaagacatttatgatgctgataaactaatcaaaagcttggaaaacgtcgtcaaagttgtcaaacaattgcctgaacaagtatctctaagagacatcgccattgttaaagtccctacaagagttacagaagactacatcaaagaacacattgaacccatcttcaagtccaaaggaaacattcgagtcgctacctacttcccttctgtcaacctgaggaaatcctcacaagacggtgaaaccgatcctgtgtcttgcttggcaatgttcggttccttggagttgcaacctgagctgaacgcagtagttgagtccatgatagagaggttaaggactcacagcagtaaatcaggtggccggttcatagctgtagaccttagaatcgaagcactcgagaagaaaaattgtcattcaactggtgtgggagggtccaagacttgttacaacgcacaagagattgctgtgttcttgaggaagcttggatttgctggtgacacaaccatctatctgactcagcctagatgggacagtagcctcaatatccttaaggatatcttcccaaaaacgttcactaaggaggcagtaatgccggcaagtaagagatcaaagtaccttgaatcagagagttctgagtatgaaaatgttattgacttctacataagctcaagaagcgatgtgtttgttccagccatatctggtttgttctatgcaaacacagttgggaaaaggatagctttgggtaagcctcaagtgctagttccagcagagatctcagagacttcttcccttgctacagatttcatctctccttacatctcaaagaagaaccacttggcttattcatgcttttgctgaaccttgtccccttttctaaagtgatctctccaaacatgggctttctcagttttcaccaagtgtaagctatattttatttgatgttttctttgtttttctttatgtaaggttgccttgtgtaggaaagaaaacaattgaggtttacaatttgattttgttggcttatagctttttgcatcctacaaattttgttcaatagtatgaaacacataaaatttgttt

SEQ ID NO: 1342 - DNA, 1543 bp, Brassica rapa
tttctttttcttttccttttccttccttccttctctctgtttcaactctgttttcacgatccagttttgtaagaaagtactagaaatgggtgtggatttgaggcaagtggttgctggtattctcaccatcaccatgtttgtgatgctcggacagatgcttcatcgagattactatgattctcttcaggagaaagctcagggagatgcacatgatatcgaattcgaaggatcaagagtatctgtgaaagatagtcttgtgggagccttagaaggaaataaaggaccttggatggatgataacaatgaccttaatccttgttggccaacattactatccgatgaagcggtatcatcaaaagggtatgttacattctctctaacgaatggtcctgagtaccatatctctcagatcactgatgctgtaatggtggcaaagcatcttggagccacactagtgcttcctgatataagaggaagcaaacctggtgatgaaaggagttttgaagacatttatgatgctgataacataatcaaaagcttggaaaacgtcatcaaagtcgtcaaacaattgcctgaacaagtatctctaagagacatcgccattgttaaagtccctacaagagttacagaagactacatcaaagaacacattgaacccatcttcaagtccaaaggaaacattcgagtcgctacatacttcccttctgtcaacctgaggaaatcctcacaagacggcgaaaccgatcctgtggcttgtttggcaatgtttggttccttggagttgcaacctgagctgaacgcagtagttgagtccatgattgagaggttaaggactcacagcaggaaatcagatggccgtttcatagctgttgaccttagaatcgaagcactcgagaagaaaaattgtcattcaactggtgtgggagggtccaagacttgttacaacgcacaagagattgctgtgttcttgaggaagcttggatttgctggtgacacaaccatctatctgactcagcctagatgggacagtagcctcaatatccttaaggatatcttcccaaaaacgtttacaaaggaggcagtaatgccagcaagtaagagatcaaagtaccttgaatcagagagttctgagtatgaaaatgttattgacttctacataagctcaagaagcgatgtgtttgttccagccatatctggtttgttctatgcaaacacagttgggaaaaggatagctttgggtaagcctcaagtgctagttccagcagagatctctgagacttcttcccttgctacagatttcatctctccttacatctcaaagaagaaccacttggcttattcatgcttttgctgaaccttgtcaccttttctaaagtgatctctccaaacatgggctttctcagttttcaccaagtgtaagctatatttaatttgatgttttctctgtttttctttatttaaggttgccttgtgtaggaaagaaaacaattgaggtttacaatttgattttgttggcttatatccttttgcattttatatattt

SEQ ID NO: 1343 - DNA, 1496 bp, Raphanus sativus
  misc_feature (1429)..(1429): n is a, c, g, or t
  misc_feature (1431)..(1431): n is a, c, g, or t
  misc_feature (1442)..(1443): n is a, c, g, or t
  misc_feature (1453)..(1453): n is a, c, g, or t
  misc_feature (1464)..(1464): n is a, c, g, or t
  misc_feature (1476)..(1476): n is a, c, g, or t
ttttttcgagagaaggaagaaatgggtgtagatttgaggcaagtggttgctggtatcctcaccattaccatgtttgtgatgctcgggcagatgcttcatagagattactatgattctcttcaggagaaagctcagggagatgctgcacacgatatggagttcgaaggatccagagtatctgtgaaagatagtcttctcggagctgtggaaggcagtaaagggccttggatggatgataacaatgatcttaacccttgctggccaacattactatcagatgaagctgtatcatcgaaagggtatgttacattctcattaacgaacggtcctgagtaccatatctctcagatcactgatgctgttatggtgacaaaacatcttggagcaacactagtgcttcctgatataagaggaagcaaacctggtgatgaaaggaactttgaagatatttatgatgctgataaactaatcaaaagcttggaaaacgtcatcaaagtcgtcaaacaattgcctgaacaagtatctctaagggacatggccattgtaaaagtccctaccagagttacaaaagactacattaaagagaacattgatccaatcttcaaatcaaaaggaaacattcgagtggccacgtacttcccttctgtaaacttgaggagatcctcacaagacggcgaaaccgatcccgtggcatgtttggcaatgtttggttccttggagctgcagcctgcactgaatgcagttgttgaatcaatggttgagaggttaaggactcacagcaggaaatcaggtggccgtttcatagcggtagaccttagaattgacttacttgagaagagaaattgccattcaactggtgtagtagggtccaagacatgttacaacgcgcaagagattgctgtattcttaaggaagcttggatttgctggtgacacaactatctatctcactcagacgagatgggacagtagcctcaatatccttaaggatattttccccaaaacattcacaaaggaggtgataatgccagcaagtaagaaatcaaagtaccttgaatcagagagttcagagtacgaaaatgttattgacttctacataagctcgagaagcgatgtgtttgttccagccatatcaggtctgttttatgcaaacatagttgggaagaggatagctttaggtaaaccacaagtgctagttccagcagaaatctcagagacatctggtcttgctacagatttcatctctccttacatctcaaaaaagaaccacttggcttattcctgcttttgctgaccttctcacatttccaaattgatctttaagcatggcctttctcagttttcaccaagtgtatgcaatttaactttttttttgttcttgtatcttttgttatgcaaggttgtttcaatataagttgtttttttctttncnggtgagtttanntttgtttgcnatgtgtagganagaaaactattnaggtttacaatttgattctg

SEQ ID NO: 1344 - DNA, 1660 bp, Raphanus sativus
  misc_feature (68)..(68): n is a, c, g, or t
atttcatatttgaggaagataccttgtccctatctgccccacacctcactctctttgttggactttcnttttctttccttccttctctctatttcaactctgtatcctctgttttcacgatccagttttgtaagaaaagtagaaatgggtgtggatttgaggcaagtggttgctggtattctcaccattgccatgtttgtgatgctcgcacagatgcttcatagagattacttagattctcttcaggagaaagctcagggagatgcaaatgacatagaattcgaaggatccagagtatctgtgaaagaaagtcttgttggagccttagaagggaataaaggaccttggatggatgataacaatgaccttaatccttgttggccaacattgttatccgatgaagcggtatcatcaaaagggtatgttacattctctctaacgaatggtcctgagtaccatatctcccagatcactgatgctgtaatggtggcaaagcatcttggagcaacactagtgcttcctgatataagaggaagcaaacctggtgatgaaaggagttttgaagacatttatgatgctgataaactaatcaaaagcttggagaacgtcatcaaagttgtcaaacaattgcctgaagaagtatctctaagagacatcgccattgttaaagtccctacaagagttacagaagactacatcaaagaacacattgaacccatcttcaagtccaaaggaaacattcgagtggctacatacttcccttctgtcaacctgaggaaatcctcacaagacggtgaaaccgatcctgtggcttgtttggcaatgtttggttccttggagttgcaacctgagctcaatgcagtagttgagtcaatgattgagcggttaaggactcatagcaagaaatcaggtggccgtttcatagctgtggaccttagaatcgaagcacttgagaagaagaattgtcattcaactggtgtagcagggtccaagacttgttacaatgctcaagagattgctgtattcttgaggaagcttggattttctggtgacacaaccatctatctgactcagcctagatgggacagtagcctcaatatccttaaggatatcttcccaaaaacgttcactaaggaggcaataatgccggcaagcaagagatcaaagtaccttgaatcagagagttctgagtatgaaaatgttattgacttctacataagctcaagaagtgatgtgtttgttccagccatatctggtctgttttatgcaaacacagttgggaaaaggatagctttgggtaagcctcaagtgctagttccagcagagatctcagagagttcttcccttgctacagatttcatctctccttacatctcaaagaagaaccacttggcttattcatgcttttgctgaaccttcccatctttctaaaagtgatctctccaaacatgggacttctcagttttcaccaagtgtaagctatttgatttgatgttttcttgttttttttttatgtaaggttgccttgtgtaggaaagaaaacaattgaggtttacaatttgattctgctggcttatagcctttgcattctataaattttgttctatagtatgagacacataatatttgttttataagattgatttagtgtggagggttt

SEQ ID NO: 1345 - DNA, 2454 bp, Eutrema parvulum
gtcggtggctgtgtttgggcattagacagagcgtaaggcaaagacttgaacactgacaataacacccagaaattatataaaaagaaagtatctttttcgacaaaatcatcaaaagggactcagatttgtgaaatctggtctctttttctttcttcttttgtttttttctaaccattcataattctcctcaatttccgtgaaacccttcaaaacccatttctagagagagagaggagagtgtaagaagaagaagaagaaaatgggtgtggatttgaggcaagtggtggctggaattctcacaattaccatgtttgtgatgctcggacaaatgcttcatagagattactttgatgctgttcaggaaaaagttcaaggagatgcacatgatattgaattccagggatcaaaagtagctgtggaagatggacttgttagagcaagtgaagggaataaagggccttggatggaggatagccatgaacttaaaccttgttggtcaatctctcaatctgatgaagcggtatcgtcaaagggttatgttacattctccttaacgaatggtcctgaataccatgtctctcagattactgatgccgtgatggtggcgaagcatcttggagcaacgctcgtgctccccgacataagaggaagcaagcctggtgatgaaatgaactttgaagatatatatgatgtagataaactcgtgaaaagcttggaaagcgttgtcaaagttgtaaaaaaattgccgagccacgtatctctaagagatatcgccattgttaaggttcctactcgagttgcagaagattacatcaaggaacatattgatcccatcttcaaatcaaaagggaacattagagttacaacctatttcccttccgtgaatttgaggaaatcgtcgcgggatgctgaaaccgaccctgtctcttgtttggcaatgtttggttccttggagttgcaatccggagtgagtgaattggttgagtcgatgattcagcggctgaagacacatagcaagaaatccggtggccgtttcatagccatagacttgagagttgagatacttgagaagaaaaattgccatgaaacaggtgcagtgggatcaaaaacctgttacaacgcacaagagatcgcattgttcttgaggaagcttggatttgacagtgatacaactatatacctgactcagccaagatgggagagcagcctcaatattcttaaggacattttcccgaaaacttttactaaggaggagataatgccggcagacaagaaatcgaagtaccttgaattagaaaattctgagtatgaaaatgttattgacttctacataagttcaaggagtgatgtatttgtgccagccattcccggtctgttttacgccaatacagttggaaaaaggatagctttaggcaagcctcaagtcctagttccagctgagatctcaggaacatctggtctttccactgattacatcactccctacatctcaaagaagaaccacttggcgtattcatgcttttgctgaacttctctggcatgatttaggggggaaatgatttgccaaaagtggccttaaagccaacaaaatccatgaaagtgtctcctcaccaagtgtaagccatctagttaccaggggtactccagctgtttattgtttagctcgataccagttcaatttttagtcaagtattttcattggggttgtcttgtttaggaaggaaaacttttgtaagatacaatttgaatctattgtctcatagctttttcatcctagtcatttggtaacgatggttgagtgtgagaagaggcaacatgtgggatacggcgagactttgttcgttgttgtcaaacatgctgaaaactaacaactgtaaaaataatgcaatgtatgatcttgtcttttactcttttagatcaaaaagagatagcaaagaccagatgcagaaaaattgtgatgacatttacaagatataaatcaagatgtaccaggagaaccatgtaaaggttttcttggatcataagggagatgaagaatgctagattactgaactctcatggtcatgtcgatcactgagtctcttgtgttgtctccccagttctttcatgagcccgagccatctctaaggccagacactcgctgagctctataacaacctggctcatgcttggcctatttctaggacgagctgcacatgcgcgtgctatctccatagctttcctgactgagttacgctcaaagtcactgtcaagcctgggatcaacaacctctagagcatcgcctttcccgaccttaagatcaacccacttggaaatgtgaggactttcacggtcgatgtcaaccacatgctgattggttatcatctctaacagaacaatgccaaagctataaatgtcgcttgtttgggttaaccagtttgagttgaagtatctgcattatccaatacacagagt

SEQ ID NO: 1346 - DNA, 1745 bp, Eutrema halophilum
ccaaaattatttaaaaagaaagtatctttttgacaaaatcttcaaaatggactcagatttgtgaaatcttgtctctttttctttcttcttttgtttttaaccattcctcattctcctcaatttccgtgaaacccttcaaaacccatttttagagagagagagaagaagaagaagaagaagaagaagaagaagaagaagaagaagaagaagaaaatgggtgtggatttgaggcaagtggtggctggaattctcaccatcaccatgtttgtgatgctggggcaaatgcttcacagagattacttcgatcctgctcaggaaaaaatccaaggagattcacatgatattgagttccaaggatcaaaagtagcggttgaagatggactagttagaacctttgaaggaaataaagggccttggatggaggattgccatgagcttaaaccttgttggtcaatatctcagcctgatgaagcggtatcttccaagggtcatgttacattctccttaacgaatggtcctgaataccatgtctctcagattactgatgccgtgatggtggcgaagcatcttggagcaactcttgtgcttcccgacataagaggaagcaaacctggtgatgaaatgaactttgaagatatctatgatgtggataaactcgttaaaagcttggaaagtgttgtcaaagttgtaagcaagttgccaagccacgtatctctaagagatatcgccattgttaaggttcctactcgagttgcagaagattacatcaaggaacatattgatcccatcttcaaatcaaaagggaacataagagttacaacctatttcccttccgtgaatctgaggaaatcttcgcgggatgctgaaaccgaccctgtctcttgtttggcgatgtttggttccttggaactgcaaaccggagtgaatgaactggttgaatctatgatacagcggctgaagtcacatagcaagaaatccggtggccgtttcatagccatagacttgagagttgagatacttgaaaagaaaaattgccatgaaacaggtgcagtgggatccaaaacctgttacaacgctcaagaaatcgcattgttcttgaggaagcttggatttggcagcgatacaactatatatctgactcagccaagatgggacagtagcctcaatattcttaaggacattttcccgaaaacgtttactaaggaggcgataatgccatcagacaagaaatcgaagtacctcgaattagaaaattccgagtatgaaaatgttattgacttctacataagttcgaagagtgacgtatttgtgccagccattcctggtctgttttacgcaaatacagttggaaaaaggatagctttagggaagcctcaagttctggttccagccgagatctcaggaacatccggtctttcaactgattacatatctccttacatctcaaagaagaaccatttggcgtattcgtgcttttgctgaacttgtctggtggaaacttatgagggaaatgttttgacaaaaagtgatctttgaagcagaaaaatccatggaaaggtcttgtcaccaagtgtaagccaatttagttaccaggtttttcttgggttgtttattgataaagtttagctcgataccagttcgattttagtcaagtgttctctcattggggttgtcttgtttaggaaaagaaaacttttgtaagttacattctgattctattggcccatagcttttgcatcctattc

SEQ ID NO: 1347 - DNA, 1632 bp, Raphanus sativus
  misc_feature (140)..(140): n is a, c, g, or t
  misc_feature (916)..(916): n is a, c, g, or t
  misc_feature (1036)..(1036): n is a, c, g, or t
  misc_feature (1606)..(1606): n is a, c, g, or t
ggggtggctgtgttgtgggtctgtagatagagagcgtaaggcaaagactttaacactcactcataaagaaacaaaatatattttcgacacaatcatcaaaagggactcagattcgtgaaatcttgtctcttttttttctntctcttttgtcttcttaaaccatcccctaatctctcctcaatcgaaggagagtgtaagaagaaccacaatgggtgtggatttgagacaagtggtggctggaatcctcaccattaccatgttcgtcatgctcggacaaatgcttcacagagattactttgatgctcaggttcaaggggatgcacatgatattgagttccatggatcaaaagtatctctggaagatggacttgttagatccagggaagggaatcatgggccttggatggaagatagccatgatcttaaaccttgttggtcaatatctgaatctgatgaagcggtatcttcaaagggttatgttacattctccttaaccaatggtcctgagtaccatgtctctcagataactgatgctgtgatggtggctaagcatcttggagcaacgcttgtgctccctgacataagaggaagcaaacctggtgatgaaatgaactttgaagacatctatgatgcagataaactcgttaaaagccttgaaagcgttctcaaagttgtgaagaagttgccaagccacgtttctctaagagacatcgccattgttaaggttcccaccagagttgcggaagactacatcaaggaacatatcaaccccatcttcaaatcaaaaggcaacatcagagttacaacctacttcccttccgtgaacttgaggaagtcttctctggatggtgagaccgaccctgtctcttgtttggcgatgtttggttccttggagttgcaacctggagtgaatganctggtggagtcgatggttcagaggctgaagagcaagagctctggtggacggttcatagccatagacttgagagttgagatacttgagaagaaaaactgccatgagacaggtgcagggggntccaaaacatgttacaacgcgcaagagatcgcagtgttcttgaggaagcttggatttgatggtgacacaactatatacctgactcagcctagatgggatagcagcctcaatattcttaaggacatcttccctaaaacgtttactaaggaggcgataatgcctgcagagaagaagtctaagtaccttgagttagagaactcagagtatgaaaatgttattgacttctacataagttcaaggagtgatgtgtttgtgccagccattcctggtttgttttacgctaatacggttgggaaaaggatagctttagggaagcctcaagttctagttccagctgagatctcaggaacgtctggtctttctactgattacatctctccatacatctcaaagaagaaccatttggcttattcatgcttttgctaaacttttctgatgtaaaattttatgagggtaatgttttgccaacaaaatctataaaaagggtcttttctcaccaagtgtaagccaattagtttgataccaattttatttttagtgaaaactgttgttaagttacattttgaatcnatgggcttactatagcttttgcagca

SEQ ID NO: 1348 - DNA, 1679 bp, Arabidopsis thaliana
atataaccccaaaataaaaataaaaagtgtggtcttttgacaaaatcatcaaaagggactcagatttgtgaaatcttgtctctttttctttatctgttttgtttttaacgattcgtaattctcctcaatttccgtgaaaccccttggaaaaacccatttctcgagagagagagagagaaggagagtgtaagaagaagaagaagaagaagaaggagatgggtgtggatttgaggcaagtggtggctggaatactcaccattaccatgtttgtgatgcttggacaaatgcttcatagagattactttgatgctgttcaggagaaagttcaaggagatgcacatgatattgaattccatggatcaaaagtagctgttgaagatggacttgttagagcctttgaggctgggactaaagggccttggatggaagatagtcatgaactcaaaccttgttggtcaatttctcaatctgatgaagcggtatcgtcaaagggttacgttacattctccttaacaaatggtcctgaataccatgtctctcagattactgatgccgtgatggtggcgaagcatcttggagcaactcttgtgcttcctgacattagaggaagcaaacctggtgatgaaatgaaatttgaagatatctatgatgtggataaactcattaaaaccttggaaagtgtcgtcaaagttgtaagaaaattgccgagccacgtatctctaagagatattgccattgtcaaagttcctacccgagttgcagaagattacatcaaggaacatattgatcccatcttcaaatcaaaagggaacataagggttacaacctatttcccttctgtgaatttgaggaaatcttcgcagggtgctgaaaccgaccctgtctcttgtttggcaatgtttggttccttggaattgcaacctgcagtgaatgaattggttgagtcgatgattcagcggttgaagacacatagcaagaaatccggtggccgtttcatagccatagacttgagggttgagatacttgaaaagaaaaactgccatgaaacaggtgcagtgggatccaaaacatgttacaacgcacaagagattgcattgttcttgaggaagcttggatttgacagcgatacaactatatatctgactcagccaagatgggagagcagcctcaatattcttaaggacattttcccaaaaacatatactaaggaggcgataatgccgtcagataagaaaacgaagtaccttgaattagagaattctgaatatgaaaatgttattgacttctacataagttcaaggagtgatgtatttgtaccagccattcccggtctgttttacgccaatacagttggaaaaaggatagctttaggcaagcctcaagttctcgttccagccgagatctcagggacatccggtcttcccgctaattacatatctccctatatatcaaagaagaaccacttggcgtattcatgcttttgctgaacttctctggtgtaacttttgagggaaatattttgctaaagtgatcttgtagccaaaatctgttgaaatggtcttctgcaaatgtaagccaatatagtaaccaggtttttccggttgtttattgataagtttagctcgataccaattcgatttttagtcaaaagtattctcattggggttgtcttgtttagg

SEQ ID NO: 1349 - DNA, 1351 bp, Arabidopsis lyrata
ataaggagagtgtaagaagaagaagaaggagatgggtgtggatttgaggcaagtggtggctggaattctgaccattaccatgtttgtgatgctcggacaaatgcttcatagagattactttgatgctgttcaggaaaaagttcaaggagatgcacatgatattgaattccagggatcaagagtagctgttgaagatggacttgttagagcctttgaaggtgggaataaaggtccttggatggaagatagccatggacttaaaccttgttggtctatatctcaatctgatgaagctgtatcgtcgaagggttatgttacattctccttaacgaatggtcctgaataccatgtttctcagattacggatgccgttatggtggcgaagcatcttggagcaactcttgtgcttccagacattagaggaagcaaacctggtgatgaaatgaactttgaagacatctatgatgtggataaaatcgttaaaagcttggaaagtgtcgtcaaagttgtaagaaaattgccgagccatgtatctctaagagatatcgccattgttaaggttcctacccgagttgcagaagattacatcaaggaacatattgatcccatcttcaaatcaaaagggaatataagagttacaacctatttcccttctgtgaatttgaggaaatcttcgcagggtgctgaaaccgaccctgtctcttgtttggcaatgtttggttccttggagttgcaaccgggagtgaatgaattggttgaatcgatgattcagcggttgaagacacatagcaagaaatctggtggccgtttcatagccatagacttgagggttgagatacttgaaaagaaaaattgccatgaaacaggtgctgtgggatccaaaacatgttacaacgcacaagagattgcattgttcttgaggaagcttggatttgaccgcgatacaactatatatctgactcagccaagatgggagagcagcctcaatattcttaaggacattttcccaaaaacatatactaaggaggcgataatgccgtcagataagaaatcgaagtaccttgaattagaaaattctgaatatgaaaatgttattgacttctacataagttcaaggagtgatgtatttgtgccagccattcccggtctgttttacgccaacacagttggaaaaaggatagctttaggcaagcctcaagttctcgttccagccgagatctcagggacatccggtgttcccactaattacatctctccctacatatcaaagaagaaccacttggcgtattcatgcttttgctgaacttctctgatgtaacttatgagggaaatgttttgctaaagtgatctt

SEQ ID NO: 1350 - DNA, 1605 bp, Brassica napus
aagagagagagagagagagagtgtaagaagaaggagaagaagaagaaaatgggcgtggatttgagacaaattgtggctggaatcctcaccatcaccatgtttgtcatgctcggacaaatgcttcacagagactactttgatgctgttcaggaaaaagttgaaggagatgcacatgatattgagttccatggatcaaaagtagctgttgtggaagatggacttgttagagtaagtgaagggattaaaggaccttggatgcgggatagccatgagcttaaaccttgttggtcaatctcttcatctgatgaagcagtatcgtcaaagggttatgttacattctccttaactaatggccctgaataccatatctctcagattactgatgctgtgatggtggcgaagcatcttggagcaactcttgtgcttcctgacataagaggaagcaaacctggtgatgaaatgaactttgaagacatctatgatgtagataaattcgttaaaagcctggaaagcgttgtcaaggttgtgaagaaactgccaagccacgtatctctaagagacatcgccatcgttaagatccccactcgagttgcagaagactacatcaaggagcatattgatcccatcttcaaatcaaaagggaacattagagtcacgacctacttcccttccgtgaatctgaggaagtcttcgctggatggcgagacagatcctgtttcttgtttggcaatgtttggctccttggagttgcagccaggagtgagtgacttggtggagtcgatgattcagcggctgaagaaatcaggtggccgtttcgtagccatagacttgagacttgaggtacttgagaagaagaattgccgtgaaacaggtgcggtggggtccaaaacctgttacaacgcacaagagatcgcgttgttcttgaggaagcttgggtttgagagtgatacaactatatacctgactcagcctagatgggagagcagactcaatatacttaaggacattttccccaaaacttttactaaggaggtgataatgccagcaagcaagaaatcgaagtatcttgagttggaaaactcagagtatgagaatgttattgacttctacataagttcgaggagtgatgtgtttgtgccagccattcctggtctgttttacgcaaatacggttggaaaaaggatagcgttagggaagcctcaagttcttgttcctgcggatatctcaggaacgtctggtctttctactgattgcatctctccctatatctcaaagaagaaccacttggcgtattcatgcttttgctgaacttctctatgaagggaaacaacgagtgatcttgaaagtacacgaaagggtatagctcatcaaagtgtaagccaactagttaccaggggatttttcaggttgtttattgacaaagtttagctctataccggttccaattttagttaaaagtattattatcattggggttgtcttgtttagggaagaaaaacttctgtaagttatattccagtcttttggtaactacggaggatacgaccagacataacaactgtactagaacaatgcaatgtatgatctatctgagatataagcatc

SEQ ID NO: 1351 - DNA, 1476 bp, Brassica napus
aatctctcctcaattgaagggagagtgtaagaagaagaagaagaagaacacaatgggtgtggatttgagacaagtggtggctggaatcctcaccattaccatgttcgtaatgctcggacaaatgcttcatagagattactttgatgctaatcaggttcaaggagatgcacatgatattgagttccatggatcaaaagtatctctggaagatggacttgttagatcaagtgaagggactaaagggccttggatggaggatagcaatgatcttaaatcttgttggtcaatatctgaatctgatgaagcggtatcttcaaagggttatgttacattctccttaaccaatggtcctgagtaccatgtctctcagataactgatgctgtgatggtggctaagcatcttggagcaacgcttgtgctccctgacataagaggaagcaaacctggtgatgaaatgaactttgaagacatctatgatgtagataaactcgttaaaagcctcgaaagcgtcatcaaagttgtgaagaagctgccaagccacgtttctctaagagacatcgccattgttaaagtccccaccagagttgcagaagactacatcaaggagcacatcagccccatcttcaaatcaaaaggaaacatcagagtcacaacctacttcccttctgtgaatctgaggaagtcttctctggatggtggtgagacagaccctgtttcttgcttggcgatgtttggctccttggagctgcagcctggagttaatgaactggtggaggccatgatccagaggctcaagaagaaatctaatggtcggttcatagccatagacttgagggttgagatacttgagaagaaaaactgccgtgagacaggtgcaggggggtccaaaacatgttacaacgcgcaagagattgcagtgttcttgaggaagcttgggtttgatggtgacacgactatatacctgactcagcctaggtgggagagcagcctcaacattctcaaggacatcttccctaaaacgtttactaaggaggcgataatgccggcagagaagaagtctaagtaccttgagttagagaactcagagtatgaaaatgttattgacttctacataagttcgaggagtgatgtgtttgtgccagccattcctggtctgttttatgccaatactgttgggaaaaggatagctttagggaagcctcaagttcttgttccggcagagatctcagggacgtctggtctttctactgattacatctctccttatatctcgaagaagaatcatttggcgtattcatgcttttgctgaacttttgtggtgtaatttattatgagggaattgttttgccaaccaaatctataaaagggtcttttctcactaagtgtaaggcagttagttccataccaatttgattttttagtaaaaactagttgttgagttacgtaaaaaaaaaaactaaagcgactgcacgacga

SEQ ID NO: 1352 - DNA, 1530 bp, Brassica rapa
  misc_feature (62)..(62): n is a, c, g, or t
cgggtctgtagatagagagagcgtaaggcaaagacttaaacactcacttatataaaaaacanaatatcttttagacaaaatcatcaaaagggactcagattcgtgaaatcttgtctcttttttctttcttttgtccttttaaaccagtccctaatctctcctcaattgaagggagagtgtaagaagaagaagaagaagaacacaatgggtgtggatttgagacaagtggtggctggaatcctcaccattaccatgtttgtaatgctcggacaaatgcttcatagagattactttgatgctaatcaggttcaaggagatgcacatgatattgagttccatggatcaaaagtatctctggaagatggacttgttagatcaagtgaagggactaaagggccttggatggaggatagcaatgatcttaaatcttgttggtcaatatctgaatctgatgaagcggtatcttcaaagggttatgttacattctccttaacgaatggtcctgagtaccatgtctctcagataactgatgctgtgatggtggctaagcatcttggagcaacgcttgtgctccctgacataagaggaagcaaacctggtgatgaaatgaactttgaagacatctatgatgtagataaactcgtcaaaagcctcgaaagcgtaatcaaagttgtgaaaaagctgccaagccacgtttctctaagagacatcgccattgtcaaggtccccaccagagttgcagaagactacatcaaggagcacatcagccccatcttcaaatcaaaaggaaacatcagagtcacaacctacttcccttcagtgaacttgaggaagtcttctctggatggtggtgagacagaccctgtctcttgtctggcgatgtttggctccttggagctgcagcctggagttaatgaactggtggaggccatgatccagaggctcaagaagaaatctaatggtcggttcatagccatagacttgagggttgagatacttgagaagaagaactgccgtgagacaggtgcagggggatccaaaacatgttacaacgcgcaagagattgcagtgttcttgaggaagcttgggtttgatggtgacacgactatatacctgactcagcctaggtgggagagcagcctcaacattctcaaggacatcttccctaaaacgtttactaaggaggcgataatgccggcagagaagaagtctaagtaccttgagttagagaactcagagtatgaaaatgttattgacttctacataagttcgaggagtgatgtgtttgtgccagccattcctggtctgttttatgccaatactgttgggaaaaggatagctttagggaagcctcaagttcttgttccggcagagatctcagggacgtctggtctttctactgattacatctctccttatatctcgaagaagaatcatttggcgtattcatgcttttgctgaacttttgtggtgtaatttattatgagggaattgttttgccaaccaaatctataaaagggtcttttctca

SEQ ID NO: 1353 - DNA, 1547 bp, Brassica napus
ctcttctaaaccattccttaatcctccgtgaaaccattcaaaacacatttggagacagaggaggaggaacatagtgtagtaagaagatgggtgtggatttgaggcaagtggtggctggaatcctcaccattacaatgtttgtaatgctcggacaaatgcttcatagagattactttgatgctgttcaggttcaaggagatgcacatgacattgtattccatggatcaaaagtatctcttgaagaagatggacttgttagaacaagtgaagggccttggatggagaatagccatcaacttaaaccttgttggtcattatctcaacctgatgaagaggtatcatcaaagggttatgttacattctccttaaccaatggtcctgagtaccacatctctcagattactgatgctgtgatggtggccaagcatcttggagcaacgcttgtgctccctgatataagaggaagcaaacctggtgatgaaatgaactttgaagacatctatgatgtggacaaactcgttaaaagtttggaaagtgtagtaaatgttgtgaagaaactcccaagccacgtatctttaagagacatcgccattgttaaggttcctagccgagttgcagaagattacatcaaggaacatattgatcccatcttcaaatcaaaagggaacatcagagtcacaacctatttcccttctgtgaatctgaggaagtcttctctggatggtgagacagacccggtttcttgtttggcaatgtttggttccttggagctgaaaccaggagtgagtgacttggttgagtcgatgattcagcggcttaagaaatctgatggccgtttcatagccatagacttgagggttgagatacttgagaagaaaaactgccgtgaaacaggtggaatgggatccaagacatgttacaatgcgcaagagattgcattgttcttgaggaagcttgggtttggaagtgatacaactatatacttgactcagccaagatgggagagcagcctcaacattcttaaggacattttccctaaaacgtttactaaggaagctataatgccggcagagaagaaagggaagtatcttgagttagaaaactctgagtatgaaaatgttattgacttctacataagttcaaggagtgatgtgtttgtgccggccattcctggtctgttttacgctaacacagttggtaaaaggatagctttaggcaagcctcaagttcttgttccagctgagatctcaggaagttctggtctttctactgattacatctctccgtatatctcaaagaagaaccatttggcgtattcatgcttctgctgaacttctttgttgttatttatgagggaagtgttttactaagtgaaagagtcttctcactaagtgtaagccatctagttaccaggggttttactgttgtttattgataagtttagcttgataccagttcgaatcttagttaaatattatcattgagggttgtcttgtttaggaagaaaaacttttgtaagttacaatttgaatctattggctcatagc

SEQ ID NO: 1354 - DNA, 1112 bp, Brassica napus
aggagaaagctcagggagatgcacacgatattgaatttgaaggatctagagtatctgtgaaagatagtcttgtcggagccttagaaggcagtaaagggccttggatggatgataacaatgaccttaatccttgttggccaacattactatccgatgaagcggtatcatcaaaagggtatgttacattctcactaacgaatggtcctgagtaccatatctctcagatcactgatgctgtaatggtggcaaagcatcttggagcaacattagtgcttcctgatataagaggaagcaaacctggtgatgaaaggaactttgaagatatttatgatgccgataaactaatcaaaagcttggaaaaagtcatcaaagttgtcaaacaattgcctgaagaagtatctctaagggatatggccattataaaagtccctaccagagttacagaggactacattaaggagaacattgatccaatcttcaaatcaaaaggaaacatccgagttgctacgtatttcccttctgtaaacttgagaaaatcctcacaagacggcgaaactgatcctgtggcttgtttggcaatgtttggttccttggagttgcaacctgaactgaatgcagtagttgaatcaatggttgagaggttaagaacacatagcaggaaattaggtggccgttttatagcagtagaccttagaattgacttactcgagaagaaacattgccattcaactggcgtagtagggtccaagacatgttacaacgcgcaagagattgctttattcttgaggaagcttggatttgctggtgacacaactatctatctcactcagccaaggtgggacagtagcctcgatatccttaaggatatcttcccaaaaacgttcacaaaggaggcaatatttccagcaagtaagaaatcaaagtaccttgaatcagagagttcagagtatgaaaatgttattgacttctacataagctcgagaagcgatgtgtttgttccagccatatctggtttgttttatgcaaacatagttgggaagaggatagctttaggtaagccacaagtgctagttccagcagaaatctcagagacatctggccttgctacagta

SEQ ID NO: 1355 - DNA, 631 bp, Arabidopsis lyrata
ttttacgcaattcatcaatcatcatcagcatcaaattaaaacctcagcttttgcatttctctactaacacaaaactctcatttcggtgtctctgattgcgaatttgatctcaatattcgatttttgaaagatctctttcaatttcaccattcctggaccccaaacggaggaagagttcgatcatgaagtttggttattcctctggtcaaattcgatttgtgttttaagcaactgaagtaacaatgtcgaaaccgatcctgctcgtgggtctactagttatacttatagttacctctcagtttgaatggaggcaaccacttgttgagttagatacagccaccagctcgtctcagaaacagcagcaaatttcagatagggaagaagctgtcaaagagaagatcatcatatcacaagagagacatatccagaggctaaatgagcttgtcaggagtcttcaattgcagttgctgcaatgcaagggagagaatgagacccaaaatgccaccaaaagctatcatctaaacaaacaattcatcgaggtcgaaaggaaacaaatcctggaaggctaaactccggtaaaagttgtgaaagaaatcactctttaatttttgtgttcagatgttgtaatgta

SEQ ID NO: 1356 - DNA, 447 bp, Eutrema halophilum
gtgatttaaacaatttgaaaagtagcaatgtcgaagccgatcctgctcgtttttctactgattatacttatagtcacctctcagtttgaatggagacaaccacttgttgagcttgatgcagcaaccagcttgtcacagaaacagcagcaaatctcagatagggaggaagctgtgaaagagaagatcatcatgtcccaagagagacatatccagaggctaaatgagcttgtcaggagtcttcagttgcagttgctgcgatgcaagggagagaatgagacccaaaatgccaccaaaagctaccatatgaacaaaaaatacatcaaggaggtggagaggaaacaaatactggaaggataatctctcccctacaaaagctgaaatgatacgtaaaaattgtgaaagaaaagaccactctttgatattgtgtttaggtgttgtattgtatct

SEQ ID NO: 1357 - DNA, 365 bp, Eutrema halophilum
gtgatttaaacaatttgaaaagtagcaatgtcgaagccgatcctgctcgtttttctactgattatacttatagtcacctctcagtttgaatggagacaaccacttgttgagcttgatgcagcaaccagcttgtcacagaaacagcagcaaatctcagatagggaggaagctgtgaaagagaaggtaagatcatcatgtcccaagagagacatatccagaggctaaatgagcttgtcaggagtcttcagttgcagttgctgcgatgcaagggagagaatgagacccaaaatgccaccaaaagctaccatatgaacaaaaaatacatcaaggaggtggagaggaaacaaatactggaaggataatct

SEQ ID NO: 1358 - DNA, 754 bp, Brassica napus
tcgggggtagaaaatctgggaacacttattcctttctcataaatcaaagagccattcatcctctcaagcttttgcatttctcttctaataacacaaaactcattcattagggtgttccttatcactttattctcgaatcactttcaaaaagatctcgatcgatttcaccattttgcagaaaacccctagagaggtcgtcgatcatgaagtgttgccaaattcgctctgtgttttaaaaccactgaattagcgatgtccaagcccatcatgctcgtctgtctactagttatactcatagtcacctctcagtttgaatggagacaaccactcgttgaccttgatgcacccaccaccatctctcagaaacagcagcaaatttcagacagggaagaatctgtcaaagagaaaatcatcatatcgcaagagagacatatccagaagctaaatgagcttgtcaggagtcttcagttgcagttgcttcaatgcaagggagataatgggacccaaaatgccaccaaaagctttcattcagataaacatttcatcgaggtcgagaggaaacaaatcttccaaggctaatctcccttgcaaaaaaatgaaatgatacgtcaattcatttgaaagaaagatcactctttataatgtgtttcggtgttgtattgtatttatgctgatgttcatattgagaagatttttttttctgatattaaattttataaatatcaacctgtaaaacgggatatgattttgatta

SEQ ID NO: 1359 - DNA, 682 bp, Brassica napus
aggaaaatctgggaacactatcctttctcataaatcaaagagccattcatcctctcaagcttttgcatttctcttctaataacacaaaactcattcattagggtgttccttatcactttattctcgaatcactttcaaaaagatctcgatcgatttcaccattttgcagaaaacccctagagaggtcgtcgatcatgaagtgttgccaaattcgctctgtgttttaaaaccactgaattagcgatgtccaagcccatcatgctcgtctgtctactagttatactcatagtcacctctcagtttgaatggagacaaccactcgttgaccttgatgcacccaccaccatctctcagaaacagcagaaaatttcagacagggaagaatctgtcaaagagaagatcatcatatcgcaagagagacatatccagaagctaaatgagcttgtcaggagtcttcagttgcagttgcttcaatgcaagggagataatgggacccaaaatgccaccaaaagctttcattcagataaacatttcatcgaggtcgagaggaaacaaatcttccaaggctaatctcccttgcaaaaaaatgaaatgatacgtcaattcatttgaaagaaagatcactctttataatgtgtttcggtgttgtattgtatttatgctgatgttcatattgagaaga

SEQ ID NO: 1360 - DNA, 792 bp, Raphanus sativus
  misc_feature (288)..(288): n is a, c, g, or t
  misc_feature (310)..(310): n is a, c, g, or t
  misc_feature (399)..(399): n is a, c, g, or t
  misc_feature (402)..(402): n is a, c, g, or t
  misc_feature (560)..(560): n is a, c, g, or t
tcgatcatgaagtgtggtcaaattcgatctgtaagttgtagaaaataaataaagaaaatggaaacttttgccttttagaggtttgatgcattatcttggtaggtttgtcttaatggtgctatttgcttgactttatcagttgcagatttataaaattaatttctttttgtggatcccagcatatatttcttttgattctggctaggcttgacatgaatgtttaagattgtgtatatgattttatggaactggctgattcctttggaacaggtgttttaaaaaacaagngaattagcaatgtccaagcccntcatgctcgtctgtctactagttatacttatagtcacctctcagtttgaatggagacaaccactcgttgaccttgattcacccaccacnatntctcagaaacagcagcaattttcagacaaggaagaagctgtcaaagagaagatcatcatatcgcaagagagacatatccagaagctaaatgagcttgtcaggagtcttcagttgcagttgctgcaatgcaagggagataatgggacccaaaatgccancaaaagctttcattcagataaacaattcattgaggtcgagaggaaacaaatctttcaaggctaatctcccctgcaaaaaatgaaatgatacgtcaaagatcactcactctttataatgtatttaggtgctgtattgtatttatgttgatgttcatattgagaaggctttcctgatacattataacgaggctgaaaaaaatttaatataaaatatcataacctactatgaacg

SEQ ID NO: 1361 - DNA, 458 bp, Eutrema parvulum
gagttttaaaaaacaattgaaatagcaatgtcgaagcacatcatgctcgtttttgtattaattgtacttatagtcacctctcagtttgaatggagacaaccacttgttgttgaccttgatgcagccaccagcttgtctcagaaacaacagcaaattttagacagggaagaagctgtgaaagagaagatcatcatatcgcaagagagacatatccagaagctaaatgagcttgttaggagtcttcagttgcaggtgctccaatgcaaggaagagaatgagacccaaaatgccaccaaaagctaccatcttaacaaacaattcatcgaggaggtcgagagtaaacaaatcctggaaagctaatctctaccctgcaaaaaaactgaaatgatacgtgaaaaaacatgtgaatgaatgatcactctttgatattgtgtttaggtgttgtgttgtatctgtat

SEQ ID NO: 1362 - DNA, 1198 bp, Arabidopsis lyrata
ataaaagtctgtggcgaccaaaagaggcaaagagagagagaatgatattaactagtataagcctctcaacaccagtttcttctcaaaggttctctccacctcctgctactacaacgaggagatctcatatctctgtcacagtctgttcttccaaagggttgctgaagaatgctgagttaaaatgtttcttggagaagccaattggaaacctgtctttgagaaagcatcttgtttcagggttggcagctattttgcttctctctcaggcaggccagggtattgcgttggatctctcatctggttatcagaacatttgccaactagggagtgcttctgtggaagaaacaaagctgactcttccacttgacaatgcatctgatggtgactcggaagcgatgatgatgatgatgatgagaggcatgactactaagaactttgacccagttaggtactctggaagatggtttgaagtagcttctcttaagcgtggatttgcgggtcaaggccaagaagactgtcattgtacccagggggtatactcgtttgatatgaaggaatccgccattcgagtagatacattttgtgttcacggcagtcctgatggatatataacaggaatcagaggaaaagtccaatgcgtgggagcggaagacctggagaaaagcgagactgacttagaaaagcgagagatgattaaagagaagtgtttcctccgatttcccacaattccttttattcccaagttgccttatgatgtcatagccactgactacgacaactatgctcttgtttctggagccaaagacaagggctttgttcaggtatactcaagaacaccaaatccaggacctgagttcatcgccaagtacaagaactacttggcacaatttggctatgacccggataaaatcaaggatacaccacaggactgtgaagtgatgtctgatggtgagctagctgccatgatgaccatgccaggtatggagcaaacactgaccaaccagtttccagatcttggattaagaaagtcagtccagtttgaccccttcacaagtgtgtttgaaaccttgaagaaacttgtcccgctctatttcaagtagagcagcttcttttgctcaaagctattaaaaattcttatgtagatgatataatcactgtccttatacacatcttccagaatcaaacactcttctgatca

SEQ ID NO: 1363 - DNA, 1239 bp, Eutrema halophilum
aaaacaaaaaaaaacaaaaaaatctgtcgctcactgaatctcagagagaatggtaagtattccagtttcttcccaaagcttctctccacctgctactacaagaagatgctccttggttaggatcgacaagagatctcatttgcctgacacaatcagatgctgctgttcttccacagggtttcttaagaatcttgagttaaaatgttccttagagaatcccattcaaagcaagtctttgagaaaccgttttgtttcagagtttgcaaccattttgctcctctctcaggcaggccagggtgttgcgttggatctctcatctggtcatcaaaacatttgccaactagggaatgcttctgtggaagaaaagaatctgactcttccacttgtaaatggtgacccggaaacgatgatgatgatgatgacgagaggcatgacagctaagaactttgacccagttaagtactctggaagatggtttgaagtcgcttctcttaagcgcggttttgccggtcaaggccaagaagactgccattgtactcagggcgtatacacgtttgatatgaaagaaccagccataagggtagatacgttttgtgttcatggaagccctgatgggtatataacaggaatcagagggaaggttcaatgcgtggcagatgaagatttggagaaaagtgagactgacttagaaaagcgagagatgatcaaagaaaagtgtttccttcgatttcccacaattcctttcattcccaagttgccttatgatgtcatagccactgactacgacaactatgctcttgtctctggagccaaagacaagggctttgttcaggtatactcaagaacacctaacccaggacctgagtttatcgccaagtacaaaaactatttggcacagtttggctatgacccggagaaaatcaaggatactccacaggactgtgaagtgatgtctgatggtcagctagctgcgatgatgtccatgccaggtatggagcaaactctgacaaaccagtttccagatcttggattaagaaagtcagtccagtttgatcccttcacaagtgtgtttgaaaccttgaagaaacttgtcccgctctatttcaagtagaccaagctttatttgttccaagttttttgaattcttgtgtagatcacactgtccatatgcttatacacaaggctgagtgtatatacatcttccggaatcaaacaatcttttctgataataacaatatg

SEQ ID NO: 1364 - DNA, 1228 bp, Eutrema parvulum
ctgtttcatttattaaacagaagatgctctgtggttaggatcgatagtagatctcattattctgacagaatcagatgctgctcttcttccaaagtgtttccgaagcggcctgagttaaaatgttccctggagaatctaattgaaagcaaagctttgagaaagcattttatttcaggttttgctgccattttgcttctctctcaggcaggccagggtgttgcgctggatctctcgtctgatcatcagaacgtttgccaactagggagtgctgctctggaaggaaacaagcttactcttccacttgaaaatgcatctgatggtgatccggaaacaatgatgatgatgatgatgagaggcatgactgctaagaactttgacccagttaggtactctggaagatggttcgaagtagcttcccttaagcgtggtttcgctggtcaaggccaagaagactgccattgtacccagggagtatactcgtttgatatgaaggaaccagcgatacgggtagatacgttttgtgttcatggcagccctgatggatatataacaggaatcagaggaaaagttcaatgcgtgggagcggaagacctggagaaaaccgagactgacttagaaaagcaagagatgattaaagaaaagtgtttccttcgatttcccacgattcctttcattcccaagttgccttatgatgtcatagccaccgactacgacaactacgctcttgtttctggtgccaaagacaagggctttgttcagatatactcaaggacacctaccccaggacctgagttcatcgccaagtacaagacttatttggcacagtttggttacgatccagataaaatcaaggatactccacaggactgtgaagtgatgtctgatggtcagctagctgcaatgatgtccatgccaggtatggagaaaacactgacaaaccagtttccagatctagaattgcgaaagtcagtccagtttgatcccttcacaagtgtttttgaaaccttgaagaaacttgtcccgctctatttcaagtagagaagcttctctgctccaaggtttttttgaagtctttgtgtagattatttatcactgtccatatgcttatgcacctgactgagtgtatatatatgtatcttccacaatcaaacagtctttttctgataaataaactctgatcataaactccttgagttcgtatcaaacaacgaaatgcgaggcaaatatt

SEQ ID NO: 1365 - DNA, 1231 bp, Brassica napus
gtggcgatcaagagaagatggtaagtaacatcataactagcctgtcaatgacactagttcttcctcaaagcttcactcgacctgcaaatacaagatgctctgtggttaggaggatcaacagtagatctcattattctgacagaattatatgttccttggagaatcccactgaaagcaaggaggctttgagaaagcattttgtttcaggctttgctgccattttgcttctctctcaggcaggccagggtgttgccttggatctctcttcacgttatcacaacatttgccaactgggaagtgcttctgtggaaggaaacaagcctactcttccacttgatgatgacccggaagcgatgatgatgatgatgatgagaggcatgacggctaagaactttgacccagttaggtactctggaagatggttcgaagtggcttctcttaagcgtggctttgctggtcaaggccaagaagattgccattgtacacagggcgtatacacgtttgatatgaaggaaccagctatacgggtggatacgttttgtgttcacggtagccctgatgggtatataacaggaatcagaggaaaagttcaatgcgttggagcacaagacctggagaaaactgagactgacttagaaaagcaagagatgattaaagagaaatgttaccttcgatttcccaccattcctttcatccccaagttgccttatgatgtcatagctacagattacgacaactacgctcttgtttctggagccaaagacaggagctttgttcaggtatactcaaggacacctaacccgggacctgagttcatagccaagtacaaagactatttggcacagtttggctacgacccggagaatataaaggatactccacaggactgtgaagtgatgtctgatggtcagctagctgctatgatgtccatgccaggtatggagaaaacgctgacaaaccagtttccagatcttgaattaagaaagtcagtccagtttgatcccttcactagtgtgtttgaaactttgaagaaactggtcccactctatttcaagtagagaagcttctctgcccccaagaggttttttgaattctgtatgcagattatttatcactgtcaatatgcttgtgcacctgactgagtgtatagatactattcttttctaagataaactcaaagttattatccttgacttcgtataaaacaaacacaagcaaggcaaacgctatt

SEQ ID NO: 1366 - DNA, 1265 bp, Raphanus sativus
  misc_feature (1162)..(1162): n is a, c, g, or t
gacaaacaaattattaaaaacccttaaaaaagaaacaaaagaaattctgtggctaccaagagaagatggcaagtaacatcataactagcctgtcaacgacactagttcttccccagagcttcactcgacctgcaaatacgagatttgcggttaggaggatcaacagtagatctcacgattccaaagggtttctgaagaagtcaacagtaaaatgttccttggagaatcccattgaaagcaaggagactttgagaaagcattttgttgcagggtttgctaccattttgcttctctctcaggcaggccagggtgttgcattggatctctcatcaggtcaggatcacaacatttgtcaactgggaagtgctgctgtggaagaaaacaaacctactcttccacttgataatgacccggaagagatgatgatgatgatgatgagaggcatgactgccaagaactttgacccagttaggtactctggaagatggtttgaagtagcttctcttaagcgtggctttgctggtcaaggccaagaagattgccattgtacacagggagtatacacgtttgatatgaaggaaccagctataagggtagacacgttttgtgttcacggtagccctgatgggtatataacaggaatcagaggaaaagttcaatgcgttggagcacaagacctggagaaaactgagactgacttagaaaagcaagagatgattaaagagaaatgttaccttcggtttcccaccattcctttcatccccaagttgccttatgatgtcatagctacagactatgacaactacgctcttgtttctggagccaaagacaggagctttgttcaggtatactcaaggacacctaacccgggacctgagttcatagccaagtacaaagactatttggcacagtttggttacgacccggagaaaataaaggatactccacaggactgtgaagtgatgtctgatggtcagctagctgctatgatgtccatgccaggtatggagaaaacgctgacaaaccagtttccagatcttgaactaagaaaggcagtccagtttgatcccttcacaagtgtgtttgaaactttgaagaaactggtcccactctatttcaagtagagaagcttttctgccccctcaagagtctttttgaattntgaatgtagattatttatgctgcttgtacacctgactgagtgagtgtatagatatgaattattttctaagataaagtcatatgagcacaaagtcttattaaca

SEQ ID NO: 1367 - DNA, 1720 bp, Arabidopsis lyrata
cttctattctaatcatctccttgaattttccaagttttctccttttgtctttacttattttcccttgaataaaaatccaacttttctttgtttcagtcctctcttctgctctcattgatcttttaattaagtttgattctctccgtttatggcttaaccattttgatcgagattaactctcaggaaatcgacgagttggtaagttgttgttgtctgatcgttataaagattcaacctttttggtccgatcatggctgttgctgagaatgctggtgtcaaagtggactcttcgtctggtcagaatttagacaacaacactgattcagctaccgagacgaagccgccatgtcctgatgatgatcagagccctaaatctgactcatcgaatcctcctaccatcgattcgactccagaaactgacgatcggatcaatgagactgctcaaaagggtcagactttaaatgggtttaacagaaatggtgagagagataacaatggaggaagtctcaagactgagatcaaagatttggctgatgctttttctaagcttaatcccatggctcaggagtttgttcctccttctctcgctcgaagtcaatctggggttttcagaaatggattagggtttactaacaattttgcagccccacctaaacttgctgatgggaatgatcattttcctacaaggagaaggagttttggccaagggaagcgaagaattaacaaaagaacaagcttggctcagaaggacgatgtaatcaggagaactgtatatgtctctgacattgaccaacaggttaccgaggagaacctcgctggtgtctttattaattgtggacaggttgttgattgtcgtgtatgcggtgacccaaattctgtccttcgttttgctttcattgaatttaccaatgaagagggagctagggctgctttgagcatgtcgggtactgtgctcggtttttaccctcttaaggttcttccttccaaaaccgctattgcccctgttaacccgacttttcttccaagatctgaggatgagcgtgagatgtgcgttaggactgtttactgtaccaacattgacaagcggatcactcaaattgacttgaaagtcttctttgaaatgctttgcggggaggttcatcgtctgaggcttggagactatcaccaccaaacccgtattgcttttgttgagtttgcgatggcggaaagtgcaattgctgcgcttcactgcagtggtattgtcttgggggcactcccaataagggtaagtccatcaaagacaccagtaaggccgcactttccccgcgctgatttcaagtgaaatgatcgcgaaaaacactctcgctggagatgtcaaattatatagcaaacgagagagagagagaaagcagaagaagatgaagtctaaagaagaaggtacttgaggcgttttgtgtttatatttaaactctttttagatttattttaagttatgcttcgcggtcgcagagcctgcccggtatctttgaacaactcaagaactttggtctaaactttctcctttctatagtctccaaaaacaaaaaaaaaaaaaaaattggattatttttgttgttgttgaaattgagttaccctttggatatttttttatgaattatttaagacatttggtgaaattttctctctgtcggggaaaaaataaaatttcactgacctttagttgttaatttcagttagatct

SEQ ID NO: 1368 - DNA, 1698 bp, Eutrema parvulum
tgttccttctattctaatcatccccttggacttttccaaattttctctcttttgtttttctttctctaattatttccctttaaaaacctttttttttctttgtttcagtcgctcttctgctcattaatctttcagaggggttttctccatttatggaataccattgatcgagataattctcagaaatcggcgagttcgtaacttgtttctgatcttttggagattcacctttttggtccgatcatggccgtcgctgagaatgctggtgtgaaagtggactcttctggtcagaatttagacaacaacaacaacactgcttcttcagcagccgagacgaagccgccatgtcctgatgatcagagccctaaatccgattcgtctctcgactcatcgaatcctccgaccaacgattcgactccagattccgacgatcggaccaatgagactcccaaaaagggtccgactccaaatgggtttaacaaaaatggtatcgagtcgaaatcggaggatggtgagggagaaaacaatggagaatgtctcaagagtgagatcaaaaatttggctgatgcgttttccaagctcaatccgatggctcaggaatttgttcctccttcactggctagaagtcaatctggggttttgagaaatggattagggtttactaacaattttgcagcccaacctgttcctgcagatgggaatgatcgttttgctagaaggagaaggagctttggccaagggaagagaagaatgaacaaaagaaccagcttggctcagaaggaagatgtaatcaagagaactgtatatgtctccgacatcgatcaacagattaccgaggagacccttgcaggcgtctttattaattgtggacaggttgttgattgtcgtgtatgcggtgacccaaattctgtccttcgtttcgctttcgttgaattcaccaatgaagagggagctagggctgcgttgagcatgtcgggaacagtgcttggtttttaccctcttaaggtgcttccttccaaaactgctatcgcccctgttaacccgactttccttccgcggtctgaggatgagcgtgagatgtgcgtgaggacagtttactgtaccaacattgacaagcggattagtcaaactgacttgaaaggcttctttgaaatgctttgcggagaggttcatcgtctgaggcttggagactatcaccaccaaacccgcattgcttttgttgaatttgcgatggcagaaagtgcaattgctgctcttcactgcagtggtattgtcttgggcgcactcccaataagggtaagcccatcaaagacgccagtaaggccacactttcaccgcgctgagtgcaactgaagttattgcaaagctattgctggagatcccaaaaatatattatagaaatcgagagagaaagcaagaagaagaagaagaagaagaagaagtctaaagaagaagaaggtacttgaggcgttttgtgtttatatatcaaatcttttagtctttatttttaagtttgcttcgcagtcgcagagcctgcccggtatctttgaacaactttaagaactttggtcttaactttctcctttctatagagtcgccaaagacaacgattggtttctctttcttttgttgttgttattgtcgaaatacacttttggatcttttatgaattatttaagacatttggatcatttcatt

SEQ ID NO: 1369 - DNA, 1738 bp, Eutrema halophilum
tgttccttctattttaatcatccccttggatttttccaagtgttcccttttttatctttctgactttctctaaatattttttttctttaaaaatccttttttttttctttgtttcagtcgctcttctgctcaattgatctttttaagttgggttttctccatttatggaataccattgatcgagataagtctcaaaaatcggcgagttcgtaacttgtttctgatcttttggagattctcctctttggtccgatcatggcagtcgctgaaaatgctggtgtgaaagtggactcttctggtcagaatttagacaacaacaacaacaacactgattcttcagcagccgagacgaagccgccatgtcctgatgatcagagccctaaatctgattcctctctcgattcatcgaatcctccaaccagcgattcggctttagattccgacgatcggaccaatgagtctgccaaaaagggtcagaccccaaatgggtttaacagaaatggtttcgggtcgaaatcggagaatggtgagatagaaaacaatggagggagtctcaagagtgagatcaaaaacttgtctgatgcgttttctaagctcaatccgatggctaaggaatttgttcctccttcactggctcgaagtcaatctggggttttgagaaatggactagggtttaataacaattttgcatcccaacctgttctcgcagatgggaatgacaattttgctagaaggagaaggaactttggccaggggaagagaagagtgaacaaaagaaccagctcggctcaaaaggaagatgtaatcaggagaactgtatatgtttccgacatcgatcaacaggttactgaggagaatcttgcaggtgtctttgttaattgtggacatgttgttgattgtcgtgtatgcggtgacccaaattctgtccttcgtttcgctttcattgaattcactaatgaagagggagctagggctgctttgagcatgtcgggaacggtgcttggtttttaccctcttaaggtgcttccttccaaaactgctattgcacctgttaaccctactttccttccgcggtctgaggatgagcgcgagatgtgcgtgaggactgtttactgtaccaacattgacaagcggattactcaaattgacttgaaaggcttctttgaaatgctttgtggagaggttcatcgtctgaggcttggagactatcaccaccaaacccgcattgcttttgttgagtttgcgatggcggaaagtgcaattgctgctcttcactgcagtggtgttgtcttgggtgcactcccaataagggtaagcccatcaaagacaccagtgaggccgcagtttccccgtgctgagtgcaactaatattatcgcaaaactctcgccggaaatcggaaaaacttatgtagaaaaagagagagaaagcagaagaagaagaagaagaagaagaagaagaagtctaaagaagaaggtacttgaggcgttttgtgtttatatatcaatcttttagttttctttttttaagtttgcttcgcagtcgcagagcctgcccgggtatctttgaacaactttaagaactttggtctaaactttctcctttctctagagtcgccaaaaacaaaagattggttgtttctttctttttcttttgttgttgttattgttgaaataccctttcggatattattttttatgaattaatttaagacatttggagcaattcactggtcttttg

SEQ ID NO: 1370 - DNA, 1536 bp, Brassica napus
cccgttatttgcaggtaccggtccggcatccctggtcgaccacgcgtccgtaaaaaaaaatcaatttttgcttctttgtttcagtcgctcattgatctttaaagttgggtctatggagtagcattgatcgagacatctgcaagctcctaacttgtttctactcttttggagactcacaactctttggtccgatcatggccgtcgctgagaatgctggtgtgaaagtggactcttctggtcagaatttagacaacaacaacactgcttcttcagctaccgagaccaatccctcatgtcctgatgatcagagccctaaatccgattcctctcttgactcctcatcggatcctccagactccgacgatcggaccaatgagactgtccaaaagggtcagaccgcaaatggtgtaaagagtgagatcaagaacctgtctgatgcgttctcgaagctgaatccgatggctaaggagtttgttcctccttcgctggctcgaagtcaatctggggtttcgagaaatgggttagggtttactaacagtttcgcagcgcagcctcttgttgcagatggaagtggtcaattcgccagaaggagaaggagctttgggcaagggaggagaagagtgaacaaaagaaccagcttggctcagaaggaagatgtaatcaagagaactgtttatgtctctgatatcgatcatcaggttaccgaggagaacctagcaggtgtctttgttaattgtggacaggttgttgattgtcgtgtgtgcggtgatccaaactccgtcctccgttttgctttcgttgagttcaccaatgaagagggagctagagctgctttgagcatgtcaggaacagtgcttggtttttaccctcttaaggtgcttccttccaagaccgctatcgcccctgttaatccgactttccttccccggtctgagggtgagcgtgagatgtgcttgaggactgtctactgtaccaacattgacaagcggattagtcaagttgagttgaaaggcttctttgaaatgatttgcggagaggtttttcgtctgaggcttggagactatcacaaccatacccgcattgcttttgttgagtttgccatggcggatagtgcaattactgcacttcactgcagtggtatggtcttgggcgcactcccaataagggtaagcccatcaaagacgccagtgaggccgcacattcaccgcccatgagtgcaactgaaattatcaagtctattatagagaaagagagaaagaagcagaagtctaaagaagaagaagaaggtacttgaggcgttatgtgtttatatatatatatcaaaatgtttttaagtctttttaaatttaagtttgcttcggagtcgcagagccctgcctgcctgcccggtatctttgaacaactttcttttaactttctcctttctatagagtcgctcaaaaaccaaagactgtttttccttttgttattattattgtcgaaatgcccttttggatatttcttttatgaacggtttaagacatttggtgcaatttt

SEQ ID NO: 1371 - DNA, 1561 bp, Brassica napus
cccgttatttgcaggtaccggtccggcatccctggtcgaccacgcgtccgtaaaaaaaaatcaatttttgcttctttgtttcagtcgctcattgatctttaaagttgggtctatggagtagcattgatcgagacatctgcaagctcctaacttgtttctactcttttggagactcacaactctttggtccgatcatggccgtcgctgagaatgctggtgtgaaagtggactcttctggtcagaatttagacaacaacaacactgcttcttcagctaccgagaccaatccctcatgtcctgatgatcagagccctaaatccgattcctctcttgactcctcatcggatcctccagactccgacgatcggaccaatgagactgtccaaaagggtcagaccgcaaatggtgtaaagagtgagatcaagaacctgtctgatgcgttctcgaagctgaatccgatggctaaggagtttgttcctccttcgctggctcgaagtcaatctggggtttcgagaaatgggttagggtttactaacagtttcgcagcgcagcctcttgttgcagatggaagtggtcaattcgccagaaggagaaggagctttgggcaagggaggagaagagtgaacaaaagaaccagcttggctcagaaggaagatgtaatcaagagaactgtttatgtctctgatatcgatcatcaggttaccgaggagaacctagcaggtgtctttgttaattgtggacaggttgttgattgtcgtgtgtgcggtgatccaaactccgtcctccgttttgctttcgttgagttcaccaatgaagagggagctagagctgctttgagcatgtcaggaacagtgcttggtttttaccctcttaaggtgcttccttccaagaccgctatcgcccctgttaatccgactttccttccccggtctgagggtgagcgtgagatgtgcttgaggactgtctactgtaccaacattgacaagcggattagtcaagttgagttgaaaggcttctttgaaatgatttgcggagaggtttttcgtctgaggcttggagactatcacaaccatacccgcattgcttttgttgagtttgccatggcggatagtgcaatcactgcacttcactgcagtggtatggtcttgggcgcactcccaataagggtaagcccatcaaagacaccagtgaggccgcacattcaccgcccatgagtgcaactgaaatgatcaagtctattatagagaaagagagaaagaagcagaagtctaaagaagaagaagaaggtacttgaggcgttatgtgtttatatatatatcaaaatgtttttaagtctttttaaatttaagtttgcttcggagtcgcagagccctgcctgcctgcccggtatctttgaacaactttaagaactttggtcttttaactttctcctttctatagagtcgctcaaaaaccaaagactgtttttccttttgttattattattgtcgaaatacccttttggatatttcttttatgaacggtttaagacaatttggtgcaatttttactctctttattt

SEQ ID NO: 1372 - DNA, 1425 bp, Brassica napus
gggtctatggagtaacattgatcgagacatctgcaagctcctaacttgtttcaactcttttggagactcacaactctttggtccgatcatggccgtcgctgagaatgctggtgtgaaagtggactcttctggtcacaatttagacaacaacaacactgcttcttcagctaccgagaccaatccctcctgtcctgatgatcagagccctaaatccgattcctctctcgactcctcatcggatcctccgactccagactccgacgatcggaccaatgagactgtccaaaagggtcagaccgcaaatggtgtaaagagtgagatcaagaacctgtctgatgcgttctcgaagctcaatccgatggcgaaggagtttgttcctccttcacttgctcgaagtcaatctggggtttccagaaatgggttagcgtttactaacagtttcgcagcgcagcctcttgttgcagatggaaatggtcaattcgccacaaggagaaggagctttgggcaagggaggagaagagtgaacaaaagaaccagcttggctcagaaggaagatgtaatcaagagaactgtttatgtctctgatatcgatcatcaggttactgaggagaacctagcaggtgtctttgttaattgtggacaggttgttgattgtcgtgtgtgcggtgatccaaattccgtccttcgtttcgccttcgttgagttcaccaatgaagagggagctagagctgctttgagcatgtcaggaacagtgcttggcttttaccctcttaaggtgcttccttccaagaccgctatcgcccctgttaatcccactttccttccccggtctgagggtgagcgtgagatgtgcttgaggactgtctactgtaccaacattgacaagcggattagtcaagttgagttgaaaggcttctttgaaatgatttgcggagaggtttttcgtctgaggcttggagactatcacaaccatacccgcattgcttttgttgagtttgccatggcggatagtgcaattactgcacttcactgcagtggtatggtcttgggcgcactcccaataagggtaagcccatcaaagacgccagtgaggccgcacattcaccgcccatgagtgcaactgaaattatcaagtctattatagagaaagagagaaagaagcagaagtctaaagaagaagaagaaggtacttgaggcgttatgtgtttatatatatatatcaaaatgtttttaagtctttttaaatttaagtttgcttcggagtcgcagagccctgcctgcctgcccggtatctttgaacaactttcttttaactttctcctttctatagagtcgctcaaaaaccaaagactgtttttccttttgttattattattgtcgaaatgcccttttggatatttcttttatgaacggtttaagacattt

SEQ ID NO: 1373 - DNA, 2950 bp, Arabidopsis lyrata
caacacttttttcttcaccagtctcttcatcgttttggtgaggaaaacgatggccgatggatttcgcagctatggtggtttctctggaatagcgtacccgttgtggctctcatctccgcctccgcctcatccagcttctgcgccgccgtttcaaccaagcaatccggttgaatcctatgatccaaccaaagaagtgtttgatccgatgatgtatcccggctcttatcaacgatcgccggatgattggtcaaataatccatcgtatcgtgaaaattctcgctctcagacgccttcctcatcgttttacgctgacaatactcgacttggaaattgtggtccaagaggtgaagattattataaagaaatgttatcaccgagtggattttactcttcaagggaatcatcatctgattttgtgtcacttcccgctgacaatttctgggagaggcaacgtttgaactttacgcctacctacaactcagctaccttagctccagtgtcttcttatgcagatatgctaatcaaaaattctcgggaaccattctttacgcctattacgtcatctggtgtttacgcttctagcaatgttgttgatgagaatcgtcctggatattactttcctgaaactatgaatgttgtctctgcttctcatgtggagccttacataggtgttacagattgtaatccatctttgccaatgacgaatttgaaaacacaagctctctttgatggaagtcagaccggggttcgtttaggagatgggagatcattccctagcaacagtgatgtttgtagtcaagcgcctgagaattttttaggagctcaatccagcttgcagagttcctctgttgaaccagttaacttcgatgtgttgcttggatatggtgaagctactggtcatatcaggccttcgcccgagaatccagatcttcgctatcggatagctggctcgcaaggtttgagaagcccaggatcttcccaccccctaccagctaatattaattcctcagtgtcactgataaatgataaactagaaggtagtggtgtctcctccctttaccagaggccttacactttggttgctgacagtgagaatggtgtttctgagagctccttgaagaatgcatctgaagatttaaattgtcacgagcctcgatcttggagccacttcatggtaacctctgagggaccttcagctcccacgatgaaagcggataatgagaatgctcaatcagctgtcaactataaaccccctttcgaaggtggtaccacccaaactagtgaagatgttccaactaaccaaaagtcttgtaatctccaggaacaaacatttgatataatagatagagataagaagatcatgttgttgacagatctgggtctcgatttgagtagcagatcaaatgcagatgatgtctcaactggccgatcacctgaaaaacacttctgtgatcaaggagacttcccatctccgacttcttctccaagagtttcttctgtggttaacgccatgcataatttgtcagaagtgcttgtttatgaatgctttaacaatggaagctggctgaagctggagcaacttgagaaccttgacaaagtagtagataatctcacaaagtgcttaaagaaaataactgataataagtcaacagcaggggaagcctcacttccaacgcaagctatgcatgaggtatgctccagttttacgccggcattttgccgcgaagggaattgctaaagactttcaaggttttactgtcaagccactagacagctttggcgtcaaagaaccggtggataagaatgaaatgacccagagtattaagaacattcttgcttccaactttcctgatggtgaagaaaaccacccacaaactctcttgtacaagagtctctggctcgaaactgaagctgccttatgttccacaacttgcatggctcggtatcatcgggtcaagaacgagattgataatctcaaatttaacaataaagagatctctgcagatgcagcaacctttatgcaggaaccttctcttaacccccagaaatcggttcccatcatgaacaatgcaaatgcagagaaggagacaactgaatcgatcagcaaacatggaagcagttgtggaaacaatgtagtaacaatgagtcatgatgcatcacaatgttctagattcaactcagatcctgtggatgcagtattatcgcttatgtcccgaagctttacaggtggtttaaggcctgatgttgcaacctctgtaaagataccggatgcgatacggcaggaatcccctgcatccactacagagaacaaacataatgatgttatagaccggtttcagattctgaagcagcaggaaacagagcgcaaactcaagtctcagaagttaacagattcagacattgatgttatagaccggtttcagattctcaagaagcaggaaacgaatcgcaaactcaagactcaaaactgtccagagacaaaaaagggtgaccaggaggagaaactagaagcttcagtgatggctaatattggcagaagcagccatgtgagtgatgttatggatagattccagatactaaaacgccgggaagctgaacaagtgaagagatctctcaacaacttggatgtagattcagattcagacaatgaccagccacaaaagcgtgatcatctctggtcagcttcgatgttcccaatacgtggacattctcagagagaaacatgcgctgcggacactgaacaatctgcatctggcaaaggctacgagagcccgaactcggactgggaacatgtaatcaaggatgattgagtagtggaacttccttggacaagaagtttcgatcctatcatgaaagcttgttattataaataaaaggtatttgtagaataacatgaacgccattatgaatacgtttgttatgtatgataagggataaaactgcgtggatg

SEQ ID NO: 1374 - DNA, 2184 bp, Arabidopsis lyrata
attcctcacttccaaccgccaaaggaaaaaaaacaaaaactccaacaaaaaaaaaaaaaaaacttcccaaaccctacccgagcggtcgtcaaatgggtacggaggaatacagattccctcaaggaccggaggagctgcaccaccgccaccaccacaccgtggaggctcctcagcctcagccgttcttgaagtcacttcagtactcagtgaaggaaactctgtttccggacgacccttttagacaatttaagaaccaaaatgcatcaagaaaagttgtattaggcctcaaatacttcctcccgattttcgaatgggctccacgctacaatcttaagttcttcaaatcagatctcatcgccggaatcaccatcgctagtctcgccatccctcagggcatcagttacgccaaacttgctaacttgcccccaattcttggcctttattcgagttttgtaccgccactggtgtacgcggtgctagggagttcaagggatttagcggtgggaacggttgcggttgcgtctcttttgacaggtgcgttgctgagcaaagaagtcgatgctgagaaagatcctaagctttaccttcaccttgctttcaccgccacttttttcgccggcgttttcgaagcctctcttggaattttcaggttaggtttcatagtggactttctatcgcatgcaacgatagtaggattcatgggaggagcagcgacggtggtgagtctgcaacagcttaagggtattttcggacttaaacatttcacagacgccactgatgttatctccgtcatgcgttccgttttctcccaaactcaccagtggagatgggagagtggcgttctcggctgtggtttccttttctttcttctctctacaagatatttcagcacgaagaaaccaaaattcttttgggtggcggcgatggctcctttgacctcagtgattcttggaagtctcttggtttacttcactcacgctgagagacatggtgttcaagtgatagggaacttgaagaaaggattgaatccactctccggttctgatctcatctttacttcgccttatatgtcgacagctgtcaagactggtctcatcactggcatcatagctctcgctgaaggaatagctgtagggaggagttttgcgatgttcaagaactacaacatagacgggaacaaagagatgatagcgtttggaatgatgaacatcgttggttccttcacatcttgttacctcacaacggggccattttcaaggtcggccgtgaactacaacgcgggttgcaagactgcaatgtccaacatagtgatggcgattgcggttatgttcacactcctcttcctcacgccgctttttcactacacaccacttgtcgtcctctccgccatcatcatatccgcaatgctcggcctcattgactatcaagctgccatccatctctggaaagtcgacaagttcgacttcctcgtctgcatgagcgcctacgttggggtcgtattcggcagtgtagagattggactcatagtcgcagtggcgatatcgatagcgaggttgttgctgtttgtgtcgaggccaagaaccgcagtgaagggaaacataccaaacagcatgatctataggaacactgagcagtacccttcctcaagaactgtccctggtattcttatcttggagattgatgctcccatctattttgccaacgccagttacttgcgtgaaagaatcataaggtggattgatgaagaggaggagagagtcaaacaatcaggagaaagcagtttacaatatattatactcgatatgtcagctgttggtaatattgacacaagcggtataagcatgatggaggaaatcaagaaagtcatcgaccgaagagcgttaaagttggtattggcaaatccaaaaggagaggtggtgaagaaattaaccagatccaaattcatcggtgatcatttgggcaaagagtggatgttcttaacagtaggagaagctgtggaggcttgtagctacgtgcttcacacgtttaaaaccgaaccggcctccaaaaacgagccttggaacaacgtatagttcgttattaactagttcgatctgaactaaagtaaaaaaaacgaaactcattttgtaatattgatgatgagtcacatgcgatatatatgtactcttattttagtgttatgga

SEQ ID NO: 1375 - DNA, 2269 bp, Eutrema halophilum
aactcctcctataaaaagaagaaaccaccttagctcttctcctcattcctaaattccagccgccaaaaactccaacaaaatctttcctaaccacgaaccgaatccgagcggtcttcaaatgggcacggcggactacacatttcctcaaggagcggaggagtcgcaccgccgccaccacacggtggaggctcccgagcctcagccgttcttgaagtcacttcagtactcattgaaggaaactctgtttccagacgacccttttagacagttcaagaaccagaaagcatctaggaaagttgtattaggcatcaagtacttcttcccgatctgcgaatgggctccacgctacaatctcaagttcttcaaatcggatctcattgccggaatcaccatcgctagcctcgccatccctcagggcatcagttacgccaaactcgctaacttgcctcccattcttggcctttactcgagttttgtaccgccattggtgtacgcggtactggggagttcaaaggatttggcggtcggaacggttgcggttgcgtctctgttgacaggtgcgatgttgagcaaagaaatagacgctgagaaatatcctaagctttaccttcaaatcgctttcaccgccacgtttttcgccggcgttttcgaagcctcactcggctttttcaggttagggttcatagtggattttctatcgcatgcaacgatagtgggattcatgggaggagcagcgacggtggtgagtctgcaacagcttaagggtattttcggacttaaacatttcacagaagccactgatgttatctctgtcatgcgttccgttttctcccaaactcaccagtggagatgggagagtggcgttctcggctgtggtttccttttcttccttctctccaccaaatatttcagcacgaagaaaccaaaattcttctgggtggcggcgatggctcctttgacctcagtgattcttggaagcctcttggtttacttcactcacgctgagagacatggtgttcaagtgatagggaacctgaagaaagggttaaatccactgtccgtgtctgatctcgtcttcacttccccttacatgtcgacagctgtcaagactggcctcatcactggcatcatcgccctcgctgaaggtatagctgtggggaggagctttgcgatgttcaagaactacaacattgacgggaacaaagagatgatagcatttggaatgatgaacatcgttggttccctcacttcttgttacctcacaaccggaccgttttcgaggtcggccgtgaacttcaacgcgggttgcaagacagcagtgtcgaacatagtgatggcgattgcggtaatgttcacactgctcttcctcactccgcttttccactacacaccactcgtcgtcctctcctctatcatcatagccgctatgctcggcctcattgactatcaagctgcctttcatctctggaaagtcgacaaattcgacttcctcgtctgcatgagcgcctactttggtgttgtcttcggtagtgtcgagatcggtctcgtcctcgccgtggcgatatcgatagcgagattgttgctattcatgtcgaggccacggactgcggtgaagggaaacataccaaacagcatgatatataggaacactgagcagtatccttactcaagaaccgttcctggtcttctcattttggaaattgacgctcccatctactttgccaacgctggttacttgcgtgagagaatcacaaggtggatcgatgaagaggaagagagagtcaaaacatcaggagaaagcagtttgcaatatgttatactcgatatgtccgctgttggtaatatcgacacgagtggtataagcatgatggaggaaattaagaaaattatcgacagaagagcgctgaagttagtattggcaaatccgaaaggagaggtcgtgaagaaattaacaagatccaaattcatcgatggtaatttgggcaaagaatggatgttcttaacggtaggagaagccgtggaggcttgtagtttcaggcttcacacgttcaaaaacgaaccggcctccaaagaagagccttggaacaatgtataattccttttttttagtcgttttgagagtgctcgtaattaaattgctgtatgtaatcttaaatatcaggaaaaggtaattatcgcattttgtaaagtttactgtgtgtaacacatctcacatgcaatttgtactctttatgatctccttataagttacaacaagggtaaatgtaga

SEQ ID NO: 1376 - DNA, 2129 bp, Brassica napus
ctaaaccaaaccaacctgagaggtcttcaaatgggaacggaggacaacacattccctcaaggagcggaggagccacaccgccgccaccatgcggtggaggctccggatcctcagccgttcttgaagtcacttcagtattcagtgaaggaaactctgtttccagacgatcctttcagacagttcaagaaccagacgacatcaagacaagttgtactaggcctcaaatacttcttgccaatattggaatgggctccacgctacaatttcaagctctttaaatcagatctcatcgctggaatcaccatcgctagcctcgccatccctcagggcatcagttacgctaaactcgctaacttgcctcccattcttggcctttactcgagttttgttccaccattggtgtacgctgtgctggggagttcaaaggatttggcggtgggaacggtggcggttggatctttgttgacaggtgccatgctgagcaaagaagttgacgctgagaaagatcctaagctctaccttcatcttgctttcactgccacgtttttcgcaggcgttctggaagcctctctcggcattttcaggttagggttcatagtggattttctgtcgcatgcaacgatagtgggattcatgggaggagcagcgacggtggtgagtctgcaacagcttaagggtatttttggacttaaacattttacagaagccactgacgttatttctgtcatgcgttcagtcttctctcaaactcaccagtggagatgggagagtggcgttctcggctgttgtttccttttcttccttctttccaccagatatttcagcacgaagaaaccaaaattcttttgggtagctgcgatggctcctttgacctcagtgattcttggaagcctcttggtttacttcactcacgcggagagacatggtgttcaagtgataggggacctgaagaaagggttgaacccactctctgtgtctgatcttgtcttcacttcgccttacatgtcaacagctctcaaaactggcctcatcactgggatcattgctcttgcagaagggatagctgtgggaaggagctttgccatgttcaagaactacaacatagacggtaacaaagaaatgatagcgtttggaatgatgaacatcgttggttccttcacatcttgttaccttacaactggaccgttttcaagatcggccgtgaacttcaatgcgggttgcaagactgccgtgtccaacatagtaatggccattgcggttatgttcacattgctcttcctcacgccttttttccactacacgcccctcgtcgtcctctcctccatcatcatggtcgcaatgctcggactcatcgactatcaagctgccatccatctttggaaggttgacaaattcgatttcctcgtctgcatgagcgcctactttggggtcgtgtttggtagtgtcgagatcggacttgttgtcgcagtggtaatatcgatagcaaggttgttgctgttcgtgtcgaggccgaggactgcggtgaaaggaaacataccaaacaccatgatctataggaacactgaccagtatccttactcaagaattgttcctggtcttctcatcctggagattgatgctcccatctactttgccaacgctggttacttgcgcgagagaatcacaaggtggatcgatgaagaggaagataggatcaaagcatcaggaggaaatagtttacaatatgttatactcgatatgtctgctgttggtaatatcgacacgagtggtataagcatgatggaggaaattaagaaaatcatggacagaagagagttaaagttagtattggcaaatccaaaaggagaggtcgtgaagaaactaacaagatccaaattcataggtgacaatttgggcaaagagtggatgttcttaacagttggagaagccgtggaagcttgtagtttcatgcttcacacgtcaaagaccgaaccggcctccaaagaagagccttggaacaacgtttagccgcttatgtttttcattcgtttgagactgctcgtgatcaaataatagtatagtgtaaccgcatataaaagaaaaacgcattatgtataacattgttgttgatagtatgatttcgatttgta

SEQ ID NO: 1377 - DNA, 2266 bp, Eutrema parvulum
atgctcaaactcctataaagagacgaaaccaccttggctctactcctcattcctcacctccaaccgccaaaaataatattaaagactctcaacaaaaaaaacacgagctgtttccaaatgggcacggtggactacaaactccctcaagaagcggaggagccgcaccgccgctaccacacggtggaggctccgaagcctcagccgttcttgaagtcacttcagtactcagtgaaggagactctgtttccagacgatcctttcagacagttcaagaaccagaaggcatccacaagagttgtattaggcctcaaatacttcttcccaatatgtgaatgggctccacgctacagtctcagtttcttcaaatcggatctcattgccggaatcaccatcgctagcctcgccatccctcaaggcatcagttacgccaaactcgctaacttgcctcccattcttggcctttactcgagttttataccgccgttggtgtacgcggtgctggggagttcaagggatgtcgcggttggaacggttgcggttgcgtctctgttgataggtgcgatgctgagcaaagaagttgacgctgagaaagatcctaagctctaccttcagcttgctttcaccgccacgtttatcgcaggcgttctcgaagcctcccttggcattttcaggttagggtttatagtggattttctatcgcatgcaacgatagttggattcatgggaggagcagcgacggtggtgagtctgcaacagcttaagggtattttcggacttagacatttcacagaagccactgatgttatctccgtcatgcgttccgttttctctcaaactcaccagtggagatgggagagtggagttctcggctgtggtttccttttcttccttctttccaccaaatatttcagcatgaagaaaccaaaatttttctgggtggcggcgatggctcctctgacctcagttattcttggaagcctcttggtttacttcactcacgctgagagacatggtgttcaagtgatagggaacctgaagaaagggttgaatccattgtccgtgtccgatcttgtctttacttcgccttacatgtcgacagctgttaaaactggcatcatcactggcatcatcgctctcgctgaaggaatcgctgtaggaaggagctttgcgatgttcaagaactacaacatagacgggaacaaagaaatgatagcgtttggaatgatgaacatcgttggttccttcacatcttgttacctcacaaccggaccgttctcgagaacggccgtgaacttcaacgcgggttgcaagactgcggtgtcgaacattgtgatggcgattgcggttatgttcacattgctcttcctcacgccgtttttctactacacaccactcgtcgtcctctcctccatcatcatatccgcaatgcttggactcatcgactatcaagctgccattcatctctggaaagtcgacaaattcgacttcttcgtctgcatgagtgcctacattggggttgtgttcggtagtgtcgagatcggacttgttgtcgcagtggcgatatcgatagcaaggttgttgttatttgtatcgaggccgaagactgcggtgaagggaaacataccaaatagcatgatctataggaacaccgagcaatatccatactcaagaaccgttcctggtcttcttatcttggagattgatgctcccatctactttgctaacgctggttacttgcgtgagagaatcacaaggtggatagatgaagaggaagagagggtcaaaatatcaggagaaaacagtttacaatatgttgtactcgatatgtctgctgttggcaatatcgacacgagtggtataagcatgatggaggaaattaagaaagtcatcgacagaagagagttgaagttagtattggcaaatccaaaaggagaggtcgtgaagaaactaaccagatccgaattcatcggtggtagtttgggcaaagaatggatgtttctaacggtaggagaagcagtggaggcttgtagtttcatgcttcatacgttaaaaaccgaaccggcttccaaagaagaacaatggaacaacgtctagctagttccttgtttctataagtcgtttgagattgctcgttatcaaatgtacgatgtaatctcaaaaaaccgaaagcaaacgaaaaaacgcattttgtataaaactgatgatgattcacatgcaatctattctcttagtttctccctaagttacaaccatggtaaatgttatc

SEQ ID NO: 1378 - DNA, 2178 bp, Brassica napus
attcctcctttcagcgcaacagtcaatcaaaacttctacaaaaaacttactaaaccaaaccaacctgagaggtcttcaaatgggaacggaggacaacacattccctcaaggagcggaggagccacaccgccgccaccatgcggtggaggctccggatcctcagccgttcttgaagtcacttcagtattcagtgaaggaaactctgtttccagacgatcctttcagacagttcaagaaccagacgacatcaagacaagttgtactaggcctcaaatacttcttgccaatattggaatgggctccactctacaatttcaagctctttaaatcagatctcatcgctggaatcaccatcgctagcctcgccatccctcagggcatcagttacgctaaactcgctaacttgcctcccattcttggcctttactcgagttttgttccaccattggtgttcgctgtgctggggagttcaaaggatttggcggtgggaacggtggcggttggatctttgttgacaggtgccatgctgagcaaagaagttgacgctgagaaagatcctaagctctaccttcatcttgctttcactgccacgtttttcgcaggcgttctcgaagcctctctcggcattttcaggttagggtttatagtggattttctatcgcatgcaacgatagtgggattcatgggaggagcagcgacggtggtgagtctgcaacagcttaagggtatttttggacttaaacatttcacagaagccactgacgttatttctgtcatgcgttcagtcttctctcaaactcatcagtggagatgggagagtggtgttctcggctgttgtttccttttcttccttctttccaccagatatttcagcacgaagaaaccaaaattcttttgggtagctgcgatggctcctttgacctcagtgattcttggaagcctcttggtgtacttcactcacgcggagagacatggtgttcaagtgataggggacctgaagaaagggttgaacccgctctctgtgtctgatcttgtcttcacttcgccttacatgtcaacagctctcaaaactggcctcatcactgggatcattactcttgcagaagggatagctgtgggaaggagctttgccatgttcaagaactacaacatagacggtaacaaagaaatgatagcgtttggaatgatgaacatcgttggttccttcacatcttgttacctcacaactggaccgttttcaagatcggccgtgaacttcaatgcgggttgcaagactgccgtgtccaacatagtaatggccattgcggttatgttcacattgctcttccacacgcctttttttcactacacgcccctcgtcgtcctctcctccatcatcatggtcgcaatgctcggactcatcgactatcaagctgccatccatctttggaaggttgacaaattcgatttcttcgtctgcatgagcgcctactttggggtcgtgtttggtagtgtcgagatcggacttgttgtcgcagtggtaatatcgatagcaaggttgttgctgttcgtgtcgaggccgaggactgcggtgaaaggaaacataccaaacaccatgatctataggaacactgaccagtatccttactcaagaattgttcctggtcttctcatcctggagattgatgctcccatctactttgccaacgctggttacttgcgcgagagaatcacaaggtgggtcgatgaagaggaagataggatcaaagcatcaggaggaaatagtttacaatatgttatactcgatatgtctgctgttggtaatatcgacacgagtggtataagcatgatggaggaaattaagaaaatcatggacagaagagagttaaagttagtattggcaaatccaaaaggagaggtcgtgaagaaactaacaagatccaaattcatcggtgaaaatttgggcaaagagtggatgttcttaacagttggagaagccgtggaagcttgtagtttcatgcttcacacgtcaaagaccgaaccggcctccaaagaagagccttggaacaacgtttagccgcttatgtttttcattcgtttgagactgctcgtgatcaaataatagtatagtgtaaccgcatataaaagaaaaacgcattatgtataacattgttgttgatagtatgatttcgatttgta

SEQ ID NO: 1379 - DNA, 1873 bp, Brassica napus
aaaatccaacaaaaactttcctaaaccgaccggtcttcatatgggaacggttgactacacatttcctcaaggagcggacgagccgcaccgtcgccaccacacggtggaggctccagagcctcagccgttcttgaagtcacttcagtactcagtgaaggagactctgtttccagacgatcctttcagacaattcaagaaccagaacgcatcaagaaaagttgtactaggcctccaatacttcttcccaatatgtgaatgggctccacgctacaatctcaagttattcaaatcagatctcatagccggtatcaccatcgctagcctagccatcccacagggcattagttacgctaaactcgctaacttgcctcccattcttggcctttactcgagttttgttccaccactggtgtacgcggtgctggggagttcaagggatttggcggtggggacgacggcggttgggtctctgttgatgggtgcgatgcttagcaaagaagttaacgctgagaaagatcctaagctctaccttcatcttgctttcacagccacgtttttcgcaggcgttctcgaagcctccctcggcattttcaggttgggattcatagtggattttctatcgcatgcaacaatagtgggattcatgggaggagcagcgacggtggtgagcctgcaacagcttaagggtatatttggacttaaacatttcacagaagccactgatattatctccgtcatgcgttccgtcttctcccaaactcaccagtggagatgggagagtggcgttctcggctgtggtttccttttcttccttctttccaccagatatttcagcacgaagaaaccaaaattcttttgggtggcggcaatgactcctttaacctcagtaattcttggaagcctcttggtttacttcactcacgctgagagacatggtgttcaagtgatagggaacctgaagaaagggttgaatccactctccgtgtctgatatggtctttacttcgccttacatgtcgacggctgttaaaactggcatcatcactgggatcatagctctcgctgaaggaatcgctgtgggaaggagctttgcgatgtttaagaactacaacatagacggaaacaaagaaatgctcgcttttggaatgatgaacatcgttggttccctcacatcttgttacctcacaaccggaccattttcgagatcggccgtgaacttcaacgcgggttgtaagactgtggtgtcgaacatagtgatggcaattgcggttatgttcacattgctcttccttacgccgcttttccactacacaccactcgtcgtcctctcctccatcatcatatccgcaatgcttggactcatcgactaccaagctgctattcatctctggaatgtcgacaaattcgacttccttgtctgcatgagcgcttactttggggtcgtattcggtagtgtcgagatcggacttgttgtagcagtggcaatatcgatagcaaggttgttgctattcatgtcaaggccgagaactgcgataaagggaaacataccaaacagcatgatctatagaaatactgagcagtatccttactcaagaaccgttcctggtcttctcatcttggagattgatgcacccatctactttgcgaacgctggttacttgcgtgagagaatcacaaggtggatcaacgaagaagaagaaagggtcaaaacatcaggagaaaacagtttacaatatgttatactcgatatgtccgctgtcggtaatatcgacacgagtggtataagcatgatggaggaaattagaaatcgatcgacgagagcgttgagctagtattggacaatccgaaaggtcaagtcgtaaagaactagacct

SEQ ID NO: 1380 - DNA, 1999 bp, Brassica napus
ctctttaaatcagatctcatcgctggaatcaccatcgctagcctcgccatccctcagggcatcagttacgctaaactcgctaacttgcctcccattcttggcctttactcgagttttgttccaccattggtgtacgctgtactggggagttcaaaggatttggcggtgggaacggtggcggttggatctttgttgacaggtgccatgctgagcaaagaagttgacgctgagaaagatcctaagctctaccttcatcttgctttcactgccacgtttttcgcaggcgttctcgaagcctccctcggcattttcaggttagggtttatagtggattttctatcgcatgcaacgatagtgggattcatgggaggagcagcgacggtggtgagtctgcaacagcttaagggtatttttggacttaaacatttcacagaagccactgacgttatttctgtcatgcgttcagtcttctctcaaactcaccagtggagatgggagagtggcgttctcggctgttgtttccttttcttccttctttccaccagatatttcagcacgaagaaaccaaaattcttttgggtagctgcgatggctcctttgacctcagtgattcttggaagcctcttggtttacttcactcacgcggagagacatggtgttcaagtgataggggacctgaagaaagggttgaacccgctctctgtgtctgatcttgtcttcacttcgccttacatgtcaacagctctcaaaactggcctcatcactgggatcattgctcttgcagaagggatagctgtgggacggagctttgccatgttcaagaactacaacatagacggtaacaaagaaatgatagcgtttggaatgatgaacatcgttggttccttcacatcttgttacctcacaactggaccgttttcaagatcggccgtgaacttcaatgcgggttgcaagactgccgtgtccaacatagtgatggccattgcggttatgtttacattgctcttcctcacgccttttttctactacacgcccctcgtcgtcctctcctccatcatcatggtcgcaatgctcggactcatcgactatcaagctgccattcatctttggaaggttgacaaattcgatttcctcgtctgcatgagcgcttactttggggtcgtgtttggtagtgtcgagatcggacttgttgtcgcagtggtaatatcgatagcaaggttgttgctgttcgtgtcgaggccgaggactgcggtgaaaggaaacataccaaacaccatgatatataggaacactgaccagtatccttactcaagaattgttcctggtcttctcatcctggagattgatgctcccatctactttgccaacgctggttacttgcgcgagagaatcacaaggtggatcgatgaagaggaagataggatcaaagcatcaggaggaaatagtttacaatatgttatactcgatatgtctgctgttggtaatatcgacactagtggtataagcatgatggaggaaattaagaaaattatggacagaagagagttaaagttagtattggcaaatccaaaaggagaggtcgtgaagaaactaacaagatccaaattcatcgacgacaatttgggaaaagagtggatgttcttaacagttggagaagccgtggaagcttgtagtttcatgcttcacacgtcaaaaaccgaaccggcctccaaagaagagccttggaacaacgtttagccgcttatgtttttcattcgtttgagactgctcgtgatcaaataatagtatagtgtaaccgcaaataataacattgttgttgatagtatgatttcgatttgtattagtttgttgaattggcccatcttagagcatgattatccctatcacccttaatgagtttcttaatgatttttaatgaataaatgtaactaagaatccttaattaagaaacttccattttaaatggtccagtgggagtttcttaattaaagttcttaaa

SEQ ID NO: 1381 - DNA, 1680 bp, Arabidopsis lyrata
cttctgaaatcctcttgttggatgtattgttcaggtttgtaagtgctgatctgtctcagaaaaaaccaatggatgattgttccaaagatgtaatcaattgtttaccagacaatcttctttgtcaaatcttgtccaacttgtctacgaaagaagctgctttgacatcacttctctcaaaaagatggcggtatctgtttgctcttgtaccaaatcttgattttgatgtccttccctctctgcatcccgagattgcgatgcaggaccaggaccagacgagttttatagattttgtggatagagtattgaaattgcgaggaaatgatcatattaacaagttctctctaaaatgtggacatggtattgaggatgaagacgtcttcccttggatattaaatgcgttgagacatggtgtatcagatctttctctacatgtctctccttcattggtttattggttgccttcaaaggtttttgcgagtaagacactagttaggctgaaaataggacctaaagatggtcccagagttaaactgagaaatgtctgtcttccaaagcttaagactctaaatcttgattcagttgtgtttgaagaaggtaagattgggcttgcaaagcttctttctggttgtcccgttcttgaggaattagctttgcttaatcttgcgtgggatcgttgggattcttgctctgtgtcttccaaacttctcaagagactaacgctatgttgtgcacactataaaaaaaatccgaagagtgtatcatttgatactccaaatgttgtctactttgaatattctgataatattgcgcacaagtatccgaaagtgaattttgattcgctggttgaagctagtatcgatattcggatgacgaatgatcagaaagcaaatgcgagatatgtatcagatgttgatgaggaaacagtgatggttggcaatgcaacagatcttcttatgggaatatgcaatgtaaagaccctttacttatcttatgacactcttgagacacttcatttttgctgtcaagtgataccggtattcaacaacttgactcatctaactattgagagtcacccggaactaggatgggaatcattgccaaatctgctcaagagttgtccaaatcttgaaacccttgtcttccaaggactccttcacaaagcaacatatagatgtggggatgtgtgcttgtgccaaggtttggagaatagtccatcttgcttatcatcaagtccggtgaaatttctaaagatattgaaatttggagaaaccaatgttgatgacgatatggagatagagatggagcagatcaagaatttcttggagaaaatgccgaatcttgaacaactcatgatatactacaatacatcaatcgaaaatgatctagttgaagtatcaagccaacttcagatggttcctgcagtagcttcactcaaatgcaagattcaagtaatctctgataaccttagctcttgtcatccactttgcccatttccttgtcaatgaaatatggattgcacctctagaagaaccttactggtttcgtggaatcaatagtgcggtcatgtctcgtttgccacttggaagctatatatggatgtgtctcctggcttcaagtatctgtagttactaaaaatgtataaaaactcaaatcaagactctcttgtttctgttgttagta

SEQ ID NO: 1382 - DNA, 2654 bp, Arabidopsis lyrata
actcttcgccactttcttgtcatccaaacaattacacagttccctttttctccattattgcttctcaaaaaaaaacatgtaaatttgtttcatgaatcgttctcaattttcttcaacgagattcattgttgttacgagctcttcaatattgggttctttgcttctgtgtcttcttatctggatttctataccctaaacttgtattgagaatgttctgtaatatgggtttcttcgatttcaagtagtctcctttttcgtgtctccctcatatcgggtttaaactcatcttctccgagagtgtttaaccgaagaagccctccaagtgtttgacgatttgtctgagagagataaaaaaacagaggaacttgaaaacagagtaatttacagaaagaagccatcatggaagagacttttgttccgtttgaaggtatcaagaatgatgttaaaggaaggttaatgtgctacaaacaagattggatcggaggaatcaaagctggatttaggattctagctcctaccacatacatattcttcgcgtctgcgattcctgttatttcattcggcgaacagttggaacgaagcactgatggagttcttaccgctgttcagacactggcctctacagccatctgcggaatcattcactcgatcatcggaggccagcctctgcttatactcggagttgctgagccaactgtaattatgtacacattcatgttcaactttgctaaagggagacctgaactgggacgcaatttgttcttggcttggtctggatgggtttgtgtctggacttcgttgatactgtttgtgttggctatatgtggagcttgttcaattatcaacagattcaccagagtagctggagaattgtttggacttcttatagctatgctcttcatgcaacaagccatcaaaggattagtcgatgaattccgtgctcctgcgagggaggatctgaaacttgtggagtttttaccttcctggagatttgcaaatgggatgtttgctttggttctttcctttggtcttcttataactgcacttagaagcagaaaagccagatcatggagatatggaacaggctggcttagaagtttaatagctgactatggtgtgccactcatggttctggtgtggaccggtgtctcgtacatcccaacaggagatgttccaaaaggaattcctcggcgactttttagcccaaatccttggtcccctggtgcttatgagaattggactgtcgtaaaggagatgcttcaagttccaattgtctacataattggagcattcattccagcgacaatgattgcagttctttactacttcgatcatagtgtagcatcacagcttgcgcagcagaaagaatttaatttgagaaaaccatcttcttaccactatgatctgctgcttcttgggtttctgaccttaatgtgtggtctacttggaattcctccatcaaatggagtcatccctcagtcaccaatgcataccaagagcttagcaacactaaaatatcagctgcttcggaacagactagttgcaactgcacgcagaagcatcaagcagaatgcgagtttaggacagttgtatggaaacatgcaagatgcttataatcagatgcagactccattagtctaccagcagcctcagggtctgaaagagctaagagaatcaacaatccaagcaacaacattcacaggaaatcttgatgctccagttgatgagactctgtttgatatcgagaaagagatcgatgatttattgccaattgaagtcaaagaacagagagtaagcaacttgcttcaagcaataatggttggaggatgtgttgcagctatgcctctccttaaaatgatccctacatcagtcctttggggctactttgccttcatggcaatcgaaagcttacccggaaaccaattctgggaaagaatcttacttctcttcacagccccaagtcgtcgattcaaggtccttgaagataaccacgcgacattcgtggaaaccgttccattcaaaacgatcgcaatgttcacaattttccaaacaacttatcttttaacttgctttggtctcacgtggatcccaatcgctggagttatgttccctctaatgatcatgtttctaatacccgtaaggcaatatatcctcccaagattcttcaaaagtgctcatcttcaggacttagacgcagcagagtatgaagaagcacccgctttaccattccatctcgcagtaccggaagctgagatgggatcaacagcttcgtatccatgtgattctgagattcttgatgagtttattacaagaagcagaggagagtttagacacacatgtagtcctaaagttactagttcgacttcaacgccggtttataatcggaatctgtctcaagtgtttagtcctagagtgaatgatttaagaggtgagatgagtcctaggctcgccgggaaagggcaaagtagtccaaagccgagtcctttaaacccatcatcgtcgtcgaaatgagtttacagatgatggaggcttaatgaaactggaggagattatgtttaaaattagttgattaattgatcttggatctaatgctttcttgagttttttatgtttgcatttctgctcttgatctcgaatcattgtaaaatctctct

SEQ ID NO: 1383 - DNA, 2783 bp, Eutrema halophilum
gccacgaaagacgtacattgcaatctgctcagctgacaactttgccactttcttgccatccaaacaatacagtccccttttctttattattgcttctcaattacttctcaaaacactttatcatgtaaagtctgttccatgaatcgttcccaatcttcttctacgaggagattcattgttattacgagctccttaatattggattcctttcttctgagtcttcttatctgtttttttttctccatttttcttctcttccctgaacttgtattgagaatgttctgtaatatgggtttgttcgatttcaagtagttctcctcttcgtttctgcccccataaccgggtgtctgcttgtgttgtagaaggctctccaagtgtttgacgatttgtctgacagaaaaaaacagaggaacttagaaacagagtggattttacagagagtagccagccaccatggaagagacattcgttccgtttgaaggtatcaagaatgatcttaaaggaaggttaacgtgctacaaacaagattggaccggaggattcaaagctggatttaggattctggctcccaccacatacatattctttgcatctgccattcctgttatttcattcggggaacaattggaacgaagcaccgatggagttcttacagctgttcagacactggcatctacagccatttgcggaatcattcactcgattatcggaggccagcctctgcttatactcggagttgcggagccaactgtaattatgtacacattcatgtttaactttgcgaaagggagacctgagctggggcgcaatttgttcttggcttggtctggatgggtttgtgtctggacttcgttaattttgttcgtgttggctatatgtggagcttgttcaataatcaacagattcaccagagtagctggagaattgtttggacttcttatagctatgctattcatgcaagaagccatcaaaggattagttgatgaatttcgctcccctgagagagaaaatctgaaacttctggagtttttaccttcctggagatttgcaaatgggatgtttgctttagttctctcctttggtctacttataactgcacttagaagtagaaaagccagatcctggagatatggaacaggctggcttagaagcttaatagctgactatggtgtcccactcatggttcttgtttggaccggtgtctcctacatcccaacaggagatgttccgaaaggaattccccggcgactttttagcccaaatccttggtcccctggtgcttatgagaattggaccgtcgtaaaggagatgcttgaagttccaattgtatacattattggagcttttattcctgcaacaatgattgcagttctttactacttcgaccacagtgtagcatcgcagcttgcacagcagaaagaattcaatttgagaaaaccatcttcttaccactatgatctgcttcttcttggttttttgaccttaatatgtggtctacttggaatccctccatcaaatggagtcatacctcaatcaccaatgcataccaagagcctggcaacactaaaatatcagctgcttcggaacagactagttgcaactgcacggagaagcattaagcagaatgcgagtttaggacagttgtatggtaacatgcaagaggtttataatcaaatgcagactccattagtctatcagcagcctcagggtctgaaagagctgaaagaatcaacaatacaagcgacaacattcacaggaaatctcgatgctccagttgatgaaactctgtttgatatcgagaaagaaatcgatgatttattgccaattgaagtcaaagaacagagagtaagcaacttgcttcaggcactaatggttggaggatgtgttgcagccatgcctctccttaaaatgatccctacatcagtcctttggggctatttcgccttcatggccatcgaaagcttacctggaaaccaattctgggaaagaatcttacttctcttcacagccccaagtcgtcgattcaaggtccttgaagacaaccacgcgacattcgtggaaactgttccattcaaaacgattgcaatgttcactattttccaaacaacttatcttctaatctgctttggtctcacatggatcccactcgctggagttatgttccctctaatgatcatgtttctagtacctgtaaggcaatatatccttccaagattcttcaaaagtgctcatcttcaggacttagacgcagcagagtatgaagaagcacccgctttaccattcaacctcgcagtaccggaagctgagatgggatcaacagcttcatatccatgtgattctgagattcttgatgagtatattacaagaagtagaggagaatttagacacacatgtagccctaaagtcactagttcgacttcaacgcctggttttaatcggaatctgtctcaagtgtttagtcctagagtgaatgaaaggagaggtgagatgagtcctaggctcgccggaaaagggaaaaatagtccaaagccgagccctttgaacccgtcatcgtcatcaccgtcgaagtgagaatagcgattatggaggcttaataaaacccgagagattatgtttaaaactagtcgattaataaaagctttcttgagtttttcgtttttaacctatgttttacgtatgcatttcctgttcttgatctcgatacgaatcactgtcaaaatcttacttactctttcgactgccggtaaacttatattatatgtactactaaaagaggcaaacat

SEQ ID NO: 1384 - DNA, 2733 bp, Eutrema parvulum
gccaccgaagacgtacattgcaatctgctcagctgaaacaactttgccactttcttgtcatccaaacgatacattccccttttcaccattgttgtttatccattacttaaaaaaaaacacactttatcatgtaagcttgttccatgaatcattcccaatcttcttcttcaacgagattcattgttgttacgaccatcttaatattggtttctggatcttatcatctggagttttgtgcatctttcttctgtcccctaaacttgtattgagaatgttttgtaatatgggtttgttcgatttcaagtagttttcctcttcgtctctcctccagtaatcgggtttaagctcatctgcttgttttcggggagtgttttaaccgaagaagctctccaagtgtttgatgatttgtctgagagaaacaaaaaacagaggagcttagaaacagagtgacttacagagagaagccagccaccatggaagagactttcgttccgtttgaagggatcaagaatgatcttaaaggaaggttaatgtgctacaaacaagattggactggaggattcaaagctgggtttaggattcttgctcccacaacatacatattcttcgcgtctgcgattcctgttatctcattcggcgaacaattggaacggagcacggatggagttcttactgctgttcagacactggcatctacagccctttgcggaatcattcactcgattatcggaggccagcctctgctaatactcggggttgcagagccaactgtaattatgtacagattcatgtttaactttgcaaaagggagacctgagttgggacgcaatttgttcttggcttggtctggatgggtttgtgtttggacttcgttgattctgtttgtgatggctatatgtggagcttgttcaataatcaacagattcaccagagtagctggagaattgtttggacttctcatagctatgctcttcatgcaagaagctatcaaaggaatagttgatgaatttcgctctcctgagagggaaaatctgaaacttctggagttttcaccttcctggagatttggaaatgggatgtttgctttggttctctcctttggtcttcttataactgcacttagaagtagaaaagccagatcctggagatatggagcaggctggcttagaagcttaatagctgactatggtgtgccactcatggttctggtgtggaccggtgtctcctacatcccaacaggagatgttccaaaaggaattccccggcgactttttagcccaaatccttggtcccctggtgcttatgagaattggaccgtcataaaggagatgcttgaagttccaatagcctacataattggagccttcattccagcaacaatgatcgcagttctttactactttgaccatagcgtagcatcacagcttgctcagcagaaagaattcaatttgagaaaaccatcttcttaccactatgatctgcttcttctcgcgtttctgaccttaatgtgtggtctacttggaatccctccgtcaaacggagtcattcctcaatcaccaatgcatacgaagagcttagcaacactaaaatatcagcttcttcggaacagactagttgctactgcgcgcagaagcatcaagcagaatgcaagtttaggacagttgtatggaaacatgcaagaagtctataatcaaatgcagactccattagtataccaacagcctcaaggtctgaatgagctgagagaatcaacaatccaagcgacgacattcacaggaaatcttgacgctccagttgatgaaactctgtttgatatcgagaaagaaatcgatcatttattgccaattgaagtcaaagaacagagagtaagcaacttgcttcaagcagtaatggttgggggatgtgttgcagctatgcctctcctcaaaaggatccctacatcagtcctttggggctacttcgccttcatggccatcgaaagcttacccggaaaccaattctgggaaagaatcttacttctcttcacagccccaagtcgacgtttcaaggtccttgaagataaccacgcgacattcgtggaaactgttccattcaaaacgattgcgatgttcaccatcttccaaacaacttatcttctaacctgctttggtctcacatggatcccaatcgctggagttatgtttcctctaatgatcctatttctaatacctgttaggcaatacatcctcccaaagttcttcaaaggtgctcatctacaggacttagacgcagcagagtatgaagaagcagccgctttaccattcaatctcgcagtagtggaagctgagatgggatcaacagcttcttatccatgtgattctgagattcttgatgagtttattactagaagcagaggagagtttagacagacatgcagtcctaaagttactagttcgatttcaacgccggtttataaccggaatctgtctcaagtgtttagtcctggagtgaatgaattgagaggagagataagtcctagggtctccggaaaagggaaaaatagtgcgaagccaagcccttttaacccctcatcgtcatcgccatcgaagtgagattagtgattatggagacttaatgaaaccggaggagattatgtttaaaaactagttgattaattgaactatggtttgcagcctatggtttgcgtttgcattttctgctcttgatcttgattcgaatcaatgtaaaatctct

SEQ ID NO: 1385 - DNA, 2430 bp, Brassica napus
atggaagagacgtttgtgccgtttgaaggaatcaagaatgatctcaaaggcagactcatgtgctacaagcaagactggaccggtggattcaaagctggctttaggattctagctcccaccacttacatattcttcgcctctgcgattcctgtcatctccttcggtgaacagctcgaaagaaacactgatggagttctcacggctgttcagaccttagcatccaccgccatttgcggcatcattcactctgttatcggaggtcagccactgcttatactcggtgttgcagagccgactgttattatgtatacattcatgtttaacttcgcaaaggctagacctgaactgggacgagacctcttcttggcttggtctggatgggtttgtgtttggactgctttgatgctgtttgtgatggctatatgtggagcttgttccatcatcaacaggttcacccgtgtagctggggagttgtttggactgcttatcgctatgctcttcatgcaacaagccatcaaagggctagtggatgaatttcgcattcccgaacgagaaaatcagaagctgatggagttcttaccttcctggaggttcgctaatgggatgttcgctctggttctctcctttggccttctgctaaccggacttagaagccgaaaagctagatcatggcggtacggtactggctggctcagaagcttaatagcagactatggtgtaccactgatggtactagtgtggaccggtgtctcctacattccatcaggagatgttccaaaaggaatccccaggcggcttcttagcccaaatccttggtctcctggtgcttatggaaactggaccgtagcaaaggagatgcttgatgttccaatcgtttacataataggagctttcattccagcgtcaatgattgctgtgctttactactttgatcatagcgttgcttctcagcttgctcagcagaaagagttcaatttgagaaaaccttcttcttaccactacgacttgcttcttcttgggtttctgaccttaatgtgtggtctacttggagtccctccatcaaatggtgtcattcctcaatctccaatgcacaccaagagcttagcaactcttaaatatcagttacttcgtaacagactggttgcaacagcaagaaaaagcatcaaaacgaatgctagtttggggcaactctacaacaatatgcaagaagcttaccatcacatgcagacaccattagtataccagcaacctcaaggtttaaaagaactaaaagaatcaacaatccaagcaactacattcaccggaaacctcaacgctccagttgatgaaactctattcgatatagagaaagagattgatgatttgttaccagtggaagtcaaagagcagcgtgtaagcaacctccttcagtccacaatggtaggaggatgcgttgctgctatgcctatccttaaaatgatcccaacctctgtcctttggggttacttcgccttcatggctattgagagcttacctggaaaccagttctgggagagaatcttacttctcttcaccgccccaagtcgccgcttcaaggttcttgaagattaccacgcaacgttcgttgagacggttccattcaagacgattgcgatgttcactattttccaaacggtttatctgttaatctgctttggcctcacatggatcccaatagcaggagtcatgttccctttaatgatcatgttcttagtccccgtaagacaatacatcctccctagattcttcaaaggagctcatcttcaggacttggacgcagcagagtatgaagaagctccagctttacccttcaatctcgcagcggaaacggagattggatcgacaacttcgtatccaggagactcagagattcttgatgaggttattacacgaagcagaggagagtttagacacacgagtagtcctaaggtcacgagttcgagttcgactcctgtcaataataggagtttgtctcaagtgtttagtccacgagtgggtgaactcaggtttggtcagatgagtcctcgagtcgttggtaatagtccaaagcctgttagttgtggaaggagtcccttgaaccagtcctcgtcaaagtgagatgatatatatattcagaaagctcaataaaacaaaaccacccccaatgaggatgaatgtttaattagttaattaatttgatctttagttattataagaaacaaaagctttcttgaataatctctctttagttaatgtgttgtatgtgtttgtaatccccttcccttgtgttttagttttatcttttgagtttctgtaaaatcttacttataatgtaactctgtgtggcaaggcaaatatgtataaagacttacaaaatgttataacggtaagcaatctttttatatgatcggctgtcgcacacttgttttttta

SEQ ID NO: 1386 - DNA, 2708 bp, Arabidopsis lyrata
gccagttgccaccagacatataacacattgaaagaagcagcttatgtaattcaacgacataccaccctaatcaaaatctcactctccctctctttcttcatgtaaattctttccttttttacatgtatctttcttcatcgagattcgatcttcttcttcttctcacgaacctccttattgggtttcccctgcattctcctattcttcgctaaaccttgaataaagacatgttcttcgacatgggtttttccggtttaaagtagttcagtcttcgtttcccccttaaaccgggtttgagctcaaccttttcgtagaagaactccaagtgtttgacaaattgactgagagaaacagagcaactgagtcatggaagagacttttgtgccgtttgaaggaatcaagaatgatcttaaaggaagattgatgtgctataagcaagattggactggtggattcaaggctggatttaggattctagctcccaccacttacatatttttcgcgtctgcgattcctgtcatctcattcggtgaacaactggaaagaagcaccgatggagttctcacggctgttcaaaccttagcatctacagccatttgcggcatgatacactccattatcggaggtcagccactgcttgttctcggagttgcagagccaactgtgattatgtacacattcatgtttaactttgcaaaggccagacctgaattgggacgagacctcttcttggcgtggtctggatgggtttgtgtttggactgctttgatgctgtttgtgttggctatatgtggagcttgttccatcatcaataggttcactcgagtagctggagaattgtttggacttcttattgctatgctcttcatgcaacaagccatcaaagggctagtcgatgaattccgcattcctgaacgagaaaatcagaagctgaaggagttcttaccttcctggaggtttgctaatgggatgtttgctctggttctctcctttggccttcttctgactggacttagaagcagaaaagccagatcatggcggtacggaactggctggctcagaagcttaatagctgactatggtgtaccactcatggtgctcgtgtggaccggtgtctcttacattccagcaggagacgttccaaaaggaattccccggcgactttttagcccaaatccttggtcccctggtgcttatggaaactggaccgtagtaaaggagatgcttgatgttccaatcgtctacataattggagctttcattccagcatcaatgattgctgtgctttactacttcgaccatagtgttgcttcacagctcgcgcagcagaaagaattcaatttgagaaaaccgtcttcttaccactatgacttgcttcttcttgggtttctgacattaatgtgtggtctacttggagtccctccatcaaatggtgtcattcctcaatctccaatgcataccaagagcttagcaactcttaaatatcagttgcttcgtaacagactggtcgcaacagcacgaagaagtatcaaaacgaatgcgagtttgggacaactctatgacaatatgcaagaagcttacaatcacatgcagacaccattagtataccagcaaccccaaggtttaaaagagctcaaggaatcgacaatccaagctactacattcaccggaaacctcaatgctccagttgatgaaactctgttcgatatagagaaagaaattgatgatttactaccagttgaagtcaaagaacaacggttaagcaacttgcttcagtctacaatggtaggaggatgcgttgcagctatgcctatccttaaaatgatcccaacatcagtcctttggggctattttgccttcatggccatcgaaagcttacccggaaaccaattctgggaaagaatcttacttctgttcaccgccccaagtcgccgcttcaaggttcttgaagactaccacgcgacattcgtggaaaccgttccattcaagacgattgcaatgttcactcttttccaaacgacttatctcttaatctgctttggcctcacatggatcccaatcgcaggagtcatgttccctttaatgatcatgttcttaatccccgtacgacaatatctcctccctagattcttcaaaggagctcatcttcaggacttggacgcagcagagtatgaagaagctccagctttaccctacaatctcgcagcggaaacggaaattggatccacaacatcgtatccgggagatttggagattcttgatgaggttattactcgaagcagaggagagtttagacacacgagtagtcctaaggtcacaagttcaagttcaactccagtcaataatcggagtttgtcacaagtgtttagtccaagagtgagtgaaatcaggttgggtcagatgagtcctcgagtcgtcggaaatagtccaaagccggtgagtcgtgggaggagtcccttgaaccagtcgtcatcatcgaactgagattatattcaggaagcttaataaaagatactaaaaatctaatgtggatggattaagaatgtttaattagttaattaatttgatctttagctcttaagaaaaaaaaaaaggcttcttgaatctttctttagtttatgttttgtgtgtttaatccctttgtggtgtttgatcttgagtcttatgtaaaatactaaaatgtcttacttatttcataatatatgtaa

SEQ ID NO: 1387 - DNA, 2737 bp, Arabidopsis thaliana
cgttgccagttgccaccagacatacataacacattgaaagcagcttattcatcgacataccaaactctcactctcgccctcgctctcgccctcgctctctttctttcttcatgtaaattgtttgttcttttccatgtatcgagattcgatcttcttcttcttcacacgaacctccttattgttttctcctgcattctctctattcttcgctaaaccttgaataaagacatgttctttaacatgggtttttccggtttaaagtagttgtatctttgtttcccctttaaaccgggtttaagctcaatcttttcttagaacaactccaactgtttgacgatttgactgagagaaaacagagtcatggaagagacttttgtgccgtttgaaggaatcaagaatgatcttaaaggaagattgatgtgctataagcaagattggactggtggattcaaagctggatttaggattctggctcccaccacttacatatttttcgcttctgcgattcctgtcatctcatttggtgaacaactcgaaagaagcaccgatggagttctcacggctgttcaaaccttagcatctacagccatttgcggtatgatacattcgattatcggaggtcagccactgcttattctcggtgttgcagagcctactgtgattatgtacacattcatgtttaactttgcaaaggccagacctgaattgggacgagacctgttcttggcgtggtctggatgggtttgtgtttggactgctttgatgctgtttgtgttggcaatatgtggagcttgttctatcatcaataggtttactcgagtagctggagaattgtttggactgcttattgctatgcttttcatgcagcaagccatcaaagggctagttgatgaattccgcattcctgaacgagaaaatcagaagctgaaggagttcttaccttcctggaggtttgctaatgggatgtttgctctggttctctcctttggccttcttctgactggacttagaagcagaaaagccagatcatggcggtacggaactggctggctcagaagcttaatagctgactatggtgtaccactcatggtgctcgtgtggaccggtgtctcctacattccagcaggagatgttccaaaaggaattcctcggcgactttttagcccaaatccttggtctcctggtgcttatgggaactggaccgtagtaaaggagatgcttgatgttccaatcgtctacataattggagctttcattccagcatcaatgattgctgtgctttactacttcgaccatagtgtagcttcacagctcgcgcagcagaaagaattcaatttgagaaaaccgtcttcttaccactatgacttgcttcttcttgggtttctgacattaatgtgtggtctacttggagtccctccatcaaacggtgtcattcctcaatctccaatgcataccaagagcttagcaactcttaaataccagttgcttcgtaacagactggtcgcaacagcacgaagaagtatcaaaacaaatgcgagtttgggtcaactctatgacaatatgcaagaagcttaccatcacatgcagacaccattagtataccagcaaccccaaggtctaaaagagctcaaggaatcgacaatccaagctactacattcaccggaaacctcaatgctccagttgatgaaactctgttcgacatagagaaagaaatagatgatttactaccagttgaagtcaaagaacaacgggtaagcaacttgcttcagtctacaatggtaggaggatgcgttgcagctatgcctatccttaaaatgatcccaacatcagtcctttggggctattttgccttcatggccatcgaaagcttacccggaaaccaattctgggaaagaatcttacttctgttcaccgccccaagtcgccgcttcaaggttcttgaagattaccacgcgacattcgtggaaaccgttccattcaagacgattgcaatgtttactcttttccaaacgacttatctcttgatctgctttggtctcacatggataccaatcgcaggagtcatgttccctttaatgatcatgttcttaatccccgtacgacaatatctcctccctagattcttcaaaggagctcatcttcaggacttagatgcagcagagtatgaagaagctccagctttacccttcaatctcgcagcggaaacggagattggatccacaacatcgtatccgggagatttggagattcttgatgaggttatgacccgaagcagaggagagtttagacacacgagtagtcctaaggtgacaagttcaagttcgactccagtcaataatcggagtttgtcacaagtgtttagtccaagagtgagtggaatcaggttgggtcagatgagtcctcgagtcgtcgggaatagtccaaagccggcgagttgtgggaggagtcccttgaaccagtcgtcatcgaactgagattatatattcaggaagcttaataaaacaactaatctaatgaggatggattaagaatgtttaattagttaattaatttgatctttagctcttgaaaaagaaaagagcttcttgaatctctctttagtttatgttttgtgtgtttaatcccctttcgtggtgtttcatcttcagtcttatgtaaaatactaaaatgtctgtcttatttcgttatatatgtaaaattcgttaaatattttcaactgttatgtttaccggtcag

SEQ ID NO: 1388 - DNA, 2857 bp, Eutrema halophilum
cttgccagttgccaccagacataacacaaaatacattgcagcttcatgtaatttaacgactcatcactttctcgtcatccaaaaaaaaacacacacacacacagtttcgctttttttctttaattgatttctcgatatcatgtaaattgtttccatgtatcgtttcccagcttcttcatcgagattcgatcttcttcttcttcttcttcttacgaacctccttattgggttttcctgcatttttatctcctgctcttcgctaaccttgaattgagagatgttcttcaaaatgggtttgtccggtttgaagtagtttatgaggtgtttcccccttaaatcgggtttgagctcaatcttcttcccttgtcggagagtaaatcaccgtagaagaactccaagtgtttgacgaattgactgaacggagaaacagagcgagtgagtgtagaaaggcatggaagagacttttgtgccgtttgaaggaatcaagaatgatcttaaaggaagattgatctgctataagcaagattggaccggaggattcaaggctggatttaggattctggctcccaccacatacatattctttgcgtctgcgattcctgtcatctcattcggtgaacaactggaaagaaacaccgatggagttctcacggctgttcagaccttagcatccaccaccatttgcggcatgatacactcgattatcggaggtcagccactgctcatactcggagttgcagagccaactgtaattatgtatacattcatgtttaactttgcaaaggcgagacctgaactgggacgaaacctgttcttggcgtggtctggatgggtttgtgtttggactgctttgatgctgtttgtgctggctatatgtggagcttgttccttcatcaataggttcactcgagtagctggggaactgtttggactgcttattgctatgctcttcatgcaacaagccatcaaagggctagtggatgaatttcgcattcctgaacgggaaaatcagaagctgatggaattcttaccttcctggaggtttgccaatgggatgttcgctctggttctctcctttggccttctcctaactggacttagaagcagaaaagccagatcatggcggtacggatctggctggctcagaagcttaatagctgactatggcgtaccactcatggtgctagtgtggaccggtgtctcctacattccagcaggagatgttccaaaaggaattccccggcgactttttagcccaaatccttggtcccctggtgcttatggtaattggaccgtagtaaaggagatgcttgatgttccaatcgtccacataattggggctttcattccagcatcaatgattgctgtgctttactacttcgatcatagcgtagcttcacagctcgcgcagcagaaagaattcaatttgaggaaaccgtcttcttaccactacgatttgctgcttctcgggtttttgaccttaatgtgtggtctactcggtgttcctccctcaaatggtgtcattcctcaatctccaatgcataccaaaagtttagcaactcttaaatatcagttgcttcggaacagattggtggcaacagcacgaagaagcatcaaaacgaatgctagtttgggacaactctataacaatatgcaagaagcttatcatcatatgcagacaccactagtataccagcaacctcaaggtttaaaagaactgaaagaatcgacaatccaagcaacgacattcaccggaaacctcaatgctccagttgatgaaaccctgttcgatatagagaaagaaattgatgacttgttaccagtcgaagtcaaagaacaacggttgagcaacttccttcagtctacaatggtaggaggatgcgttgcagctatgcctatccttaaaatgatcccaacatcagtcctttggggatatttcgcattcatggccatagaaagcttacctggaaaccaattctgggaaagaatcctacttctcttcacagccccaagccgtcgcttcaaggttcttgaagattaccacgcgacgttcgtggaaaccgttccattcaagacaattgcaatgttcaccattttccaaacgatttatctcttaatatgctttggcctcacatggatcccaatcgcaggagtcatgttccctttaatgatcatgttcttaattcccgtacgacaatacatactccctagattctttaaaggagctcatcttcaagacttagacgcagcagagtatgaagaagccccggctttacctttcaatctcgcagcggagacggagattggatccacaacttcgtatccaggagactcagagattcttgatgaggttattacacgaagcagaggagagttcagacacacgagtagtcctaaggtcacgagttcgagttcgactccggtcaataatcggagtttgtctcaggtgtttagtccacgagtgggtgaactcaggttgggtcagatgagtcctcgtatagtcggaaacagtccgaagccggcgagttgtgggaggagtcccttgaaccagtcgtcgtcgaactgagattatatactcagtaagctcaataaaacagtacccaatgaggctgaatgtttaattagttaattaatttgatcttagctcttaagacaaaagaaaaagaaaaaagaaaaaccttcttgaatctctctttactctatgtgttttgtgttttatgcccctccactctgctctggtgtttgacctcgagtcatgtaaaatctcttccttatttcgtaatacgtacatgtaatgataaggggcaaatatgtaaaaaggcttaaatgttaacggtaagcaatctttaaatagctc

SEQ ID NO: 1389 - DNA, 2409 bp, Brassica napus
actccaagtgtttgacgaattgactgaacgaaacagagcaactaatggaagagacgtttgtgccgtttgaaggaatcaagaatgacctcaaaggcagactcatgtgctataagcaagactggaccggcggattcaaagctggctttaggattctggctcccaccacttacatattcttcgcctctgcgattcctgtcatctccttcggtgaacagctcgaacgaaacactgatggagttctcacggctgttcagaccttagcatccaccgccatttgcggcatcattcactctgttatcggaggtcagccactgcttatactcggtgttgcagagccgactgtgatcatgtatacattcatgtttaactttgcaaaggctagacctgaacttggacgtgacctcttcttggcttggtctggatgggtttgtgtttggactgctttgatgctgtttgtgatggctatatgtggagcttgttctatcatcaataggttcactcgtgtagctggtgaactgtttggactgcttatcgctatgctcttcatgcaacaagccatcaaagggctagtggatgaatttcgcattccggaacgggagaatcagaagctgatggagttcttaccttcctggaggttcgctaatgggatgttcgctctggttctctcctttggtcttcttctaacaggacttagaagcagaaaagccagatcatggcgctacggtactggctggctcagaagcttaatagctgactatggtgtgccactaatggtgctagtgtggaccggtgtctcctacattccatcaggagatgttcctaaaggaatccctcggagacttcttagcccaaatccttggtcccctggtgcttatggtaactggaccgtggccaaggagatgcttgatgttccagtcgtctacataataggagcttttattccagcatcaatgattgctgtgctttactactttgatcatagcgtagcttcacagcttgctcagcagaaagagttcaatttgaggaaaccttcttcttaccactatgacttgcttcttcttgggttcctgactttaatgtgtggtttactcggagtccctccatcaaatggtgtcattcctcaatctccaatgcacaccaagagcttagcaactcttaagtatcagctgcttcgtaacagactggttgcaacagcaagaaaaagcatcaaaactaatgctagtttggggcagctctacaacaatatgcaagaagcttatcatcacatgcagacaccattagtataccagcaacctcaaggtttaaaagaactgaaagaatcaacgatccaagcaactacgttcaccgggaacctcaacgctccagttgatgaaactctattcgatatagagaaagagattgatgatttgttaccagtggaagtcaaagagcagcgtgtaagcaacttccttcagtccacaatggtaggaggatgcgttgctgctatgcctatccttaaaatgatcccaacctctgtcctttggggttacttcgcctttatggctattgagagcttacccggaaaccagttctgggagagaatcttacttctcttcaccgcccctagtcgccgcttcaaggttcttgaagactaccacgcaacgttcgttgagacggttccattcaagacgattgcaatgttcactattttccaaacggtttatctgttaatctgctttggcctcacatggatcccaatagcaggagtcatgttccctttgatgatcatgttcttaatccccgttagacaatacatcctccctagattcttcaaaggagctcatcttcaggacttggacgcagccgagtatgaagaagctccagctttaccctttaatctcgcagcggaaacagagattggatcgacaacttcgtatccaggagactcagagattcttgatgaggttattacacgaagcagaggagagtttagacacacgagtagtcctaaggtcacgagttcgagttcaactccgctcaataataggagtttgtctcaagtgtttagtccacgagtgggtgaactcaggtttggtcagatgagtcctcgagtcgttggtaatagtccaaagcctgttagttgtggaaggagtcccttgaaccagtcctcgtcaaagtgagatgatatatatatatattcagaaagctcaataaaacaaaaccacccccaatgaggatgaatgttaatagttaataatttgatcttagttattataagaacaaaagctttcttgaataatctctctttagtttatgtgttgtatgtgtttgtatcccttcccttgttgttttttttttattctttgtagtttcttagtaaatactaatactattaaaagggaaggagtacttaaaaatactacctgcaca

SEQ ID NO: 1390 - DNA, 2847 bp, Eutrema parvulum
ttgccagttgccaccagacataacacaaaatacattgcagcttgatgtaattcaaagactcatcactttctcgtcatccaaaaaaaaacaaactttcgctctcttgatttctcgatatcatgtaaactgtttccatgtatcgtttcccagcttcttcatcaagattcgatcttcttctcacgaacctccatattgggttttcctgcatttttatctcctgctcttcgctaaccttgaattgagagatgttcttcaaaatggggttgtcgggtttgaagtagtttatgaggtgtttcacccttaaatcgggtttgagctcaatcttctccccttgccggagagtaaatcaccggagaagaactccaactgtttgacaaattgactgaacgaaacagagaaacagagcaagtgagtgtagaagaaagtcatggaagagactttgatgccctttgaaggaatcaaaaatgatcttaaaggaagattgatgtgctataagcaagattggactggaggattcaaagctggatttaggattctggctcccaccacatacatattcttcgcgtctgcgattcctgtcatctcattcggtgaacaactggaaagaaacacggatggagttctcacggctgttcagaccttagcatccaccgccatttgcggcatgatacactcgattatcggaggtcagccactgcttatactcggagttgcagagccaactgtgatcatgtatacattcatgtttaacttcgcaaaggccagacctgaactgggacgaaacctcttcttggcgtggtctggatgggtttgtgtttggacttctttgatgctgtttgtgatggctatatgtggagcttgttccatcatcaataggttcactcgtgtagctggggagttgtttggactgcttattgctatgctcttcatgcaacaagccatcaaagggctagtggatgaattccgcattcccgaacgggaaaaccagaagcttaaggaattcttaccttcctggaggtttgctaatgggatgttcgctctggttctctcctttggccttcttctaactggacttagaagcagaaaagccagatcatggcggtatggaactggctggctcagaagcttaatagctgactatggtgtaccactcatggtgctagtgtggaccggtgtctcctacattccagcaggagatgttccaaaaggaattccccggcgactttttagcccaaatccttggtcccctggtgcttatggaaattggaccgtagtaaaggagatgcttgatgttccagtcgtctatataattggagctttcattccagcatcaatgattgctgtgctgtactactttgatcatagcgtagcttcacagcttgcgcagcagaaagaattcaatttgaggaagccgtcttcttaccactacgatttgcttcttctcgggtttctgaccttaatgtgtggtctactcggagtccctccatcaaatggtgtcattcctcaatctccaatgcataccaaaagcttagcaactcttaaatatcagttgcttcgtaacagactggttgcaacagcacgaagaagcatcaaaacgaatgcgagtttgggacaactctataacaatatgcaagaagcttatcatcacatgcagacaccattagtataccagcaacctcaaggtttaaaagaactgaaagaatcgacaatccaagcaactacattcacaggaaacctcaatgctccagttgatgaaactctattcgatatagagaaagaaattgatgatttgttaccagtcgaagtcaaagaacagcgggtaagcaacctccttcagtctacgatggtaggaggatgcgttgcagctatgcctatccttaaaatgatccctacagcagtcctttggggatatttcgccttcatggccatcgaaagtttacccggaaatcagttctgggaaagaatcctactcctcttcaccgccccaagtcgtcgcttcaaggttcttgaagattaccatgcaacattcgttgaaaccgttccattcaagacaattgcaatgttcactatcttccaaacgatttatctcttaatctgttttggcctcacatggatcccaatcgcaggagtcatgttccctttaatgatcatgttcttaattcctgttcgacaatacatcctccctagattctacaaaggagctcatcttcaggacttagacgcagcagagtatgaagaagctccagctttgccctttaatctcgcagcggaaacggagattggatccacaacttcgtatccaggagactcagagattcttgatgaggttattacacgaagcagaggagagtttagacacacgagtagccctaaggtcacgagttcgacttcgactcctctcaataatcggagtttgtctcaagtgtttagtcctcgagtgggtgaaatcaggttgagtcagatgagtcctcgagtcgtcggaaatagtccaaagccggcgagttgtgggaggagtcccttaaaccagtcgtcgtcgaactgagagactatgtataaattcaggaagcttcaataaaacaaaacccgatgaggatgattgtataattacttaatgagtctgatctttagttctaaacgaacaaaaacacaagcttcttgaatctctttttagtttatgtgttgtgtgtttttatgcccctttttctggtgtttgttcttgaatctgtaaaatctttcttatttcatgatatatgtaacgatattgggggcagatatgtaaaaatacttaaatgttaacggtaagcatatcttttactaatcgtctgttccgatctgtttttgttttta

SEQ ID NO: 1391 - DNA, 2403 bp, Brassica napus
ttcttttattgatttctctcgataacatgtaaactggttccatgtatcgtttcccagtttcttcattgagattcaatcttcttcttctcacaatcctccttactcctgatcttcactaagctcgagttgagagagatgttcttcgaaatgggtttgaagtagttttatgagtttattcccccccttaaaacgggtttgagctcagatcttttaacctccgttctcggagagagaagaagaactccaagtgtttgacgaattgactcaacgaagctatggaagagactttcgtgccgtttgaaggaatcaagaatgatctcaaaggcagagtcatgtgctacaagcaggactgggccggaggattcaaggctggattcaggattctggctcccaccacttacatattcttcgcctctgcgattcctgtcatctccttcggtgaacaactcgaaagaagcaccgatggagttctcacggctgttcagaccttagcatccaccgccatttgcggcatcattcactccattatcggaggtcagccactgcttattctcggcgttgctgagccaactgtcatcatgtatactttcatgtttaactttgcaaaggccagacctgaacttggacgtaacctcttcttggcttggtctggatgggtttgtgtttggactgctttgatgctgtttgtgatggctatatgtggagcttgttccatcatcaataggttcactcgtgtagctggagaactgtttggactccttattgctatgctcttcatgcaacaagccatcaaagggctagtggatgagtttcgcattcctgaccgggaaaatcagaaactgaaggagttcttaccttcctggaggtttgctaatgggatgttcgctctggttctctcctttggccttcttcttactggacttagaagcagaaaagccagatcttggcgctacggatctggctggctcagaagcttaatagctgactatggagtaccactcatggtgctagtgtggaccggtgtctcctacattccagcaggagatgttccaaaaggaatcccccggcgactttttagcccaaatccttggtcccctggtgcttatggaaattggaccgtagttaaggagatgcttgatgttccaatcgtccacataattggagcgttcattccagcgtcaatgattgctgtgctttactacttcgatcatagcgtagcttcacagcttgcgcagcagaaagaattcaatttgaggaaaccctcttcttaccactacgacttgcttcttcttgggttcctgacattaacgtgtggtttactcggaatccctccatcaaatggtgtcattcctcaatctccaatgcataccaagagcttagccactcttaaatatcagttgctccgtaacagactggttgcaacagcacgaagaagcatcaaaacgaatgcgagtttgggacaactctataacaatatgcaagaagcttatcaccacatgcagacaccattagtctaccagcagcctcaaggattaaaagaactgaaagaatcaacaatccaagcaactacattaaccggaaacctcaatgctccggttgatgaaactctgttcgatatagagaaagagattgatgatttgttacctgttgaagtcaaagaacagagggtaagcaacttccttcagtccacaatggtaggaggatgcgttgctgctatgcctatccttaaaatgattccaacatcagtcctctggggatattttgccttcatggccatagaaagcttacccggaaaccagttctgggaaagaatcttgcttctattcacagccccaagtcgtcgcttcaaggttcttgaagattaccacgcaacattcgttgaaaccgttcctttcaagacaattgcaacgttcactattttccagacgatttatctcttagtctgctttggcctcacatggattccaatagcaggagttatgttccctttaatgatcatgttcttgattcccgtacgacagtatatcctccctagattcttcaaaggagctcatcttcaagacttagacgcagcagagtatgaagaagctccagcgttacccttcaatctcgcagcggaaacggagattggatcgacaacttcgtatccaggagactcagagattcttgatgaggttattacacggagcagaggagagtttagacacacgagtagtcctaaggtcacaagttcgaattccactccagtcaataataggagtttgtctcaagtgtttagtccacgagtgggtgaactcaggttgggtcaaatgagtcctcgagtcgttggaaatagtcctaaaccaccgagtactgggaggagtcctttgaaccattgctctcattgaactgagattatatata

SEQ ID NO: 1392 - DNA, 2726 bp, Brassica napus
gtcagacataacacacacgaagtatacattgcaagcttcatgtaatttcaacgacttaccactttcttctcatccaaatcaaaaagacacacttctttcttttattgatttctctcgatagaatgtaaactggtcccatgtatcgtttcccagtttcttcattgagattcaatcttcttcttcttcttctcctcataatcctccttactcctgatcttcgctaagctcgagttgagagagatgttcctcgaaatgggtttgaagtagttttatgagtttattcccccccttaaaacgggtttgagctcagatcttttaacctccgttgtcggagagagaagaagaactccaagtgtttgacgaattgactcaacgaagctatggaagagactttcgtgccgtttgaaggaatcaagaatgatctcaaaggcagactcatgtgctataagcaagactggaccggaggattcaaggctggattcaggattctggctcccaccacttacatattcttcgcctctgcgattcctgtcatctccttcggtgaacaactcgaaagaagcaccgatggagttctcacggctgttcagaccttagcatccaccgccatttgcggcatcattcactctattatcggaggtcagccactgcttattctcggtgttgctgagccaactgtaatcatgtatactttcatgtttaactttgcaaaggccagacctgaacttggtcgtaacctcttcttggcttggtctggatgggtttgtgtttggactgctttgatgctgtttgtgatggctatatgtggagcttgttccatcatcaataggttcactcgtgtagctggggagttgtttggactccttattgctatgctcttcatgcaacaagccatcaaagggctagtggatgagtttcgcattcctgaccgggaaaatcagaaactgaaggagttcttaccttcctggaggtttgctaatgggatgttcgctctggttctctcctttggccttcttcttactggacttagaagcagaaaagccagatcttggcgctacggatctggctggctcagaagcttaatagctgactatggtgtaccactcatggtgctagtgtggaccggtgtctcctacattccagcaggagatgttccaaaaggaatcccccggcgactttttagcccaaatccttggtcccctggtgcttatggaaactggaccgtagttaaggagatgcttgatgttccaatcgtccacataattggagctttcgttccagcgtcaatgattgctgtgctttactacttcgatcatagcgtagcttcacagcttgcgcagcagaaagagttcaatttgaggaaaccctcttcttaccactacgacttgcttcttcttgggttcctgacattaatgtgtggtctactcggagtccctccatcaaatggtgtcattcctcaatctccaatgcataccaagagcttagccactcttaaatatcagttgcttcgcaacagactggttgcaacagcaagaagaagcatcaaaacgaatgcgagtttggggcaactctataacaatatgcaagaagcttatcaccacatgcagacaccattagtttaccagcagcctcaaggtttaaaagaactgaaagaatcaacaattcaagcaactacattaaccggaaacctcaatgctccggttgatgaaactctgttcgatatagagaaagagattgatgatttgttacctgttgaagtcaaagaacagagggtaagcaacttccttcaatctacaatggtaggaggatgcgttgctgctatgcctatccttaaaatgattccaacatcagtcctttggggttattttgccttcatggccatcgaaagcttacctggaaaccagttctgggagagaatcttgcttctcttcacagccccaagtcgtcgaggttcttgaagattaccacgcaacattcgttgaaaccgttccattcaagacaattgcaacgttcactattttccagacgatttatctcttagtctgctttggcctcacatggattccaatagcaggagttatgttccctttaatgatcatgttcttgattcccgtacgacagtacatcctccctagattcttcaaaggtgctcatcttcaagacttagacgcagcagagtatgaagaagctccagctttacccttcaatctcgcagcggaaacggagattggatcgacaacttcgtatccaggagactcggagattcttgatgaggttattacacggagcagaggagaatttagacacacgagtagtcctaaggtcacaagttcgaattccactccagtcaatagtaggagtttgtctcaagtgtttagtccacgagtgggtgaactcaggttgggtcaaatgagtcctcgagtcgttggaaatagtcctaagccaccgagtactgggaggagtcctttgaaccagggctctcattgaactgagattatatatatacaagaagctaaataaggcaaaactcaatgaggatgagtgtttactagttaattaatttgatctttagttcttgggaaaaacaaaagcctcttcaaactttcttttgtttatatgttgtgcgtgtgtgggtttatgcccttacctggtgtttgatcttttgacgctggagagttgaagtctgtaaaatcgtacttattccgtaatgatattcacgactgagt

SEQ ID NO: 1393 - DNA, 2329 bp, Brassica napus
atggaagagacctttgtgccgtttgaaggaataaagaatgatctcaaaggcagactcatgtgctataagcaagattggaccggcggattcaaagctggctttaggattctagctcccaccacttacatattcttcgcctctgcgatccctgtcatctccttcggtgaacagctcgaacgaaacactgatggagttctcacggctgttcagaccttagcatccaccgccatttgcggcatcattcactctgttatcggaggacagcctctgcttatactcggtgttgcggagccaactgtcattatgtatacattcatgtttaacttcgcaaaggctaggcctgaacttggacgagacctcttcttggcctggtctggatgggtttgtgtttggactgctttgatgctgtttgtgatggctatatgtggagcttgttccatcatcaataggttcacccgtgttgctggtgaactgtttggactgcttatcgctatgctcttcatgcaacaagccatcaaagggctagttgatgaatttcgcattccggaacgtgaaaatgagaagctgaaggagttcttaccttcatggagatttgctaatgggatgttcgctctggttctctcctttggccttcttctaactggacttcgaagcagaaaagccagatcatggcggtacggtactgggtggctcagaagcttagtagcagactatggtgtaccactaatggttctactgtggaccggtgtctcctacattccttcaggagatgttcctaaaggcatcccccgccggctttttagcccaaacccttggtcccctggtgcttatgggaattggaccgttgtacaggagatgcttgatgttccagtggtctacataataggagcttttataccagcatcaatgattgctgtgctttactactttgatcatagtgttgcttcacagcttgctcagcagaaagaattgaatttgagaaaaccttcttcttaccactacgacttgcttcttcttgggtttctgaccttaatgtgtggtctactcggagtccctccatcaaacggtgtcattcctcaatctcctatgcataccaaaagcttagcaactctcaagtatcagttgcttcgtaacagactggttgcaacagcacgcaaaagcataaaaacgaatgcgagcttgggacaactctacaacaacatgcaagaagcttatcatcacatgcagacaccattagtataccagcaacctcaaggcttaaaagaactgaaagaatcaacaatccaagcaactacattcaccggaaacctcaacgctccagttgatgaaactctgttcgatatcgagaaagagattgacgatctgttacctgtagaagtcaaagagcagcgtgtaagcaacttccttcaatccacaatggtaggaggatgcgttgcagctatgcccatccttaaaatgatcccaacctctgtcctctggggatacttcgccttcatggctattgaaagcttacctggaaaccaattctgggagagaatcctgcttctcttcaccgccccaagtcgccgcttcaaggttcttgaagactaccatgcaacgttcgttgaaacagttcctttcaaggccattgcaatgttcactgtttttcaaacggtttatctgttaatctgctttggcctcacgtggatcccaatcgcaggagtcatgttccctttgatgatcatgttcttaatccctgttagacagtacatactccctaggttcttcaaaggagctcatcttcaggatctggacgcagctgagtatgaagaagctccagctttaccctttaatctcgcagcggaaacggagattggatcgacaacttcatatccaggagactcagagattcttgatgaggttattacacgaagcagaggagagtttagacacacgagtagtcctaaggtgacgagttcgagttcaactccgctcaataataggagtttgtctagtccacgagtgggtgaaataaggttgagtcagatgagtcctcgtgtcgttggaaacagtcccaagcctgcgagttgtgggaggagtcccttgaaccagtcctcgctcaactgagaagaggctatctatatattcaggaagctcaataaaacaaaaccccaatgaggatgaatgtataattacttaattaatttgatctttagttccaaaatgaaaaagtaaaagcttcttgaatctgtctttagttaatgtgttgtgtgttttatgcccctactcagtatctcgagtctctgtaaaatcttactgattgcataatatatgtaaaaagagttgaatg

SEQ ID NO: 1394 - DNA, 2377 bp, Brassica napus
cttcccttcctggttctcatcaggactgctgcttagggcgagtgtttgacgaattgactgaacgaaacagagcaaaccatggaagagacctttgtgccgtttgaaggaatcaagaatgatctcaaaggcagactcaagtgctataagcaagactggaccggcggattcaaagctggctttaggattctggctcccaccacttacatattcttcgcctctgcgatccctgtcatctccttcggtgaacagctcgaaagaaacactgatggagttctgacggctgttcagaccttagcatccaccgccatttgcggcatcattcactctgttatcggaggtcagccactgcttatactcggtgttgcagagccgactgttattatgtatacattcatgtttaacttcgcaaaggctaggtctgaacttggacgagacctcttcttggcttggtctggatgggtctgtgtttggactgctttgatgctgtttgtgatggctatatgtggagcttgttccatcatcaataggttcacccgtgttgctggggagttgtttggactgcttatcgctatgctcttcatgcaacaagccatcaaagggctagtggatgagtttcacattccggaacgtgaaaatgagaagctgaaggagttcttaccttcatggaggtttgctaatgggatgttcgctctggttctctcctttggccttcttcttactggacttcgaagcagaaaagccagatcatggcgctacggtactgggtggctcagaagcttagtagcagactatggtgtaccactaatggttctagtgtggaccggtgtctcctacattccgtcaggagatgttcctaaaggcatcccccgccggctttttagcccaaacccttggtcccctggcgcttatggtaattggaccgttgtacaggagatgcttgatgttccagtggtctacataattggagctttcataccagcatcaatgattgctgtgctttactactttgatcatagcgttgcttctcagcttgctcagcagaaagaattcaacttgagaaagccctcttcttaccactacgacttgcttcttcttgggttcctgaccttaatgtgtggtctacttggagtccctccatcaaacggtgtcattcctcaatctcctatgcataccaaaagcttagcaactcttaagtaccagttgcttcggaacagactggttgccacagcaagaagaagcataaaaaagaatgcgagtttgggacaactctacaacaacatgcaagaagcctatcatcacatgcagacaccattagtatatcagcaacctcaaggtttaaaagaactgaaagaatcaacaatccaagcaactacattcacgggaaacctcaacgctccagttgatgaaactctattcgatatagagaaagagattgatgatctgttaccagtagaagtcaaagagcagcgtgtaagcaacttcctccaatccacaatggtaggaggatgcgttgcagctatgcccatccttaaaatgatcccaacctcagtcctttggggctacttcgccttcatggctattgaaagcttacctggaaaccaattctgggaaagaatcttacttctcttcaccgccccaagtcgccgcttcaaggttcttgaagactaccatgcaacgttcgttgaaacagttcctttcaaggccattgcaatgttcactgttttccaaacggtttatctgttaatctgctttggcctcacatggatcccaatcgcaggagtcatgttccctttgatgatcatgttcttaatccccgtaagacagtacatactccctaggttcttcaaaggagctcatcttcaggatctggacgcagcagagtatgaagaagctccagctttaccctttaatctcgcagcggaaacggagattggatcgacaacttcgtatccaggagactcagagattcttgatgaggttattacacgaagcagaggagagtttagacacacgagtagtcctaaggtgacgagttcgagttcaactccgctcaataataggagtttgtctagtccacgagtgggtgaaataaggttgagtcagatgagtcctcgtgtcgttggaaacagtcccaagcctgcgagttgtgggaggagtcccttgaaccagtcctcgttcaactgagaagaggttatatatattcaggaagctcaataaaacaaaaccccaatgaggatgaatgtataattacttaattaatttgatctttagttccaaaatgaaaaattaaaagcttcttgaatctgtctttagtttatgtgttgtgtgttttatgcccctactcagtatctcgagtctctgtaaaatcttactgatt

SEQ ID NO: 1395 - DNA, 2741 bp, Citrus clementina
ttatatttcttctgctctcaccacctgcgttgacttatatttttatataataaccaaccattagggtattgatcattattttctgaacttcttcttttagtttctgaacgtacacccaagttatgtaattattcagattattaatttagtttctttatcagacctttcaatgacattctttttccaatctgcaaaagccactccgtaggaggccatttttcttcactgccctctgctcattgttagaaaccactgaagacacaagaaagtacagagtattaaatttttcctagttacagaacaatggaagaaacatttgtacctttccgcgggattaaaaatgatcttcgaggaagattgatgtgttacaagcaagattggaccagtggctttaaagcaggcttcaggattttggctcccaccacatacatattctttgcttccgcgattccggtcatttcatttggtgaacaacttgagagagatactgagggcgtactgacggcagttcaaacgttggcatctactgccctttgtgggattatacactcgatcattggaggccaaccattgctgatattaggagtggcagagcctactgtcattatgtacacatttatgtttaactttgccaaagagagagcagacttgggtcgaaatctcttcatagcctggtctggatgggtatgtgtttggacggcattgcttctgctcatgctgtcgatcttaggcgcttgctccattatcaacagatttacacgtgtagcaggagaattgtttggtctgcttattgcaatgctgttcatgcagcaagcgatcaagggtctcgtggaagaatttcgaattccagaacgagaaaatccaaaattggttcagttcataccttcatggaggtttgcaaatgggatgtttgctttagttctgtcattcggccttctatacacaggactgaaaagccgaaaagcaaggtcatggcgctatggaactggttggctaagaagcgtcatagcagactacggcgtgccacttatggttgtggtgtggacaggggtttcatacataccatctggtgatgttcccaaaggaatcccacgacgcctcttcagtccaaatccatggtcccctggtgcttatgaaaattggactgacatgctgaacgttcccattgtctacataattggagcttttattccagcaaccatgattgctgtgctctattattttgaccatagtgtagcatcccaacttgctcagcagaaagagttcaacctgagaaagccatcatcttaccattatgatttgcttcttttgggatttttgaccttactgtgtggacttattggaatccctccatctaatggtgtcattccacaatctccaatgcataccaagagtctggctactcttaaacaccagttgctcagaaaccgccttgttgcaacagcacgcacaagtatgaggaagaatgctagcctgggacagatgtatggaaatatgcaagaagcctatcagcaaatgcagacccctttaatctaccagcagtctgcagcgcaaggactaaaagaattaaaagaatcaaccattcaagcagcatcatgcacaggaaaccttaatgccccagtagacgagactttatttgatattgagaaagaaattgatgatcttctgccagttgaggttaaagaacagcgtctcagtaacttgcttcaagccatcatggtgggaggatgtgttgcagcaatgcccttcctcaaaatgataccaacctcagtcctttggggctactttgccttcatggccattgaaagtttacccggcaaccaattttgggaaaggatcttgttgctcttcacggcgccaagcagaagatacaaagtccttgaggagtaccatgccacatttgttgaaactgtgccattcaaaacaatagcaatgtttaccattttccaaacaatttatttgctaatctgttttgggcttacttgggttccaattgctggggttatgtttcctttgatgattatgctgctggttccggcaagacaatacattctgcccaagtttttcaaaggggtacaccttcaagacttggacgcagcagagtatgaagaggctccagctttgccattcaatcttgcagcagagacacagatgggcgctggtgcttcttatgcaggggatgcagagattttagatgaggttataactagaagccgtggtgagtttaggcacacaaacagttctaaaatcacaagctccacttcaacgccagcaaatgatcctctgagcatgcagagtccacgagtccgacaaagtcctcgcctcagtgaactaagaggggaaagaagtcctcgcattagaggtcttccaagtccaaagactggagaatcaaaattgtctaatttggggaaaagtcctctaaactaagcctcaaaattctagcaaataattgaccggggtgatctatctactttccaggagttttaagtggcttgttacttgtcctgttttcattgctgcgtctgttgtttggattgctgttgctgtaaaattaatctctcttctgctgagcaagagtgtaacaatagaatcgagtggcttgtcttgtaactacaacactagttgatatgtacttcccaccgtatagtttccattccctttgtaaaggaaacttgctctctcctctattatcttacactcacacgataagacaattctgcaataaacactgaaaatttgac

SEQ ID NO: 1396 - DNA, 2741 bp, Citrus sinensis
ttatatttcttctgctctcaccacctgcgttgacttatatttttatataataaccaaccattagggtattgatcattattttctgaacttcttcttttagtttctgaacgtacacccaagttatgtaattattcagattattaatttagtttctttatcagacctttcaatgacattctttttccaatctgcaaaagccactccgtaggaggccatttttcttcactgccctctgctcattgttagaaaccactgaagacacaagaaagtacagagtattaaatttttcctagttacagaacaatggaagaaacatttgtacctttccgcgggattaaaaatgatcttcgaggaagattgatgtgttacaagcaagattggaccagtggctttaaagcaggcttcaggattttggctcccaccacatacatattctttgcttccgcgattccggtcatttcatttggtgaacaacttgagagagatactgagggcgtactgacggcagttcaaacgttggcatctactgccctttgtgggattatacactcgatcattggaggccaaccattgctgatattaggagtggcagagcctactgtcattatgtacacatttatgtttaactttgccaaagagagagcagacttgggtcgaaatctcttcatagcctggtctggatgggtatgtgtttggacggcattgcttctgctcatgctgtcgatcttaggcgcttgctccattatcaacagatttacacgtgtagcaggagaattgtttggtctgcttattgcaatgctgttcatgcagcaagcgatcaagggtctcgtggaagaatttcgaattccagaacgagaaaatccaaaattggttcagttcataccttcatggaggtttgcaaatgggatgtttgctttagttctgtcattcggccttctatacacaggactgaaaagccgaaaagcaaggtcatggcgctatggaactggttggctaagaagcgtcatagcagactacggcgtgccacttatggttgtggtgtggacaggggtttcatacataccatctggtgatgttcccaaaggaatcccacgacgcctcttcagtccaaatccatggtcccctggtgcttatgaaaattggactgacatgctgaacgttcccattgtctacataattggagcttttattccagcaaccatgattgctgtgctctattattttgaccatagtgtagcatcccaacttgctcagcagaaagagttcaacctgagaaagccatcatcttaccattatgatttgcttcttttgggatttttgaccttactgtgtggacttattggaatccctccatctaatggtgtcattccacaatctccaatgcataccaagagtctggctactcttaaacaccagttgctcagaaaccgccttgttgcaacagcacgcacaagtatgaggaagaatgctagcctgggacagatgtatggaaatatgcaagaagcctatcagcaaatgcagacccctttaatctaccagcagtctgcagcgcaaggactaaaagaattaaaagaatcaaccattcaagcagcatcatgcacaggaaaccttaatgccccagtagacgagactttatttgatattgagaaagaaattgatgatcttctgccagttgaggttaaagaacagcgtctcagtaacttgcttcaagccatcatggtgggaggatgtgttgcagcaatgcccttcctcaaaatgataccaacctcagtcctttggggctactttgccttcatggccattgaaagtttacccggcaaccaattttgggaaaggatcttgttgctcttcacggcgccaagcagaagatacaaagtccttgaggagtaccatgccacatttgttgaaactgtgccattcaaaacaatagcaatgtttaccattttccaaacaatttatttgctaatctgttttgggcttacttgggttccaattgctggggttatgtttcctttgatgattatgctgctggttccggcaagacaatacattctgcccaagtttttcaaaggggtacaccttcaagacttggacgcagcagagtatgaagaggctccagctttgccattcaatcttgcagcagagacacagatgggcgctggtgcttcttatgcaggggatgcagagattttagatgaggttataactagaagccgtggtgagtttaggcacacaaacagttctaaaatcacaagctccacttcaacgccagcaaatgatcctctgagcatgcagagtccacgagtccgacaaagtcctcgcctcagtgaactaagaggggaaagaagtcctcgcattagaggtcttccaagtccaaagactggagaatcaaaattgtctaatttggggaaaagtcctctaaactaagcctcaaaattctagcaaataattgaccggggtgatctatctactttccaggagttttaagtggcttgttacttgtcctgttttcattgctgcgtctgttgtttggattgctgttgctgtaaaattaatctctcttctgctgagcaagagtgtaacaatagaatcgagtggcttgtcttgtaactacaacactagttgatatgtacttcccaccgtatagtttccattccctttgtaaaggaaacttgctccctcctctattatcttacactcacacgataagacaattctgcaataaacactgaaaatttgac

SEQ ID NO: 1397 - DNA, 2994 bp, Populus trichocarpa
gctgtctgcacaagaaactattattactatatatatctggagctttcttctcttccaagtgccaacacattgaactcaagaggactttcaagaagtctgctgctcatttttgtggtcaccaacccaccaaattctgtactgaactgcaagctttccccgttggcactcttttgtcttccacactttgctagccgtcgcatcattaactcactttgttgtgtttgttaagcctggtagtatagagcaagctcgcctgtggatttatctgtctttttcatttttgctccatcccttctaaaagttgatcttactgattcttttcaagttatgtaacttctatcaccaatcagtttctcaatggcaaatccactcctccctctaaaatcccaacattgtcgctagagggtattcttgcttatcgtctgagtagtctagtcatctgttacaagctttcaaagaaggaagaaaacaagtacgcagtacttttcaccactgagcttcctgtcggataacatcatggaggagacatttgtgcctttccgtggaatcaagaatgaccttcggggaagattgatgtgttacaagcaagactggacaggtggatttagagcaggcttcaggattttggctcccaccacatatatattctttgcttccgcgattccggtcatctcatttggggaacaattggagagaaatactgatggagttctaacagcagttcagaccctggcatccaccgcagtttgtgggatcatacactcaattattggaggtcaacctttgctgatattgggagttgcagagccgacagtaattatgtacacattcatgttcaactttgccaaagagagagctgatttgggaaggaacttatttctagcatggactggatgggtatgtgtttggacttcactcttgctgttcttactggctgtcttaggagcatgctcaattatcaataggttcactcgtgtagctggagagttgtttggtctgcttattgcaatgctcttcatgcaacaggctatcaaaggtctcgtggatgaattccgcattccaaaacgagaagatccaaaatcaatggagtttataccttcatggaggttcgcaaacggaatgtttgctttggttctatcatttggcctcctgctcactgcattaagaagccgcaaggcaagatcatggcgctatgggagtggttggcttagaagtttagtagcagactacggtgtacccctcatggttgtagtatggacagctgtttcttatattccgacaggaaatgttccgaaaggaatcccccggcgtcttttcagcccaaatccctggtcccctggtgcatatgagaactggactgtagtcaaggcaagttctgagatgttagatgttcccatttcctacataattggagctttcattcctgctacgatgatcgcggtgctttactattttgaccatagcgtagcatctcaacttgctcagcagaaggagttcaatttgagaaagccatcttcttatcattatgacttgcttcttttgggatttctgaccttaatgtgtggtcttattggaatcccaccatcaaatggagtcattccccaatctccaatgcatacaaaaagtctggccactcttaagtaccaggtaatctaccctgaaatctctcaaaaaatcaagttgcttcgaaatagacttgtcgcaacagcacgtacaagtctgagaaagaatgccagcctgggacaattgtatggaaatatgcaagaagcttatcaccaaattcagactcctttgatgtaccaacagccctctcaaggtctaaaggaattcaaagaatcaaccatccaagcagctacatgtacaggccatatagatgccccagtcgatgagacagtatttgacattgagaaggaaattgatgacctattgcctgttgaggtcaaagaacaacgtgtaagtaatttgcttcaagccacaatggttggaggttgtgttgcagccatgcccttcctcaaaatgatcccaacctcagtcctttggggctattttgccttcatggctattgaaagtttgcctggtaaccagttttgggaaagaatattattgctcttcaccgcaccaagcagaagatacaaagtacttgaagatttccatgccacattcgtagaaacagttcctttcaagtcaattgccatgtttacaattttccagacggcttatttgcttatatgttttggtctcacttggataccgattgcgggccttatgtttcctttgatgatcatgcttttggttcctgtaagacaatactgccttcccaagtttttcaaaggagcacaccttcaagacttggatgcagccgagtatgaagaagcaccagctttgccattcaatctcgcaacagaggcagagctggggggaggagctgcttatggaggagatggagagattttggatgaggttatcacccgaagccgtggagagttcaggcacacgagtagtcctaaaatctcaagctccactacaacaccagcaaataatcctaaaagccttcaaagccctcgtctctcgtacacatatagtcctcgtataagtgaattaagagggcagaaaagtcccaaatccagtggaagagggcttaacagtccaaggactggagatcaaaagttatctaaactggggaagagtccttcaagttcagaacaaaactagtggcaaatttttttggcttatctaccagtaaggagctttagattggcttgtgctcgcaccatttccctttcaagtgtgttgttgtggttggaattagtgtaaaatatcccttctttctgatcttctctagaaaaaaattgtaacttacaatggaatagttgctttgttgtaataagtgtgctagtatatatttgttccggctatagtagttcaatgccactgcctttatgatgaaatttagttgctcttaattagaatttccaagtagtcaatttataattc

SEQ ID NO: 1398 - DNA, 2579 bp, Populus trichocarpa
aagaggtttgtattgttcttgtttgtggagaccaacccaccaacttctgtcctgcacagcgaacttctcccccttggcactcttttgtctttaaactctttgctacccatcgtatcattattttactttgctgtgcttgttaagccaggtagcatagagcaagctcacctgtggattcatctttctttttcttttttttttcctctagtccttctataagttgaccagattgatgattttcaagttatgtagccttttccactaatcagttcctcaatgaatccattcctccctgtaaaatcccaaaattgtcgctagagggtattctagctttagcttctgagtgtttgagtcatcttttgcaagctttcaaagaaggaagagattcaagtgcagcactacttttcaccagttagcttcttgtggataacatcatggaggagacatttgtgccgttgcgtggaatcaagaatgaccttcgtggaagattaaggtgttacaagcaagactggacaggtggattcaaatcaggcttcaggattttggctcccaccacatatatattctttgcttccgctattccggtcatttcatttggtgaacaattggagagaaatactgatggggttctaacagcagttcagaccctagcatccacctcaatttgtgggatcatacactcaattgttgggggtcaacctttgctgatattgggagtcgcagagccaacagtcatcatgtatacatttatgtttaactttgctaaagagagagctgatttgggaagggatttgtttcttgcatggactggatgggtatgtgtttggactgcactcttgttgttcttactggctgtcttaggagcatcctccattatcaataggttcacccgtatagcaggagagttgtttggtctacttattgcaatgctcttcatgcaacaggccatcaaaggacttgtggaagagtttcgcattccacaacgagaagatccaaaatcaacggagtttataccttcatggaggtttgcgaatgggatgtttgctctggttctatcatttggcctcctgctcactggattaagaagccgcaaggcaagatcatggcgctatgggagtggctggcttagaagtttaatagcagactacggtgtacccctcatggttctagtgtggacagctgtctcgtatattccaacaggaaatgttcctaaagggatcccacggcgtcttttcagcccaaatccctggactcctggtgcatatgagaattggactgtcattaaggcaagttctgagatgttaaacgttcccattttctacataattggagctttcgttcctgctacgatgatcgcggtgctttactattttgaccatagtgtagcatctcaactttctcagcagaaggagttcaatttgagaaagccatcttcttaccattatgacttgcttcttttggggtttctgaccttaatgtgtggtcttcttggaatcccgccatcaaatggagtcatcccccaatctccaatgcatacaaagagtctggctactcttaagtaccagttgcttcgaaatagacttgtgcaaacagcacgtagaagtctgagaaagaatgccagcttgggacagttgtatggaaatatgcaagaagcctatcaacaaatgcagactcctttggtctaccaacagcccgctcaaggtctaaaggaattcaaagaatcaaccatccaagcttctacatgtacaggccatatcgatgccccggttgatgagacagtatttgacatcgagaaggaaattgatgatctattgcctgttgaggttaaagaacaacgtctaagtaacatacttcaagccacaatggttggaggttgcgttgcagccatgcccttcctcaaaaagattccaacctcagtcctttggggctattttgcgtttatggccattgaaagtttgccgggtaaccaattttgggaaagaatattactgctcttcactgcaccaagcagaagatacaaagttcttgaagattaccatgccacatttgtagaaacagttcctttcaagacaattgccatgttcacaattttccagacaacttatttgctgatatgtttcggtctcacttgggttccaattgcgggcgttatgtttcctttgatgatcatgcttttggttccagtaagacaatactgtcttcccaagtttttcaaaggagcacaccttcaagatttggatgcagccgcgtatgaagaagcaccagctttgccattcaatctcgcaacagaggcagagatgggggcaggagctgcttatggaggagatggagagattttggatgaggttattaccagaagccgaggagagttcaggcacacaagtagtcctaaaatcacaagctccactgcaacaccagcaaataatcctaaaagccatcaaagcccacgtctctcttacacatatagtcctcgtgtaagtgaactaagaggggagaaaagtcctaaacctggtggtctaggaaactcatggagagttaaaaaatctctttctccttcaagcagttctatatcatcataa

SEQ ID NO: 1399 - DNA, 2950 bp, Theobroma cacao
gcccatacattgcatcaagagacaactcgaaagctagcggtgccttcttcttttgttaattagaccatcaaattctcttcctgatacacaaaggaaaaaaggaaaagaaaaaccttgttcttgtttccttttttgtttcagttcttcccgagcacacttaattatgtaatttggtgtgtttttcttgaagattaaattcatatctctcagttatagtctgatccatctggctatctagctatcacctaagactttctcttcccacttcctggggataaagttcttaagcatgaacatggtctatcttcgctaaagtttttatttatagtctgcaactctcaagtcatgtaattttacatgattgtttgactctcatttatttccaatgagaatctccttgctagatgcaatagccagatcgttccgctagcagttattcttgatcattgtcaggagtgtttccaatttttttttttcggaggttattcaaggaaaagagagagagagagagccaactgtcagagcttcagatagatagaactaaccatggaggagacctttgtgcctctccgaggcatcaaaaatgacctcaaagggagattgatgtgttacaagcaagattggactggtggctttaaagcaggcttcaggattctggctcccaccacttatattttctttgcttctgcgattcctgtcatttcatttggtgaacaacttgagagaaatactgatggagttctcacggcagttcaaaccttagcatccacggctctttgtgggatcatacactcaataattggaggtcaacccttgctgatattaggagttgctgagccaactgtcattatgtacacatttatgtttaacttcgctaaagaaagaccggatttgggtcgggacctgtttctagcatggactggatgggtatgtgtgtggactgcaggcttgctgttcttactgtctatcttgggagcttgctccataatcaataggtttacccgtgtggcaggagaattgtttggcctgcttatagctatgctgtttatgcagcaagctatcaaaggccttgtggaagagttccgcattccacaacatgaagatccgaaattaacagaatttataccttcatggaggtttgccaatggcatgtttgctttggtcctgtcttttggccttcttctcaccgcattaagaagccggaaagcgaggtcatggcgctatgggacgggttggcttagaagctttatagcagactatggtgtgccatttatggtattagtatggacagctgtgtcttacatacctgccgaaagtgttccgaaaggaatcccacgtcgtctgttcagcccaaatccgtggtcacctggcgcttatgaaaattggacagaaatgctaaatgttccggttgtctacattattggagccttcattccagccacaatgattgcagtgctctattattttgaccatagtgtagcatctcaacttgctcagcagaaggagtttaatttgagaaagccatcttgttatcattatgacttactgcttttgggattcttgacattgttatgtggtcttattggcatccctccagcaaatggggtcatcccgcagtcgccaatgcataccaagagcttggctacactcaagcaccagcttcttcgaaatcgactggttgcaacggcgcgcaaaagtattagaaagaatgctagcttgggacaattgtatggaaatatgcaagaagcctatcaacagatgcagacccctttagtttatcaggagacttcagctcgaggactaaacgaactaaaagaatcgaccgttcaagctgctacatgtacagacaacattgatgcccctattgatgagactttgtttgatattgagaaagatattgatgatctattgcctgtggaagtaaaagaacagcgtctcagtaacttgcttcaggccaccatggttggaggatgtgttggagcaatgcccatcctcaaaatgatcccgacttcagtcctctggggttacttcgccttcatggctattgaaagcttacccggtaaccaattttgggaaaggatcttattgctcttcacagcaccaagcagaagatataaagtccttgagcagcaacatgcgacatttgtggagactgttcccttcaagacaattgcaatattcaccattttccaaactacttatctgcttgtatgtttcggcttaacgtggattcccattgccggggtcatgtttcctttgatgatcatgcttttagtccccgtaagacaatacttcctgcccaagtttttcaaaggggcacatctttacgatttggatgctgccgagtatgaagaggcacctgctttgccatataatcttgccacagagacagagttgggacatggagcatcctatgcaggggatggtgagatattagatgaagttattaccagaagccgaggtgaattcaggcatacatgcagtcctaaaatcacaagctccactgctacgccagcaaatgatccgagtagccttcaaagcccgcgcctctcaggtagtccacgtgtcagtgaactaaaaggagagagaagtcctcgatcaagtggaaaggggccacacagtccaagggctggggaaccaaaaccatctaatctggggaagagtcctcttaacccagcatccagttagtgtgaaatattgttgaatatattgataaatctgtttgtaagaatttttaaatggtttggtcatatcgcagactttatttgagcgtgttggttgccttagcactgttgtaaaacctttccctcttcctcttaaagcccaagcttatttgtaacaactgatttaatttgcttttcttaccagaaattatagtagtagttgtattttttgcttgaaagtgttagcgttcgttgccacttttttcaaagaaattagttgttgtaac

SEQ ID NO: 1400 - DNA, 2168 bp, Manihot esculenta
ctcactctgacaaattgataatggaggagacgttcgtccctctccgtggaatcaagaatgaccttaagggaagattgctctgttacaagcaagactggacaggaggattcagagctggtttcaggattttggctcccaccacttatatattttttgcttcagcaattccagtaatttcatttggcgaacaactggagagaaatactgatggagttttgactgcagttcaaaccttagcatccactgcagtatgtgggatcatacactcgatcattggaggtcaacctctcctgatattaggagttgcggagcctactgtcattatgtacacttttatgttcaactttgccaaagagaggcctgatttgggcagggatttgtttctggcatggacaggatgggtttgtgtttggaccgcactcctgctgttcttgctggccatcctcggagcctgctccattatcaacaggtttacccgtgtagcaggcgaattgttcggtctgcttatcgcgatgcttttcatgcagcaagctattaaaggacttgtggatgaatttcgcattccacaaagggaagatccaaaattgatagagttcattccttcatggaggtttgcaaatgggatgttcgctttggttctatctttcggcctgcttctcactgcattaagaagcagaaaggcaagatcctggcgttatgggaccggttggcttagaagcttcacagcagactatggtgtgcccttcatggtcctagtgtggacagctgtttcctacatcccatccggaagtgttccccaagggatccctcgccgccttttcagccctaatccctggtcccctggtgcctacgaaaattggactgaaatgctgaatgttcccatattttacataattggagctttcgttccggcaacgatgattgctgtcctttactactttgaccacagtgtagcatctcagcttgctcagcagaaagagtacaatttgagaaagccatcttcttatcactatgacttgctgcttctggggttcttgactttaatgtgtggtcttattggaattccaccatcaaatggagtcatcccacaatctccgatgcatacaaagagtttggccacactgaagtatcagttgcttcgtaatcgacttgtagcaactgctcgaacaagtatcaaaaagaacgccagcttgggacagttatatggaaatatgcaagaagcttatcagcaaatgcagacacctttgatctaccaacagccttctcaacagggcctgaaagaattcaaagaaacaaccatccaggcagcttcctctactggccacatagatgcaccagttgatgagacagtatttgacatcgagaaggagattgatgatttattgcctgttgaagtgaaagaacagcgtgtcagcaacttgcttcaagccaccatggttggaggatgtgtagcagccatgcctttcctcaaaaagatcccaacttcagtcctctggggttactttgcctttatggccattgaaagtttgcctggcaaccaattctgggaaaggatattgctgctcttcactgcaccaagcagaagatacaaagtcctcgaggaataccatgccacgtttgtggaaactgtgcctttcaagacaattgcaacatttaccatttttcaaactatttacttgttaatatgttttggcctcacttgggttccaattgccggggtcatgtttccattgatgatcatgcttttggttccagtaagacaatatgtccttcctaaatttttcaaaggagcacaccttcaggacctggatgcagcagagtatgaagaagctccagctctgccatacaatattgctacagagtctgagctgggggctggggctactcgtgcaggggatggagagatactagatgaagttattacccgtagccgaggagagttcaggcatgtgagcagtcctaaaattacaagtactactggaacccctgcaaatgatcctaaaagccatcaaagcccgcgtctctcgtacacgtatagtcctcgtttaagtgaactgaaaggagagaaaagtcctaaggctagtggaagagggcctataagtccaagacctgcagaactaggattatctaagttaggaaagagtccttcaaattcagcacaaaagtag

SEQ ID NO: 1401 - DNA, 2614 bp, Euphorbia peplus
tcatctcccaaaattgcttaatcaattacagaatctttcactttcttttctgtttcttgaaaatatcatttccattatcactttgatctgcattgtcacgtttccgtttctgtgcaacatatctagcccgaaaacagacttggttaactggaatcaacatgtaattattatcctcgacgcggaccgatcccaatggcaaagcataatccatagtgtattgattattgagtttcaacagagtaattcaaagcaataacatttagtgttcctattgaagttcaacaatggaggaaacatttgtcccgttgcgaggaatcaagaatgatctccatggaagattgctttgttacaagcaagattggactggaggattcaaagcaggttttaggattttggctcccactacatacatcttctttgcctcagcaattccagttatttcattcggcgaacaactcgaaagaaatactgaaggagttctaacagcagttcaaacgctcgcatcgacagcaatatgtgggatgatacactccataattggaggtcaaccacttctgattttaggagttgcagaacctactgtgattatgtacacatttatgtttaactttgttaaagagagaacggatataggccgcgaattgtttctggcatggactggatgggtatgtgtttggacagcagccctgctgttcttgctggcaatcctgggagcatgttctatcatcaacaggtttactcgtgtcgcgggagaattgttcggtctgctcattgcaatgctttttatgcaacaggctattaaaggacttgtggatgaatttcgtattccgcaacgagaagatcccacccgagaagagtttttaccttcctggaggtttgcaaatgggatgtttgctttggttctatcctttggtctcttgtacactgcattaagaagcagaaaggcaagatcttggcgatacgggactggttggcttagaagttcgatagcagactacggtgtacccttaatggtcctagcgtggacagctatttcctacatcccgtccggaagtgtccctcaacggattcctcggcgcctttttagcccgaatccttggtctcctggtgcttatgagaattggactgtcatcaaggacatgctaaacgtcccaatttcgtacattatcggagctttcattccggctactatgattgccgtgctttactactttgatcatagtgtagcttctcaacttgctcagcagaaagagttcaatttaagaaagcctgcttcttatcactatgacttgcttcttttggggttcttgactctaatgtgcggccttctcggaattcccccgtccaacggagtcatcccgcaatctccaatgcacacaaagagcttggcaacactcaaacatcagttgcttcgtaaccgactagttgcaagtgcacggaaaagcatacaaaagaacgcgagtttgggacaaatatacggaaacatgcaagaagcatatcagcaaatgcaaacgcctttgatctaccaacaaccctcagagggtctcaaggagttcaaagaatcaacaatccaagcagcaacatgtacaggacatattgacgccccggtggatgagacagtgtttgacatagagaaggagatagatgatttactgcctgttgaggttaaggaacagagagttagtaatttgcttcaatctatgatggttggaggttgtcttgctgctatgcctgtccttaaaaggattccaacatctgttctttggggttactttgctttcatggctattgaaagtttgcctggaaatcagttctgggaaagaatattgcttctttttactgcaccaagtagaagatacaaagttcttgaggactaccatgcaacttttgtggaaacagttccattcaaatcaatagcaatgttcacaatttttcagacaacatatttgctcatatgttttggtctaacatggattccaattgctggtctcatgtttccattgatgatcatgcttttggttccggtaagacaatatattctccctaaattcttcaaaggagcacatcttcaagatctagatgcagcagattatgaagaagcacccgctttacctttcaatctcgcaacagagtctgagatgggagcaggggcagctcaggcaggggatgcagaaatattagacgaggttataacccgaagccgtggggaattcaggcatataaacagtcctaaaatgacaagcacaacaagtacaccaggacatgaactgaaaagcccttcaggattttcatactcatatagtcctagagtgagtgaattaagaggggtgagaagtcccacattgagccaaaaaggatcatctaagagcccaataattggggatgtaagattgtctaagctagggaaaagtccttcagcttcagaacataagtagttagttagttagttgtttaattttatgttgttgttagttgtggattgatgctttctttttgtgttttttgggtttggtcttgtaacattttgtctttgttttttgtctcttacatgagcaaatttgtaacctataatatatactagtgtatgtacgtatttttattgagatatgcattg

SEQ ID NO: 1402 - DNA, 1895 bp, Brassica napus
catgtacacattcatgttcaactttgccaaagggagacctgaactgggacgcaacttgttcttggcttggtctggatgggtttgtgtgtggacctcgttgattctgtttgtgctggctatatgtggagcttgttcaataatcaacagattcacaagagtagctggagagttgtttggacttcttatagctatgctcttcatgcaagaagccatcaaaggactagttgatgagtttcgatctcctgagagggaagatctgaagcttcttgagttcttaccttcatggagatttgctaatgggatgtttgctttggttctctcctttggtcttcttataactgcactaagaagcagaaaagctagatcctggagatatggaacaggctggcttagaagcttaatagctgactatggtgtgccactcatggttcttgtgtggaccggtgtctcctacatcccaacaggagatgttcctaaaggaatccctcggcgactttttagccctaacccttggtcccctggtgcttatgagaattggactgttgtaaaggagatgcttcaagttccagtagtctacataattggagcattcattccagcaacaatgattgcagttctttactactttgatcatagtgtagcatcacagcttgctcagcagaaagaattcaatttgagaaaaccatcttcttaccactatgatctgcttcttcttgggtttctgaccttgatatgtggtctacttggaatccctccatcaaatggagtcattcctcaatcaccaatgcataccaaaagcttagcaacacttaagtatcagcttcttaggaacagactagttgcaactgcaaggagaagcattaagcagaatgcgagtttaggacagttgtatggtaacatgcaagaggcttataatcaaatgcagactccattagtctaccagcagcctcagggtctaaaagagctgagagaatcaacaatccaagcgacgacattcacagggaatctagatgctccagttgatgaaactctctttgatatagagaaagaaatagatgatttattgcctattgaagtcaaggaacaaagagtaagcaacttgcttcaagcattaatggttggaggatgtgttgcagctatgcctatcctcaaaatgatccccacatcagttctctggggatactttgccttcatggctattgaaagcttgccagggaaccagttttgggaaagaatcttacttctcttcacagcaccaagtcgaagattcaaggttcttgaagacaaccatgcaacgtttgtggaaactgttccattcaaaacgatagcaatgttcacaatcttccaaacaacttaccttctgatatgctttggcctcacatggatcccaatagctggagtgatgttccctttaatgatcatgtttctaataccagtaaggcaatatatcctcccaagattcttcaaaggtgctcatcttcaggacttggacgcagcagagtatgaagaagcacctgctttaccattcaatctcgcagtagcggaagatgagatgggatcaacagcttcttatccatgcgactctgagattcttgatgaggttatgacaagaagtagaggagagtttagacacacgtgtagtcccaaagttactagttcaacttcaacgccggtctatcataggaacctgtctcaagtgtttagtcctcgagtgaatgaactaaggggtggtggcatgatgagtcctagtctcgccggaaaagggcataatagtccaaagccgagcccgttgaacccatcttcgtcgtcaccgtcaaagtgaggataatggttatggaggcttaataaaaaccagaggagatttatatatatactgtataagtgtatgctatgct

SEQ ID NO: 1403 - DNA, 2718 bp, Malus domestica
accacttctcttatctcaagattctcaacttaattctctttctcttccaaattaccaccactattgactctgctttgctagctctttctaatttccccatttggtccaccctccttgctttctctccacactgcattggttgaatctggtaaaaaatcccagaccatgtaaacttaggtggttactttgatagccagttcaagttatggcaatctcttgccccctgcttgctgcaaactgttagcaatttttcagtggagggaggctatctctattttactcaaggaaatcggtaataccgatcagacatcagagacagaagcatggaagagacatttgtgcctttgcggggaatcaagaatgatctcagaggaagattgaagtgctacaaggaagactggactgggggctttaaagctggattcaggattttggctcctacaacctacatattttttgcttctgcaatcccagtcatttcatttggtgaacaattggatcgaagtactgatggagttttgacagcagtgcaaaccttagtatcgacggcagtttgtgggatcatacattccatcgtcggaggtcaacccttgctgatattgggtgtggccgagcctactgtaatcatgtacaccttcatgttcaattttgccaaagaacgtaaggacttgggtccaaagctctttctagcatggtccgcatgggtatgtgtatggacagctggtttactgttcttattggcaatattaggcgcttgttccataataaataggtttacaagagtggctggggagttgtttggtctacttattgctatgctcttcatgcagcaagccattaaaggacttgtggatgagtttcgcttaccagaaagagaagacactagtttactacaatttataccttcatggaggtttgcaaatggaatgtttgctttggtgttgtcatttggccttcttctcacagcattaaaaagcaggaaagcaaggtcatggcgctatggcactggttggctaagaagctttgtagcagactatggtgtgccacttatggttctggtgtggactggtgtgtcttacattccaactagtagtgttccacacggcatcccaaggcgcctttttagcccaaatccatggtcacctggtgcatatgaaaattggactgacatgctcaatgttccagtcctctatatcattggagctttcattccagcaacgatgatcgcggtgctttactattttgatcacagtgtagcatcccaactatctcagcagaaagagttcaacttaagaaagccatcctcttaccattatgacttgcttcttttggggtttctgactttaatgtgtggtctgcttggaattcctccatcaaatggagtcatcccacagtctccaatgcatacaaaaagtttagctactcttaaacaccagttgcttcgtaatcgtcttgtagcaacagcacgcacaagtatgagaaataatgctagcttgggacaactgtatggaaatatgcaagatgcctatcaacaaatgcagactcctttggtttaccaggaggcctcatctcgaggactgaatgaattaaaagaatcaaccatccaggcagcttcaagtatgggaaattatattgatgcaccagttgatcagacagtatttgatattgagaaagagattgatgatctattgccggttgaggtgaaggagcagcgtctcagtaacctgcttcaagcggtattggtggggggatgtgttgcagccatgcctatcctcaaaagaatcccaacttcagtcctttggggatactttgccttcatggccattgaaagcttacccggtaaccaattttgggaaaggattttattgctctttacagctccaagtagaagattcaaagtcctcgaggataatcacgccacttttgtagaaactgtgcctttcaagtcaatcgcgatgttcacagttttccaaactctgtacctgcttgtatgttttgggcttacttgggttccaattgctggggttatgtttccaatgatgatcatgctcttggttcctgtgaggcaatacatactccccaagtttttcaaaggagcacaccttcaggatttggatgcagcagagtacgaagaggctccggctttaacatataaccttgcaacggagacagagttgggagctggagcttcctgcgcaggggatgcagaaatattagacgaagttatgaccagaagccgaggtgagtttaggcatgtcagcagtccaaagatcacaagctctacttcaacaccagcaaatgcccctgaaatccttgggagtccacacaagaccttcagtcctcgcgtaagtgagctaagaggagagcgaagtcctctttctggcggaagagggtcgcacagtccggggacccctggctcttcttctattcttgggaagagtcctagtaacagctaaggacggagcatcatgttagctgtatatttttcttcgccttcagttaagaacatgtagagggctttcaccgtttttagttccactggttcgctttgttttgttttgctttgcttctttgtaaaaattacattttccttcttttgtcttccaaaagtgttcctttgtaatcatagcacattagcgttgtgtttatttctggtaaacattatttatacaagtgaaggtattcaatcccatcacgatcgactccatgtacgtactc

SEQ ID NO: 1404 - DNA, 2640 bp, Ricinus communis
atattattgagtgatgtaaattttatcacagaccaactgtttctcaatggcaaattcatcaagcccgtaaaagcctatattctcaccttcttagtgtttgagccttacccttttgcagacaacagaaaaaaagaagaaaatagagttcttttcttttataaaacaaaaattcttgagctctcgttgtgataaaatcatggaagagactttcgtccctttgcgcggaatcaagaatgatcttcggggaagattattgtgttataagcaagactggaccagcggattcaaagcaggtctcaggattctggctcccaccacttacatattctttgcttcagcgattccagtcatttcatttggggaacaactggagagaaatactgatggagtattgacagcggttcaaaccctagtatcaactgcagtgtgtgggatcatacactctgtcattggaggtcaacctctactgattttaggagtcgcagagcctactgtcatcatgtacacatttatgtttaacttcgtcaaggagagacctgatttgggccgggatttgtttctagcatggactggctgggtatgcgtctggaccgcaatcctgcttttcttgctggctatcctaggagcctgttccattatcaataggtttacccgggtggcaggggagttgtttggtcttcttatcgcaatgctgttcatgcagcaagctgttaaaggactcgtcgatgaatttcgcatcccacaaagggaagatcgaaaatcaatagagtttatagcttcttggaggtttgcaaatggaatgtttgctttagttctttcatttggcctgctgttcactgcactaagaagcagaaaggcaaggtcatggcgctatgggactggttggcttagaagcttgatggcagattatggtgtgcccctcatggtattagtgtggacaggtgtttcctatattccatccggaagcgttccaaaagggatccctcgccgtcttttcagccccaatccatggtcccctggtgcatatgagaattggactgtcattaaagacatgctaaatgttccagtattctacataatcggggcttttattcctgcaacgatgattgcagtgctttactactttgatcatagtgtagcatctcaacttgctcaacagaaagagttcaatctgagaaagccaccttcttaccactatgacttgcttcttctggggttcttgactttattatgtgggcttcttggaattcctccatcaaatggagtcatcccacagtccccaatgcatacaaagagtttggccactcttaagcatcagttgcttcgcagtcgacttgttgcaacagcacgccaaagtataagaaagaacgccagcttgggacaattgtatggaaatatgaaagaagcttatcagcaaatgcagacaccattgatctaccaacagccctctgaaggtctgaaagaatttaaagaatcgaccatccaagtagcttcctgtactggccatattgacgccccagttgatgagacagtatttgacatcgaaaaggagatagacgatctattgcctgttgaagtgaaagaacagcgtctgagtaacttgcttcaagccacaatggttggaggatgtgttgcagccatgccttttcttaaaaagatcccaacttcagtcctctggggttactttgccttcatggctattgaaagcttgcctggaaatcaattctgggaaaggatattacttctcttcaccgcaccgagcagaagatacaaggttcttgaggagtatcatgccacgtttgtggaaacagtgcctttcaagacaattgcaatgtttacaatcttccaaacattttatttgctgatatgttttggtctaacttgggttccaatagccggcgtcatgtttcccctgatgatcatgcttctagttccagtaagacaatacttccttccaaaattatttaaaggagcacatcttcaggacttagatgcggcagagtatgaagaggcaccagctttaccatacactcttgcaacagagtcagagctaggagcaggagctgttcaggcaggagatggagagattttagacgaggttataactagaagtcgcggagagttcaggcatatgagcagtcctaaaatcacaagctcaactgcaacacctgcaaatgatccaaaaagccatcaaagccctcgtttctcatcctcatatagtccaagattaagtgaactaagaggggagaaaagtcccaaggcaagtggaaaaggggctaagagtccaagaactccagaactaggactgtctaagctagggaagagtccttcaagttctgcacaaaattagtgcagaaaatttggtatctctagctgttagtaagttgaggtaatttggattggtttatttgctttaagtgtctcgttttggttggaattgctgtaaaatcttggttcttaaatgctcttagatgtcttttagagcaagtctgcaaacttcgacaagtatactaatgtatattgctcatttccagagtaatctgttaatatctgaattaatcaagatagtgctttaaactaaacatcataatttgtaactcaataaaaccgtgttctccatattccatgccagctacaagc

SEQ ID NO: 1405 - DNA, 2734 bp, Prunus persica
aatttaagctttcccttggcctgcatgctctcaatttcccttccaaattaccactgctgctgactttgttttgctctcttccaaaaaacccttcagtttgctctttctgatgctgagtctctacattacattgttccaattttgtagaaattcccagatcatgtagtttaggtggtttatttcttacttgggttgccacttcttcaaattatggcaatctcttgcacccagcagcttactgcaaactactagcaacacccattagggcccgggcagggtacagcagagcaaagtgttgttcttgagagaaggaaccatggaagagacatttgtgcctttacagggaatcaagaatgatctcagaggaaggttaatgtgctacaagcaagattggactggtggcttcagagcaggattcaggattttggctccaaccacttacatattttttgcttcagcaatcccagtcatttcatttggcgagcagctggagcgaaatactgatggagttttgacagcagtgcaaaccttagtttctacggcagtttgtgggatcatacactccatcataggaggtcaacccttgctgattttaggtgtggccgagcctactgtaattatgtacaccttcatgttcaattttgccaaagaacgagcagacttgggtccaaagctctttctagcatggagtggatgggtatgcgtgtggacagctgccttgctgttcttattggctatattgggcgcttgttccataatcaataggttcacccgagtagccggagagttgtttggtttacttattgctatgctcttcatgcagcaagccattaaaggacttgtggatgagtttcgcttaccacaaagagaagatactagtttaccacaatttgtaccttcatggaggtttgcaaatgggatgtttgctttggtcttgtcatttggccttcttctcactgcattgaaaagtaggaaagcaaggtcatggcgctatggctctggttggcttagaggctttgtagcagactatggtgtgccactcatggttctagtgtggactggtgtatcttacataccaactagtaccgttccacatggaatcccaaggcgcctttttagcccaaacccatggtcacctggtgcatatgataattggactgtcattaaggacatgctcaatgttcccgtcctctatatcattggagctttcattccagcaacaatgatcgcggtgctttactattttgatcacagtgtagcatcccaactatctcagcagaaagagttcaatttgagaaaaccatcttcttaccattatgacttgcttcttttggggtttctgactttaatgtgtggtctgctcggaattcctccatcaaatggagtcatcccacagtcaccaatgcatacaaagagtttggccactctcaaacatcaattgcttcgtaatcgacttgtagcaacagcacgcaaaagtatgagaaagaatgctagcttgggacagctgtatggaaatatgcaagaagcctatcgacaaatgcagacgcctttgatttaccaagaggcctcagctcggggactgaatgaattaaaagaatcgaccattcaggcagcttcaagtatgggaaattatattgatgcgccagttgacgagacagtgtttgacgtcgagaaagagattgatgatctattgccggttgaggtgaaagaacagcgtcttagtaacttgcttcaagctatactggtgggaggatgtgttgcagctatgcccatcctaaaaaagatcccaacttcagtcctttggggctactttgccttcatggccattgaaagcttacctggtaaccaattttgggaaaggatcttattgctgtttactgctccaagtagaagatacaaagtcctcgaggagtatcatgccacttttgtagaaactgtgcctttcaaatcaatcgggctgtttacagttttccaaactctgtacttgcttgtatgttttgggcttacttgggttccaattgctggggttatgtttccattgatgatcatgctcttggttcctgtaagacaatacgttctgcccaagtttttcaaaggagcacatcttcaagacttggatgcagcagagtatgaagaggctcctgctttaccatttaaccttgcaacggaggcagagctgggagctggagcatcctatgcaggggatgcagagatattagatgaggttatgaccagaagccgaggtgagtttagacatgttagcagtccaaggatcacaagctctacttcaacaccaggaaatgcccctaaaatcctcgggagcccacattcctccttcagtcctcgtgtgaatgagctaagaggagagcgaagtcctcgttccggtggaagagggccaaacagtccaaggacacccggatcttcttcaattctgggcaagagtcctagtgacaacacaacatcatgatacctgtgtatttcggcaaacctttaattaagaagttttagacggctttgatcaccattttcattccaccggtttgctttgttttctttagtttggcttctttgtaaaaaaaggttttccttttgctttcccaggtgggaatggtaatcatagcacattagcattgtgtttatttcttgtaacattaattataccagtgaatgtcttcgatctgactcatgtacgttcctccctcatcaatcgaaaatgccataatttatctgttgc

SEQ ID NO: 1406 - DNA, 2845 bp, Citrullus lanatus
caccgccccttttctcagccttttcaattctcaaactccttttctaccttatttaatccacattgttgcttctttctctacacacccatttgctctgtttgtgctgagatttaaggcttttttttgtttctgtctttgtgtttctcattaaactcccttttgaaccacctcccattgaatcatgtaactgattttccttttttgagtttgagtttgaggttttggaacccccctttttgttatatggcaatgccattgaagaacccctgaatttgaagttggttttctgaatactcattattgtgaaatacttttcttcttcacttagagagggtttttgaagtgaaggaagaagacccagtttgaaattatggaggaaacttttgttcctcttcgtggaattaagaatgacctgaaagggagattagtgtgttacaaacaagactggactggtggtttgagagctggatataggattttggctcccaccacttacatattctttgcctctgcaattcctgtcatttcatttggtgaacagttggagagaagtactgatggggtgttgactgcagttcaaaccttagcctccacagctctttgtgggatcattcactccattgttggaggtcaacctttgctcatcttgggtgttgcggagcccacggttattatgtacaccttcatgtttaattttgctaaggaacgtcccgagttgggccggaatttgtttctagcatggagtggatgggtgtgtgtttggactgcagccttgctgttcttaatggctatattaggtgcttgttccatcatcaataggttcacacgtctggctggtgaactgttcggtttgcttatcgcgatgcttttcatgcagcaagcgatcaaaggacttgtggatgagtttcgcatcccagaacgggaaaatccaaaattgctccagtttataccttcttggaggtttgccaatgggatgtttgctttggtactatcatttggccttctactcactgctttaaggagccgaaaagcccggtcatggcgatatggatcaggttcgctcagaagcttgatagcagactatggagtaccgctcatggttcttgtttggacaggtatttcttatataccttcaaaaagtgtcccacaaggaatcccaaggcgactcttcagccccaatccatggtctcccggtgcgtatgaaaattggactgttatcaaggatatgcttgacgttccagttttctatatctgtggagctttcatccccgctacgatgattgcggtgctttactattttgaccatagtgttgcatctcaacttgctcagcagaaagagttcaatttgaggaagccatcttcttaccattatgatttacttctattgggattcttgaccttaatatgtggtcttcttggaatccctccatccaatggagtcatcccacaatctccaatgcatacaaagagcctggctactctcaaacaccagttgctgcggaataaacttgtagagacagcacgaagtagtatgagaaagaatgctagcttaggacagttgtatggaagtatgcaacaagcatatcaacaaatgcagacccccttgatctaccaacagccttcaattcgtggactgaatgagctaaaagagacaaccattcaagcagcttctagtatgggcagcttcgatgctccggtcgacgagacaatatttgatatcgaaaaggaaattgatgatttattgcctgttgaggtgaaagaacaacgggtcagtaatttgcttcaagctataatggtgggaggatgcgttgcagccatgccagtcctgaaaaagatcccgacctcagttctatggggttacttcgcttttatggccatcgaaagcttgcctggtaaccagttttgggaaagaatcttgttgctctttactgcacccagcagaagatacaaagttcttgaggattaccatgcgactttcgtcgaaaccgtgccattcaaatccattgtactttttaccatttttcaaacagtatatttgttcatatgttttggactaacatgggttccgattgccggggtgatgtttcctctgatgatcatgctcctcgtccctgtaagacaataccttcttcccaagtttttcaaaggggcacatctccaagaccttgatgctgccgaatacgaagaagcaccggctttaccgttcaatcttgcaacagaagccgagctgggcgctggagcatctttcggtggggatggagagattttagatgaggttatcacccgaagccgcggtgagtttaggcgtattagcagtcctaaaatcacaagctccacagcaacaccaatatctgaccgaaaaagtatagacagccctcatcgctctttcagccctcggttgagcgagctaagaggagagcacagtcctcgagctggtggacgagggacaccaggtcagaggagtgcagaagctaaaccatccagtctgggaaagagccctcttaataacacagcatcaaagtaaatgcagaaagaatcttgtagaattcttcctctgataagaagttttagataagtttgatatgatattgttaatttgtaacttgaagtaatgttcatttttctttagtatctttgtatagccttctttcttctgctcttggttaatctctttccaagaacagatctcttcataaaagttgcctctctaagatttgtagtaattcaagtgtgttttgtttaatggtttgtcatagatacaaagctttttgttagatatgaatatgcatttgttggaagtttgtgaagtggaatcaaatctctctcaagactattttcagcacca

SEQ ID NO: 1407 - DNA, 2165 bp, Ricinus communis
gctctcgttgtgataaaatcatggaagagactttcgtccctttgcgcggaatcaagaatgatcttcggggaagattattgtgttataagcaagactggaccagcggattcaaagcaggtctcaggattctggctcccaccacttacatattctttgcttcagcgattccagtcatttcatttggggaacaactggagagaaatactgatggagtattgacagcggttcaaaccctagtatcaactgcagtgtgtgggatcatacactctgtcattggaggtcaacctctactgattttaggagtcgcagagcctactgtcatcatgtacacatttatgtttaacttcgtcaaggagagacctgatttgggccgggatttgtttctagcatggactggctgggtatgcgtctggaccgcaatcctgcttttcttgctggctatcctaggagcctgttccattatcaataggtttacccgggtggcaggggagttgtttggtcttcttatcgcaatgctgttcatgcagcaagctgttaaaggactcgtcgatgaatttcgcatcccacaaagggaagatcgaaaatcaatagagtttatagcttcttggaggtttgcaaatggaatgtttgctttagttctttcatttggcctgctgttcactgcactaagaagcagaaaggcaaggtcatggcgctatgggactggttggcttagaagcttgatggcagattatggtgtgcccctcatggtattagtgtggacaggtgtttcctatattccatccggaagcgttccaaaagggatccctcgccgtcttttcagccccaatccatggtcccctggtgcatatgagaattggactgacatgctaaatgttccagtattctacataatcggggcttttattcctgcaacgatgattgcagtgctttactactttgatcatagtgtagcatctcaacttgctcaacagaaagagttcaatctgagaaagccaccttcttaccactatgacttgcttcttctggggttcttgactttattatgtgggcttcttggaattcctccatcaaatggagtcatcccacagtccccaatgcatacaaagagtttggccactcttaagcatcagttgcttcgcagtcgacttgttgcaacagcacgccaaagtataagaaagaacgccagcttgggacaattgtatggaaatatgaaagaagcttatcagcaaatgcagacaccattgatctaccaacagccctctgaaggtctgaaagaatttaaagaatcgaccatccaagtagcttcctgtactggccatattgacgccccagttgatgagacagtatttgacatcgaaaaggagatagacgatctattgcctgttgaagtgaaagaacagcgtctgagtaacttgcttcaagccacaatggttggaggatgtgttgcagccatgccttttcttaaaaagatcccaacttcagtcctctggggttactttgccttcatggctattgaaagcttgcctggaaatcaattctgggaaaggatattacttctcttcaccgcaccgagcagaagatacaaggttcttgaggagtatcatgccacgtttgtggaaacagtgcctttcaagacaattgcaatgtttacaatcttccaaacattttatttgctgatatgttttggtctaacttgggttccaatagccggcgtcatgtttcccctgatgatcatgcttctagttccagtaagacaatacttccttccaaaattatttaaaggagcacatcttcaggacttagatgcggcagagtatgaagaggcaccagctttaccatacactcttgcaacagagtcagagctaggagcaggagctgttcaggcaggagatggagagattttagacgaggttataactagaagtcgcggagagttcaggcatatgagcagtcctaaaatcacaagctcaactgcaacacctgcaaatgatccaaaaagccatcaaagccctcgtttctcatcctcatatagtccaagattaagtgaactaagaggggagaaaagtcccaaggcaagtggaaaaggggctaagagtccaagaactccagaactaggactgtctaagctagggaagagtccttcaagttctgcacaaaattag

SEQ ID NO: 1408 - DNA, 2632 bp, Mimulus guttatus
cttacttacagacttacagatcgacttacagtcactgtttgtttgtttgatgaactatttttgaaggaaaaaagaaaaaagggtctgtctatatatatttggggtcttcctttctttcttcttcgcgcgctctcgcattcttgttttactttccacagttacaaactttgattgcacacagcaatgctgcagtagcccaataacttcttcttccgtagctgatttattttagggagaaaataaaatcaaaaagatatatagtatagttaagttaaaatggaggaaacatttgtgccattccgtgggattaagaatgacattcaagggaggctactctgctacaagcaagattggactggtggtttcaaggctggtttcaggatattggctcctaccacctatattttctttgcatcggcaattccagtgatttcatttggtgaacaattggagagaaatacagatggggttttaactgctgttcagacattagtatcgaccgcaatttgtgggataatacactcaataataggaggtcagcccttactaattcttggagttgctgagccaactgttataatgtacaccttcatgttcacctttgctaaacaaagacccgatttgggccgtgaattgtttctcgcttggactggatgggtgtgcgtttggacagcagctttgctgttcttgttggctatattaggggcttgctctattatcaatcggtttacccgtgtcgctggtgaactgtttggaatgcttattgcaatgctcttcatgcagcaagctatcaaaggacttgtggatgagttccgcataccaaaaagggaagatacaactctaacggagtttatgccttcatggagatttgctaatggcatgtttgctttggttctttcatttggtctattgcttactgctttgagaagccgaaaagcaaggtcatggcgctatggttctggttgggttaggagccttgtagctgattacggggtgccgttaatggtgttggtctggacagctatatcctacatacctactaaaagtgtgcctgaaggaattccgagacgtctcttcagcccaaatccatggtcacctggtgcctatggcaactggaccgatatgctgaacgtgcctattctatacatactcggagcgtttattccagcaactatgattgctgtgctttactattttgaccacagcgttgcgtctcagttggctcagcagaaagaattcaatttgagaaaaccgccttcctttcattatgatttacttctccttggttttctgacattaatgtgtggtcttcttggaatcccaccatcaaacggtgtgataccacagtccccaatgcatactaaaagtttagccactcttaaacaccagttgctcaggaaccggcttgtagctacagcacgagagagtattcaaacgaactcaagcttaggacaattatatggaaacatgcaagaagcatatcaacagatgcagactcctcttgtctaccaagagccatcatcagccagaggtctaaaggaattgaaagaatcaacggttcaactagcgtcgagcatgggaagtttcgatgctccagtggatgaaacggtattcgatgtggacaaagagatagatgatttacttccagttgaggtgaaagaacaacgtgtgagcaacttactgcaggctgttatggttggaggatgtgtagctgcaatgcctgcattgagaatgattccaacttctgttctttggggatattttgccttcatggccattgaaagcttacctggcaaccagttctgggaaaggatattactgctcttcactgcacctagcaggagatataaggttttggaggactaccatgcgacctttgtggagacagtgcctttcaagacaattgcgatgttcacagtatttcagacaacgtatttgcttctctgtttcggcattacatgggttccgattgcggggcttttgttccctctgctcattatgcttttggtccccgtaagacagtacgtgctgccaaaattcttcaaaggggttcaccttcaagatttagatgctgcagattacgaagaggcacccgcagtaccattcaacattccggaaggagagctgggaggtggcagactttcattcgctgctgacggaggagagattttggacggaattattacaagaagtcggggtgaaataaaacatatgtgcagtccaaaggtaacgagttcatcttcagcgacacctgcaaaagatggtaaagtactacaaagcccaagggttggtgagctacgaggagagagaactcctcggtctggtggaagaggacctcacagcccgatgactggagaagtgggcccatctcatttggggataagtcctcgtaaatctgcttcagaccaatgataataagctgataaatcgatttaagatagtagtaatcaattcaatcctccttggtatgtgtttttttttcttttctagttgtttatgttttgaatgtggtgtattatcaaagtcggtgcgggagacaatgcaagctgtaaaattaaccaccaaccttattatatatgttgattccgagggatcctccaatgaatttgtgtgtatgtacatttcatatgca

SEQ ID NO: 1409 - DNA, 2846 bp, Fragaria vesca
aagctcaaaccgagtatccgaccttccttcaagctagctcgcttgatttgtttttgttggctctctctccccaacttacttctgaatttctggtacacccactttagaatctaccattttccctcacattctggggttctttcttatgtgagtctctccacagttttggattgaaacttttagagaacaaggtccagatcatgtaattgaggtggttatttgcttctgtttgcctcttcttcaaatggcaatctcttgcgcatcaggtttttgagagaaagccttgttaggaacacccattgatttagtggaggctatccaagtagcgtaggtagtagtaatatagtagaggtagaagcatggaggagacatttgtgcctatgcgcggaattaagaatgaccttagaggaagattgatgtgctacaagcaagactggactggtggctttagagcaggatacaggattttggctcccaccacatacatcttttttgcttcagcaatccctgtcatttcatttggtgaacaactggagcgaagtactgatggggctttgacagcagtgcaaaccttagtttctacggctgtttgtggaatcatacactccataattggaggtcaacccttgctgatattgggtgtggctgagcctactgtaattatgtacaccttcatgtttaattttgtcaaggaacaaaatgacttgggtgcaaagctgtttctggcatgggcaggatgggtatgtgtatggacagcagggttgctgttcttattggctattttgggtgcttgttccattatcaacaggttcacccgtatagctggagaactgtttggcctccttattgctatgctcttcatgcagcaagccataaaaggacttgtggaggagtttcgcataccacaaagagaagatacaagtttagcgcagtttatgccttcatggaggttcgcaaatgggatgtttgctttggtattgtcatttggccttcttctcactgctttaaaaagtcggaaagcaaggtcttggcgctatggctccggttctcttagaggcttcatagcagattatggagtgccacttatggttctagtctggactggtgtatcttacataccaactagtagtgttccaaaaggaatcccacgacggctctttagcccaaatccatggtcacctggtgcatatgagaattggactcaaatgcttgatgttccaatcctgtacatcattggagctttcattccagccacaatgattgcagtgctttattatttcgaccacagtgtagcatcccaacttgctcagcagaaagagttcaatttgagaaagccatcgtcttaccattatgacttgcttcttttggggtttctgaccttaatgtgtggtctgctaggaattcctccatcaaatggtgtcattccacagtctccgatgcatactaagagtttggctactcttaaacatcagttgctacgtaataagcttgtagcaacagcacggaaaagtatgcgaaagaatgctagcttgggacagctgtatggaaatatgcaagaagcctatcatcaaatgcagactcctttggtttaccagagtgcctcgtctctgggactgaatgagttaaaagaatcaactatccaggcagcttcaagtatgggaaactatattgatgcgccagttgatgatacagtgtttgatgtagagaaagaaattgacgatctattgcctgttgaggtgaaagaacagcgtcttagtaacatacttcaagctgtactggttggagcatgtgttgcagccatgcctatactaaaaaagatcccaacatcagtcctctggggctacttcgctttcatggccattgaaagcttaccgggtaaccaattttgggaaaggatcttattgctctttactgctcccagtagaagatacaaagtcctcgaggagtaccatgcaacttttgtagaaactgtgcctttcaagacaattgtgatgtttacaattttccaaactgtgtacttgcttatatgttttgggcttacttgggttccaattgccggggtcatgtttcctttgatgatcatgcttttggtccctgtgagacaatactttctgcccaagtttttcaaaggagctcatcttcaggacttggatgcagcagagtatgaagaggctccagctttaccatttaatcttgcagcggagacagagctgggagctggagcttcctgtgctggagatgcagaaatactagatgacgcttttacccgtagcagaggtgagtttaagcatgtgagcagtcctaagatcacaagtacaacttcaacaccggcaaatgcccctagaagcctcgagagtccacgtgtctccttcagtccgcgaatcagtgagctaagaggagtgccaagtcctcgttctggtggaagagggccgcatagtccaaagactggagaagtgaagccttccattctgggaaagagccttagtaagagcaactcgacatcataatatctgcacactatgctcctacctttaattaagaagtttatagatggctttcaccatattctcgccaattgttggtttgttttgtcttgtttttctttggtttgttgtaaagagctgttccttgttttgcttccatgcctctgagggacttgtaatcgtagcatatgttagcattgtcttcattaattgtgtaacaattatcctagtgagtgtttttctctctgactatgtaccttcttccaaagagactacttttttagaaatgtatatggattctgagtccctcatcaactgttctccataatctctttctctgtagcaagtgccagaaactgacac

SEQ ID NO: 1410 - DNA, 2391 bp, Cucumis sativus
acccattttgaaattatggaggaaacttttgttcctcttcgtggaatcaagaatgacttgaaagggagattagtgtgttacaaacaagactggactggtggtttgagagctggatataggattttggctcccaccacttacatattctttgcctctgcaattcctgtcatttcgtttggtgaacagttggagagaagtactgatggggtactgactgcagttcaaaccttagcctccacagctctttgtgggatcattcactctattgttggagggcaacctttgctcatcttgggagtggcagagcctactgttattatgtataccttcatgtttaattttgcgaaagaacgacctgagttaggcaggaatttgtttctagcatggagtggatgggtgtgtgtttggactgcagccttgttgttctcaatggctatcttaggagcttgttccatcatcaataggttcacacgactggctggtgaactgtttggtttgcttatcgcaatgcttttcatgcagcaagcggtcaaaggacttgtggatgagtttcaaatccctgaacgagagaatccaaaactgatcgagtttataccgtcttggaggtttgccaatgggatgtttgctttggtactatcatttggccttctattcactgctttaaggagccggaaagcacggtcatggcgatatggatccggttggctcagaagcttgatagcagactatggagtaccgctcatggttcttgtttggacaggtatttcttatataccttcaaaaagtgtcccagaaggaatcccaaggcgcctcttcagccccaatccatggtctcctggtgcgtacgagaattggactgttattaaggatatgcttgaggttccagttatttacatatgtggagctttcatcccggctacaatgattgcagtgctttactatttcgaccatagtgttgcatcccaacttgctcagcagaaagagtttaatttgaggaaaccatcttcttaccattatgatttacttctattgggattcttgaccttaatatgtggtcttcttggaatccctccatccaatggagttatcccccaatctcccatgcatacaaagagcctggctactctcaaacatcagttgctgcggaataaacttgtagaaacagcacggagtagtatgagaaagaatgccagcttaggacagttgtatggaagtatgcaacaagcatatcaacaaatgcagacccccttgatctaccaacagccttcagttcgtggactgaatgagctaaaagagacaaccattcaagcagcttctagtatgggcagttttgatgctccagtcgatgagacaatgtttgacattgaaaaggaaattgatgatctattgcctgttgaggtgaaagaacagcgggtcagtaatttgcttcaagcggcaatggtgggaggatgcgttgcagccatgccagtcctgaagatgatcccgacctcggttctatggggttactttgcttttatggccattgaaagcttgcctggtaaccagttttgggaaagaatcttgttgctctttactgcacccagcagaagatacaaagttcttgaggattaccatgcgactttcgtcgaaactgtgccattcacatccattgtactttttaccatttttcaaacagtatatttgttcatatgttttggactaacatgggttccgattgctggggtgatgtttcctctgatgatcatgctcctcgtccctgtaagacaataccttcttcccaagttttttaaaggtgcgcatctccaagaccttgatgctgccgaatatgaagaagctccggctttaccgttcaatcttgcgacggaagccgagctgggagcaggagcatcttttggtggggatggagagatcttggatgaggtcatcacccgaagccgtggtgagtttaggcgtattagtagtcctaaaatcacaagctccacggcaacaccaatatctgacagaaaaagtatagacagccctcatcgctctttcagccctcggttgagcgagctaaaaggagagcacagtcctcgagccggtggacgagggacaccgggtcagaggagtgcagaagctaaaccatccagtctggggaagagccctcttaataacacagcatcaaagtagatgctgaaagaaacttgtagaattcatcctctgataagaagttttagataagtttgatatgatatattgttaaatttgtaacttggagtaatgttcatttttctttagcatctttgtatagtcttctttcttctgctcttggcttctctttgcaagaacagatcgcttcataaaagttgccatcctcttaagatttgtagtaattcaaagtgtgtttttgtt

SEQ ID NO: 1411 - DNA, 2462 bp, Medicago truncatula
tttgttgtgatttgtttggaattatttgtctttccttaaccttctttggtgggaaaaagaaaaaaaatactatggaagaaacatttgtaccttttgaaggtatcaagaatgatctaagaggaaggttaatgtgctacaaacaagattggacaggtggaatcaaagcaggtgtaaggattttggcccccacaacatacatattttttgcttctgcaatacctgtcatttcatttggtgaacaactagagagaaatactgagggtgttctaacagctgttcaaaccttggcatcaacttcaatatgtggcattatacactcaatcattggtggtcaacctttactgattttaggagtggcagaacctactgtgatcatgtacacattcatgttcaattttgctaaagaaagacctgagttgggcagaaacctgtttcttggatgggctggatgggtatgtgtatggactgctttgatactattcttactggccatcttaggagcatgttccatcatcaaccggtttacccgaattgcgggagagttgtttggcatgctcattgcaatgcttttcatgcagcaagctatcaaaggacttgtggatgagtttcgcataccaaagagagaagatacaaaagcaattgagttcttaccttcgtggaggtttgctaatgggatgttcgctttggtcctttcatttggccttctccttactgcattaaaaagcagaaaggctagatcatggcgttatggtagtggttggctccgtagccttatagccgactacggtgttccgcttatggtcctagtttggacaggtgtgtcctacatgccgactgcaagtgttccaaatggtatcccacggcgcctctttagtccaaatccgtggtcacccggtgcctatgacaattggactgatatggttcaagttcctgttgtattcataattggagcatttataccagcaactatgattgcagtgctttattactttgaccacagtgtggcatctcagctttctcagcagaaagagttcaatttgagaaagccatcttcttaccattatgatttgctccttttgggatttttgacattattgtgtggccttattggaattcctcctgcaaatggagtcataccgcagtctccgatgcatacaaagagtctagcaactcttaaacatcagttgcttcgtaacagactcgtgataaccgctcgaaacagtatcagtaagaatgctagtctaggacagttatatggtaatatgcaagaagtataccatcaaatgcagacaccccttatttaccaggacccatctgctcgagcacaaggactaaaagaattaaaagaaacaaccattcaagcagctacaagcatgggaaacgtggacgccccggttgatgagactatatttgacgtcgagaaagaaatagatgacttgcttcctgttgaggtaaaggaacaacgtgtcagtaacttgcttcaatcagtattggttggaggatgtgttgcagccatgcctattctcaagaaaatcccaacttcagtactttggggctactttgcctttatggcaattgaaagtttacctggaaaccagttttgggaaaggatccttttactcttcactgcaccaagcagaagatacaaggtgcttgaagattaccatgctacttttgttgaaacagttcctttcaagacaatagcattattcacaattttccaaaccatttatctatttatatgttttggactaacttgggtacctattgctggagtcatgtttcctttgatgatcatgctcttagttccactaagacaatactttctccccaaatttttcaaaggtgcacaccttcaagacttggatgcggccgagtatgaggagcaaactgctttaccgttcaaccttgcatcacaatctgagtttggagctggtgcttctcatattggagaaggtgagatatttgatgaagttatcacaagaagccgtggtgaatttaggcatactactaacagtccaaagatcagtagctccactccaacaccaagaaatgatcctaaaagccgtctaagcccgcacctctcttttaattctcgtgtgggcgagttcgcgactgagcaaagtcctcggtctggcgtaagaggcaccaacagtccaatgaccaaagaaatgagattgtcaggtaggggaataagtcctctcaaccctgattccaaacaccaagacaagaaataattcaagacttgtgtcttagaatgatgtaggaggcttatttgttgcttcatttccagtttatggttctttaattttgcttggctttttattgtaacttgtaaagtattttcagtatcctatatacaacaggtgtatgcaaccaaaaatatggagcttcctatgtcaaattgtaactgttaatgttactatatttgtgcaaatgtatatcatcatcaagtttgtttc

SEQ ID NO: 1412 - DNA, 2984 bp, Vitis vinifera
ttcagcctcatctctctctctgtcaaaatctacagtgcctgctcttttttcaacccttttgaagcttatatatttgtagttttcctctctcccttctatgcaaacacattgattgcagtaagcatttccagaggtttgagacctcttgtgcttttgattcaatcatcagctgctctgctctcctgaatttaaactcatagctgatgcattgaatgatgtaatctggttcaagtattcaagtttggcacattttgaaagctgatgtctggtttgacctttctgtgtatctccattttgattgatctcttcctgtgtcaagttcttcaccgtgagtcttttgatacagaatcttggatacccaagtcatgtgatttatggatatcgatagcatcctaactgtgaaagcccaagggatccttgaagggtattcctcatccttttcagtgtcgtatttctttttctgttagaagccatttgggaagcaagagtacgtagtcgctgagttttaagtaggaagagccatggaggagacttttgtaccatttcgtggaataaagaatgatcttcgaggaagattgatgtgctacaagcaagattgggctggtggattcagagcaggcttccggattttggcccctaccacgtacatattctttgcttctgctatcccggtcatttcatttggtgaacaactggagagaaatactgaaggagttctgactgcagttcagaccttggcatccacagcaatttgtgggattatacactccatcattggaggacaacccctgctgatcttaggagttgcagagcccactgtcatcatgtacacattcatgttcaattttgccaaggagagaccagatttgggccggaagctgtttctagcatggactggatgggtatgtgtgtggactgcattcttgctgttcttactggctatcttaggagcttgctccattatcaataggtttacccgtgtggcaggagaattgtttggtctgctcatcgctatgctcttcatgcagcaagctattaagggaattgtggatgagtttcgcataccaaaacaagaaaatgccaagttaacagagttcataccttcatggagattcgcaaatgggatgtttgctttggttctctcatttggccttctgctcacagcattaagaagccgaaaagcaaggtcatggagatatgggactggttggcttcggagccttatagcagactatggtgtgccccttatggttctaatctggacagcggtttcctacatacctgctggaagcgttccaaaaggaattccacgacgccttgtcagcccaaatccatggtcacctggtgcatacgagaattggactgacatgcttgatgtgccagttctctatatagtcggagcttttattccagcgacgatgatcgcagtgctttactattttgaccatagtgtagcatctcaacttgctcagcagaaagaattcaatttgagaaagccaccatctttccattatgacttgcttcttttagggttcttgaccattatgtgtggtcttattggaatccctccatcaaatggtgtgatcccacaatctccaatgcatacaaaaagtctggctactcttaaacatcagttgcttcgtaaccgtcttgttgcaacagcacgcataagtatgagaaagaactcaagcttaagtcaattgtatggaaatatgcaagaagcttatcagcaaatgcagacccctttgatctaccaggagccctcagctcgaggactaaaggagttaaaagaatcaacaattcaattggcttcaagcatgggggcaattgatgccccagttgatgagacggtatttgatgttgagaaggagattgatgacctactgcctgtggaggtgaaagaacagcgcctgagcaacttgcttcaagccgcagcagttggtggatgtgttgcagccatgcctatccttaaaatgatcccaacctcagtactttggggctactttgccttcatggccattgaaagtttaccaggtaaccagttttgggaaaggattttattgctcttcaccgcaccaagcagaagatacaaagttctagaggagtatcatgccaccttcgtggaaactgtgcctttcaagagtattgcgacatttacaattttccaaacagcatacttgcttatctgttttgggatcacatgggttccaattgcagggttgttgttccctttgatgatcatgcttttggttcctgtgagacaatactttctgcccaagtttttcaaaggggcacaccttcaagatttagatgcagcagagtatgaagaggcaccagctttacctttcaatcttgcaatggagggagagatgggggctggagcttctttggcagagggtggagagattttagatgaaataattactagaagccgtggtgaaattaggcatatgtgcagtcctaagatcacaagctccactgcaacaccaacaaaagatcccagaaactttcagagtcctcgtctatcagaaaaagcatacagccctcgagtaagcgaactaagaggggagcatagtcctcaatcaagcgggagagggaaatacagtccaaagacaggagaagtgaagccgtctaacttgggaaaaagtccacattcctcaaactaatgagaagaattagctagtttaataaatctctctctctactaagttcaatatttgctttcttgttgcaccatctcttttcaatgttgtcttggacccttgactggaaattatataaaccctctcctttagcaaagaggggagttgtaaccatagaattgtttggtccttctgtttcaacaattctagtgactactactctcttcttgtactgtcttgtttcctctgtttcttgaaaaggaaactaggtattggagattgtgtattcactccttgcatgtatatccacttttcggttttcttcgattctctcacagataa

SEQ ID NO: 1413 - DNA, 2867 bp, Eucalyptus grandis
gacctgcactggtttgctctgtaccaaaatccacctccttttttttttttttttggctttttatcaaacccaaaaacacttttggtgcttatataattgagtcattctgctctcttctctttacaaggcagtttagatcagcagacacaggaatcactttgtttgtgacccatttgtattgcactgaatcttgcatgctggtttctctgaaatattcctgcatgaactctttttactagctcatggctgtctgaacctgtcacagagtcttgtactgtattgctccagttgaagttatggagggtttccgataatctggaccttgatttcaccgaaatggctaggcgttgacggcttacaatgatcaagtcgttcctttagaaggcgttaagtagagaaaatattgtgttggttggtggagcttcttttctttttccttggagagaactatggaggagacatttgttcccttagagggaatcaagaatgatcttagaggaaggttgatgtgttatcggcaagactggagtggcggcttccgagcaggaatcaggattttggctccaacgacttacatattctttgcttcggcgattccggtcatttcatttggggaacaactggagagaagcactgagggagttttgacggcagttcagaccttagcgtccaccgcaatatgcggcatcatccactcgatcatcggcggccaacctttgctgatcctgggagttgcagagcctactgttatcatgtacacattcatgttcaactttgccaaggaaagatcggatctgggtcggaacctgttcctcgcgtgggcagcttgggtctgtgtttggacagctgctttgctgtttctgatggccatactcggagcttgctccatcatcaaccgatttactcgtgtggccggagagctgtttggtctgctcatagcaatgctctttatgcagcaagctattaaagggctagtggaagagttccgcataccgaaacaggaaaacccgaagttggatgagttcttaccatcatggagattcgccaatggaatgttcgcgttagttctctcatttggactcctcctcactgcattgaaaagccggaaagcccgttcgtggcggtacggaacaggatggcttcgaagcttcattgcagactatggagtgccactcatggtcctagtttggaccgctgtttcctacataccggcaaagagtgtccccgatggaatcccacggcgtcttgttagcccaaacccatggtcccctggtgcatctgagaactggactgttgttaaggacatgttgaacgttccctttttctacataattggagcttttattccagcaacgatgattgctgtgctctattactttgatcatagcgtagcatctcaacttgctcaacagaaagagttcaatctgagaaagcctgcttcttatcactacgacctgcttcttttggggttcttgacattgatgtgtggccttattggagttcctcctgcaaatggagtaataccgcaatcccccatgcatacaaagagccttgcaacactcaaacaccagctgcttcggaaccggctcgttactacagctagaagaagcatacaaaacaatgcgagcttagggcaattgtatgggaatatgcaagaagcttatcgacaaatgcagaccccgttagtctaccagggagcctcttctcgaggacttaatgaactgaaggagacaacaatacaagccgcttcaagcatgggcaatctcaatgccccggttgacgaaacggtgtttgatgttgacaaggagattgatgatctgttgccagtcgaggtcaaagaacaacgcgtcagtaacttacttcagtcaatgatggtgggagggtgtgtcgcagccatgcctatcctcaaaatgattccgacttcggtgctttggggatactttgcttttatggcaatcgaaagtctaccgggtaaccagttctgggaaaggatcttgttgctctttactgcaccaagcagaagatacaaggtccttgaggagtaccacgcaacttttgtggagacagtgcctttcaaggcgattgtcactttcacgctgtttcagacaatatatctgcttatttgctttggactcacttgggttccgattgctggagttatgtttcccttgatgatcatgcttttggtgccagtaagacaatatgccttgccgaagtttttcaaaggagtacatcttcaggatttggatgctgcggagtttgaagaagcaccggctttgccattcaatcttgcaacagagacggagattggtgctggagcttcttatggtgggggtggagagatattagacgaggttatcactcgaagccgtggtgaggtccggcatctgtctagtccgaaaatcacaagctccacgacaacaccagcacatgattcgaagagcaccctccagagccctcggcccagtttcagtcctcgtgtgagcgagttaagaggtgagaggagtccttacggtggaagaggaccttatagtccaaggaccggagagaagcagccctctcatctggggaagagtccgagtaatccggcttctggttagctgatgaaggtttctagtcgcttaaaattaatgtctgatgcaagaacctgtactgtgtaattgttctgcttgcacagaggcatcagtgtaaaatatttctcgcaagtcaccacctttgtaacaatagatttctatgattttatctaaagagtttagccgtgaatttcgaactcccatttcctactgtctgaatgaagttttgctttattaattgtctgtactctggatttcattgaacgagtaaatatccttaaaaattttcaccca

SEQ ID NO: 1414 - DNA, 2439 bp, Lotus japonicus
atatggaagaaacatttgtaccccttgaagggatcaagaatgacctcagagggaggttaatgtgctacaagcaggattggattggtggaatcaaagcaggcctaaggattttggcccccaccacatacatattttttgcttctgcaatacctgtcatttcttttggtgaacaactagaaagagatactgatggtgttctaacagctgttcaaactttggcatccacttcagtatgtggcatcatacactcaatcattggtggtcaacctttacttattttaggtgtggcagagcctacagtgatcatgtacacattcatgttcaattttgctaaagagagaccagagttgggccgggaaaaatttctggcatggacaggatgggtatgtgtgtggactgcactgttgctattcttactggccatcttaggagcttgctccataatcaacaggtttacgcgaattgcaggagagttgtttggcatgcttattgcaattctcttcatgcagcaagctatcaaaggactagtggatgagtttcgcataccggaaagagaagatccaaaatcaattgagtttataccttcatggagattttctaatggaatgtttgctttagtcctttcttttggccttctcttcactgcattaagaagtagaaaggcaaggtcatggcgttatggtagtggttggcttcgcagcctaatagctgactatggtgtgcctcttatggtcctagtttggactggtgtgtcctacatgccatctaaaagtgttccaaatggtatcccaaggcgcctcttcagcccaaatccttggtcaccgggtgcatatgagaattggactgatatgatccatgttcctgttgtctacataattggagcatttattccagcaaccatgattgcagtgctctattactttgaccacagtgtggcatcccagcttgcccagcagaaagagttcaatttgagaaagccatcttcttaccactatgacttgctccttttgggatttttgaccttaatgtgtggccttattggaattcctccttcaaatggagtcataccacagtccccaatgcacaccaagagtctagcaactctaaaacatcagttgcttcggaacagactagtggtaacagcgcgaaaaagtattggaaagaatgctagtttaggacagttatatgggaatatgcaagaagcctatcatcaaatgcagacacctcttatttaccaggacccctctgcaagaggactaaaagaactgaaagaaacaaccattcaagctgctaccagcatgggaaacatggacgccccgatagacgagactatgtttgatgttgagaaagaaatcgacgacctgctaccggttgaggtgaaggagcagcgtgtgagtaacttgcttcaatcagtgatggttggagggtgtgttgcagccatgccaatcctcaagaggattcctacttcagtactttggggctactttgcattcatggccattgaaagtttgccaggaaatcagttttgggaaaggatcctgttactcttcactgcaccaagcagaagatacaaggtgcttgaggattatcatgctacttttgtggaaacagtccctttcaagacaatagcagcattcaccattttccaaaccgtttatcttctaggatgttttggactaacttgggttcctatcgcgggggtcatgttccctttgttgatcatgctcttagttccagtaagacagtacttcctccccaagtttttcaaaggggcacaccttcaggacttggatgcagcagagtatgaagagcaaactgctttaccatttaacattgccgcgcaatcagaatttggaggtggtgcttctcatattggagaaagtgagatcctagatgaagttatcactagaagccgcggtgagtttaggcacacaagcagcccaaggatcacaagctccactccaacaccaggaaatgaaactaaaagccatttgagcccgaatctctcttttaattcacgcatgggtgagttcacaactgagcaaagtcctcgttctggtgcaagaggtcctagtccaaaggccagagaagtgagattatcaagtcttggaagaagtcctcttgatcctgattcaaaacagaagcaggacaaaaaataattaatcaaacttgagaaagattatagtgttgtgcattagaatgattaggaggcttatttatttgttaattttccattttagtttgtttctacaataattttgcttggcaaggttgtaaaaaaagtgtggcgcctcctatatatgtcaattgtataagtgaatgtttgttatatttttgtgcaaatgtatatcatcatcacaggtttgttttaataaattgtgactctagtttgagtctttattagtttgatgagtactactacttgggcaaacgttttca

SEQ ID NO: 1415 - DNA, 2471 bp, Glycine max
atatggaagaaacatttgtaccctttgaaggaatcaagaatgatctgagaggaaggttgatgtgctacaagcaagattggtcgggtggaatcaaagcaggtttaaggatttgggcccccaccacatacatattctttgcttccgcaataccagtcatttcattcggggaacaactagaacgagatactgatggtgttctaactgctgttcaaacattggcatccacttcaatatgtggcattatacactcaatccttggaggtcaacctttattgattttaggagtggcagagcctacggtgatcatgtacacgttcatgttcaattttgcgaaagagagaccagagttgggccgggatttgtttctggcatggactggatgggtatgtgtctggactgcactgttgctattcttgtttgccatcttaggggcttgctctataatcaacaggtttacccgtattgcaggagagttgtttggcatgcttattgcaatgctcttcatgcagcaagctatcaaaggactcgtggatgagtttcgcataccagagagacaaaattcaaaatcaatcgagtttataccttcatggaggtttgctaatgggatgtttgctttagtcctttcgtttggccttcttctcactgcattaagaagcagaaaggctagatcatggcgttatggtaccggttggcttcgcagcctaatagctgactatggtgtgcctcttatggtcctagtttggacaggtgtatcctacataccagctggaagtgttccacatggtattccaaggcgtctgtttagcccaaatccatggtcaccgggtgcatatgagaattggactgttattaaggcatgtaaattgcaagatatggttcatgttcctgttgtgtacataatcggagcatttatcccagcaaccatgattgcagtactttattactttgaccatagtgtggcttcccagcttgcccagcagaaagagttcaatttgagaaagccatcttcttaccattatgacttgctccttttgggatttttgaccttaatgtgtggcctgattggaattcctcctgcaaatggagtcataccacagtctccaatgcacacaaaaagtctggcaactcttaaacatcagttgcttcgtaacaaactggtggtaaccgcacgaaaaagtatgggaaagaatgctagtttaggacagttatatggcaacatgctagaagcctacaatcaaatgcagacccctcttgtttaccaggacccctctgctcgagcacaaggactaagagaacttaaagaatcaaccattcaagcagctaccagtatgggaaacgtggatgccccagtagatgagactatatttgatgttgagaaagaaatagacgacctgcttcctgttgaggtaaaggaacagcgtctcagtaacttgcttcaatcaacaatggtgggaggatgcgttgcggccatgcctttactcaagaagatcccaacctcagtcctttggggttactttgccttcatggccattgaaagtttgccaggaaaccagttttgggaaagaatcctattactcttcactgcaccaagcagaagatacaaggtgcttgaggattaccatgctactttcgtagaaacagttcctttcaagacaatagcaacattcaccattttccaaaccatttatcttcttatatgttttggactaacatgggttcctattgccggggtcatgtttcctatgatgatcatgctcttagttccggttagacagtactttctccccaagtttttcaaaggggtacaccttcaagatttggatgcagcagcatatgaagagcaaacagctctaccattcaaccttgcaacacactcggagtttggagctggtgcttctcaagttggagaaggtgaaatcctagatgaagttattactagaagccgtggagagtttaggcacactagcagtccaaagatcacaagctccaccccaacaccaagaactgatcctaaaagccatttaagcccacgcctctcatttagtgctcgcgtgggtgagttcaaaactgagcagagtccacgatctggtgcaagaggtcccctcagtccaaaggcaggagaagtgagattatcaaatctgggaagaagtccacttaatccagattcaaaacagcaggaccaaaactaataattaaacgtagaagattgcagtcatatgccttagaaggactttataggaggcttatttgttgctacatttccattctagtttgttctttaattttgcttgtcatggttgtaacttgtaaagtcctttcccttgtcccatattcgacagatatgagatatgtaacaaagtgtggcgctttcctatatcaattgtattagtgaatgttactatatttgtgcaaatgtatatcatcatcacaagtttgtttcaataaattgtgactagtttgagtcttgtatt

SEQ ID NO: 1416 - DNA, 1345 bp, Arabidopsis lyrata
gctttatgtcgccttctcttcgtcaccgtgtgtgtgagttcgccgacgccgtgaattcttggttttccgatttaccattcacctccgacggcgcatcatttctctccttctccacagtttacatgttcgtggattgcctgtttctcagttatattcaatctggtgaaaacaagaatctccaagctcagagacactgagactagatcctctgtttctgtgaacttgcttatcagattcttgttgccttatccaactgatttgaaccaaccggtctattccggttattgcctcacgaagcagatcacagaatgtcatgttagctttaggttatgccaaaggaatcgctcatcgatttctcagaaatcccaaatggacctctggactcttcttgcatcacaatcagtcccctaattactccatttatgtaaagtcaaaaccttttctacaagttccatgtaaatcagcttcttttgatgttttacaagctcagagacggaatctatttgcgtatgatggtttctttagtaggcgttacttaagtaattcgacggtagagctaagaacagatgataatgtggtgaggtttgctttcaacaatgttactggtagtggtaacaatgttgtgcctacaagaaaagagaagaaatggaaacgggctaaaatgtcgagaaaggctaaagtgaatgagttaaggttttatcgtcttaaggcgaaaaagaagatgaattcaccaaaccctgaagtcaggattcgatataagcttgaaaaggccaagaggaaagaagaatggttgattgagaaactgaggaaatacgatgtcccgaagtcatcagcagagccgtatgatccagaaagtttgacagaggaagagcagcattacttaaaacgtacaggtgaaaagagaaagaactttgtacttgtcgggagacgaggagtgtttggaggtgtggttctgaatttgcacctacattggaaaaagcatgagactgttaaagttatttgcaagccatgcaacaaacccgggcaggttcatgagtatgcagaagagcttgctcggttaagtaagggcattgtgattgatgtcaaacctaacaacaccattgtattgtaccgcgggaaaaactatgtaagaccagaagtgatgtctcctgttgataccctctctaaagataaggctttggagaaatatcggtatgagcaatcgcttgaacatacgagtgagttcatagagaagctggagaaagaacttgaggagtaccagaagtacgttactcggcacaagaagaagaaagatgaagaagcagagaagaagaaagaggcagattccaagagcaaagtagtgtaa

SEQ ID NO: 1417 - DNA, 1443 bp, Eutrema parvulum
cgccgtcaatttcacgatttttccgtttagccgtttgccacttcctacaaatcatttctctttttcattgtctctctaagagatatatctatttcaaggtttgtagattctcttgtttctgagtggtattcgatcttctggtgaagataagaaggggagactgaaccctctgtgcttatcagatcctcctttcctgagccggccgatttgaaccaaccggtcaattccggttattgaaactctgccacacattgccccacgagaaaattcagaggatgtaatgatgttagcttcaggttatgccaaaggaatcgctaatcgatttctcagaaatcccaaattgacctctggactcgtcttgcttaacctgcagttccctaaatactccgtttatgcaaagcagagaccttttgtagaagtcccatatgaatctgcttcattcgagcttttacgaacatcgacgcagaatgtatttgcgtttaacagacggtacgtgagtaattcgacgatagagctaagaacagatgataatgtggtgaggttttctttcaacaacaatgtccctgataacaaaagtgtgcctatgatgaaagagaagaaatggaaacgagctaaatcgtcgagaaaggctaaagtgaatgagttaaggttctatcgtctaaaggccaaaaagaagatgaattctccaaaccctgaagttaggattcgatacaagcttgaaaaggccaagagaaaagaagaatggttgatagagaaactgaggaaatacgatgtcccgaaatcaccagcagagccctatgatcccgaaactttgacagaggaagagcagcattacctaaaacgtacaggtgaaaagagaaagaactttgtacttgtggggagacgaggagtgtttggaggtgtggttctgaatatgcaccttcattggaaaaagcacgagactgttaaggttatttgcaagccctgcaataaaccgggacagattcatgagtacgcagatgagcttgctaggctaagcaagggcattgtgatcgatgtcaaacctaataacgccatagtattgtaccgcgggaaaaactatgtaagaccagaagtgatgtctcctgttgatacactctctaaagataaggctttggagaaatatcggtatgaacaatcgcttgaacatacgagtgagttcatagagaagctggagaaagagcttgaggagtaccagaagtatgttgctcggtacaagaagaagaaagatgaagaaacggagacgaagaaagaggcagattcaaagagcaaagcagtgtaacttatacatttggagactttgtttagcctcaagacccagttctcaaaaggaatctgaaaacagaggtaagtcaatgatgttttggcttttcaaagtcgttgatttggtgcaaagagtccttattttgcattctgtccaagttg

SEQ ID NO: 1418 - DNA, 1366 bp, Eutrema halophilum
aagttcggcagcgacggcaatccataattttcccgtttaaccgtcgcctccgtcgacgaatcttttctttctctatttgtctcttaaagtgatatttctatttcaaggtttgtaatttctcttatttctgagtttatccgatcttctggtgaagataagaagcgacttgacccctctgtgcttatcagatccttgttgcctgaaccagccgatttaaagaaaccggtcaattctggttgttgaaactcttcccacattgccccacgagaaaattcataggatgtaatgatgttagctttaagttatgccaaaggaatcgctaatcgatatctcaggattcccagatggacctctagactctgcctgcttaaccatcaattccataactactccgtttatgcaaagcagagaccttttgtagaagtcccatatgaatcaccttctttcgagcttttacgagcatcaaggcaggatgtatttgcgtataacagacgttacatgagtaattcgacgatagagctaagaacagatgataatgtggtgaggttttctttcaacaatgtccctgacaacaaaagtgtgcctatgaggaaagaaaagaaatggaaacgggctaaatcatcgagaaaggctaaggtgaatgagttaaggttctaccgtttaaaggccaaaaagaagatgaattctccaaaccctgaagttaggattcgttacaagcttgaaaaggctaagagaaaagaagaatggttgattgagaaactgaggaaatacgatgtgccgaaatcaccagcggaaccctatgatccagaaaccttgacagaggaagagcagcattacctaaaacgtacaggagaaaagagaaagaactttgtccttgttgggagacgaggagtgtttggaggcgtggttctgaatatgcacctccattggaaaaagcacgaaacggttaaagtgatttgcaagccctgcaacaaacctgggcagattcatgagtacgcagaagagcttgctcggctaagcaagggcattgtgattgatgtcaaacctcacaacaccataatattgtaccgtgggaaaaactacgtgagaccagaagtgatgtctcctattgatacactgtctaaagataaggctttggagaaatatcggtatgagcaatcgctggaacatacgagcgagttcatagagaaactggagacagagcttgaggagtaccagaagtatgttgcacggtacaagaagaagaaagatgaagaagcggagacgaagaaagagacagattcgaggagcaaagctggttatgtctatgattctagcctcaagaccccaattctcaaaaggaactgaaaacatagggaagccaatg

SEQ ID NO: 1419 - DNA, 1098 bp, Arabidopsis lyrata
ataattagaaacttacgcatgcatcagcttccgtaaatcttcttcatctctctctgtctctctctcctctctgctttttgctttctagggtttttgatcatctctcaggtgaataggtttcggtataatctcatcccaatgtctgctaattccaagtcggagaggtctgcttctcaatcggcggagacggtggctgtttctaaccgtgtcgtggcgtcacggtcaagtcgtcagccgcgtctctctttctcctcctttgctccgtcatcagagcacgattacttgaagaagctgaaatccgatgagatttctccgacgagagaggaagttccggtgtcggtgaaggagagagaagaaacggaggaggaggaagcgaagaggacttggaatcttcgtccgagaaaggcttttggtggtttgaagaaaggaaacggcgtattagcggcggaggtgtgcggtggcggaggaggaggagggggttcggaggtgaagaatcagaaatcaagcggaggaatggagccgaaatcgaacaggcagagaggaatcccggcggaatctcccggattaggcggtggtgaggtagcgaacgagaatcgcaggctttgggttgctctttcacgagacgagatcgaagaagatttgttcagcatgagtgggaacaggccatctcgccggccaagaaagagggcaaaagctttgcagaaatatctcgatgtcattttccctggattgtgtctcgttgggatgaatgctgattgcttcagagtatccacttctccggctaagtgatgatcgatgcaaaggagtcttttggtgaaggaaaaagataggtatgctggtgatcaagaatccagatacaccacagtagaagataggaaggagatatatcaagagacatgttcttgtctcatatcaaacttagtagtaactaaattataagtaaatatcggtaagttcatataattatagatatataaagaaaagagagcgagaggggtttgtttttgagttagttagtaagatgcgtcgaagtttaatataatggtagagcaaaacaacataatctatgttaaaaagtgagtttgttaaaccatttat

SEQ ID NO: 1420 - DNA, 1336 bp, Arabidopsis lyrata
aaataaaatcaacattttattcatttttctccgctcaacgctcttctttccctcttccgattctcctgttgtcccattgatcaaaagcctatggatttcaatagaaaagctcatccggattgtgtatatgcggataatcctttccatgaatgtgcttcagcttgtttagagagaattgctcaaggccatgtcaagaagaacactaagaagcaaagttcaaggcttcttagcttctcagggagtttcggtaggaaaaagaaggaatcacattcacaaccgccttcaccactatccgcaaggccttaccaaaacggcagaggcggttttgcaaatagtaattccccaaaggttcatcattccgtagctccatctgtttctgtgaagaagaagattgtttctgaatcgaataagtctttaacttcttcatcatccggtgacccggatgatttcttcaaccataaaccggagaagaaaccttctcaaaccattccactttcctcaaacaatttggttgatcaaagcaaagccgtatcacctaaacctggaatacaagaacacgacgggaagattggagcaggcggcgaaactagactctttagtttcctaagccttccaagatcgcatgaagaagagagcaatgatgattatactgatgatgatgaagaaaacaacaatgagattggtgtagagctcgatcttgaatcagtaatgtctgacacttttgtctctgtcggaaaataccgagtcagatccggttcatccacaatcctaagtgctatcatcgaaaaacacggagacattgctcaaaactgtaagctggaatcggattcaatgcgatcccgttacctggagtgtttatgctcactgatgcaggaactcaggtcaaccccggtagggcagttgagcaaaatcaaagtcaaagagatgcttgcggttctcaaagacttggagtctgtgaacatcgaagtggcttggctacgttctgttcttgaagagtttgcgcagtctctagaagatgcagaaaatgagaaagagaggcatgatggtttagtgaaggctaagaaagaagagcttgaggctcaagaaacggatttggttaggatggagaaggaagtggcggaagcgaggctgcggattgaggagacgcgggctcagatggtcgagattgaagcagaacggtcgaggttggagaaaatgggattcaaaatggaaaaatttaaagggaaatcgtttatagatgagcttctgtgagtttgtgctgtgattgtgtgtgatgttgttagtaataggtaatagcacaaaatcaaaaatactctctaataaatgagttcttaag

SEQ ID NO: 1421 - DNA, 1520 bp, Eutrema parvulum
aaagatcaaacattttaattcattttctcccttccttccttcttctccgctcaacatcttttctttctctcttccgtttctcctggttttgattttgcagtttgttgcatctaattgaaactctgacattcatcaaaagctatggatttcaatcaaaaagctcatccggattgcgtatatgcggacaatcctttccatgaatgtgcttcagcttgtttagagagaattgctcaaggccatgtcaagaagaacactaagaagcaaggttcaaagattcttagcttctcagggagtttcggtaggaaaaagaaggaaacgcattcacaaccgccttcaccgttatctgtaaggccttatcaaaatggtggaggcggttttggaaacgctaattcccctaaggttcatcattcagtagctccacctgttgctgtgaagaagaagacaatttctgaatcgaataagtctttctcttcttcatcatccggtgaccctgatgatttctttaagcataaaccggagaaaaaactctctcaaatcatacctctttccccaaacaatttggttgatcgaagcaaagtggtatcacctaaaccaggaaaacaagaacacaacgggaagattgaagcaggcggcgaaactaaaccatttaatttcctaagctctccaagattgcctggaaaagagagcagtgatgactacaatgatgattacagtggtgatgatgatgatgaagaaaacaacacagaaactggagtagagcttgatcttgaatcagtaatgtctgacactttcgtctctgttgggaagtaccgagtgagatcgggttcgtccacaatcctaagcgctatcctcgagaaacacggagacattgctcaaaactgtaagctggaatcggactcaatgcggtcccgttacctcgagtgtttatgctcattgatgcaggaactcaggtcaaccccggtcgggcagttgaccaaagccaaagtcaaagagatgctcgcagttctcaaagacttggagtctgtgaacatcgaagtggcttggctacgttcgattcttgaggagttttcgcagtctcaagaagatgtagagactgagaaagagaggcaagagggtttagtgaaagctaagagagaagagcttgaagctcgagaagcggatttggttaggatggagaaggaagtggccgaagcaaggttgcggatcgaggagacgcgggtcctgatggtcgagatggagagggaacggtcaaggatggagaaaatgggattcaaaatggagaaatttaaagggaaaacgtttatagatgagcttctatgagctttttgtatgttgttaatagtaagtagtagcacaaaaccaaaatactcctaaatgagttttcaaaggttaggcttttttttagtatattggaaagctggttttatatctctaaggtgaaatgtttatttattagtaacttgtaatggtgtgttgatgtattatgttgttgctaataaaattgttttgcttgataatgc

SEQ ID NO: 1422 - DNA, 1535 bp, Eutrema halophilum
gggaaaatcaaacatttttattcattttctcccttccttcttctccgctcaacatctttctttccctcttccgtttctcctcctgggttttgaattgtagtttgttgcatcaaagcttcaagctgtgacattgatcaaaagccatggatttcattcgaaatgctcatccgaattgtgtatatgcggacaatcctttccatgaatgtgcttcagcttgtttagagagaattgctcaaggccatggcaagaagaacactaagaagcaaggttcaaagattcttagcttctcagggagtttcggtaggaaaaaaaaggaatcgcgttcacaaccgctttcaccgctatctgcaaggccttatcaaaatggtggaggcggttttgcaaacgctaattccccaaagattcatcattcagtagctccagctgttgccgtgaagaacaagacagagtctttctcctcttcatcatcaggtgacccagatgatttctttaagcataaaccggagaagaaactctctcaaatcagtcttctttccccaaacaatttggtcgatcgaagcaaagcggtttcacctaaaccgggaaaacaagaacagaacgggaagattgaagcaggcggcgaaactacactatatagtttcctaagctctccaagatcgtctggaaaagagagcagtgattactctaatgatgatgatgatgataaaaacaacaatgagattggagtagagctcgatcttgaatcagtaatgtctgacactttcgtctctgtcggtaaatacagagtgagatcgggatcgtccacaatcctaagcgctatcctcgagaaacacggagacattgctcaaaactgtaagctggaatcggactcaatgcggtcacgttacctcgagtgtctatgctcactgatgcaggaactcaggtcaacccctgtcgggcagttgacaaaagtcaaagtcaaagagatgctcgcagttctcaaagacttggagtctgtgaacatcgaagtggcttggctacgttcaattcttgaggagtttgcgaggtgtcaggaagatgtagagactgagaaagagcggcaagagagtttagtgaaggctaagagagaagagcttgaagctcaagaagcagacttggttcggaaggagaaggaagtcgccgaagcgaggttgcggattgaggagacgcgggccgtgatggtcgagatggagaaggaaaggtcaaggatggagaaaatgggattcaaaatggagaaatttaaagggaaatcgtttatagatgagcttctgtgagttttgtgttgtgtgattgtgatatgttgttaatagtaagtagagaagcataaagtcgaaatactctcaaatgagtttttaagttaggctttttaagtatatgggaaagctggttttaatcactaagggtgaaatgtttatttactagtaacgtgtaatggtgtttgaggtaattttgtcgttgctgataaatatatttggctttgtgatgcaaatgttctttcattttttttaattactttt

SEQ ID NO: 1423 - DNA, 1272 bp, Arabidopsis lyrata
atgggttgtgtttcttcgaaactaggaaagaagaaactcataagagagattagagtcaacaatggcggcgatcacattgtctcacttacttcaactacttatggtcatcttgatctcgatgaacgagcagagacttctcctaagtcactggaagttactaaaggagaggtctttgagtctgaaatcaaagcaagaagatcaatacagagagatgatccggagattatcaatacatgggagcttatggaagatcttgaagattcaatgcacgtttctaatccacagaagattagtcccaaatctcgtggtatttttggtaaatcatggaagactccggtgaaatcggttgttgaatctccgaagagaggaagtagtaagagatttggagggaaagagaacagaggaggtaataactcgagaggtgtgagtccgaatcagattctgaagcctaagaacattcttgaaactccgaagagaggagtgatgcgtttgagttttcctttgaaatctgaagaaccttcggtggtgattacgcagaggaggaagagttatagtccaatgtttgatccagatcttgtggcttcttacgagagagagttgtctcaagagcaagaacagatcaagatggtgatttctccggtggtgcatgagagcagaaaaacagagaaaacccgagaatcggagagaatccttgagaagttccctgagaaatgtccaccaggaggagagaactctgtggttatctacataacgactcttagagggataaggaagacgtttgaggattgcaatgtggtaagatcgatattagattcacacgaagttcgattctcggagagggatgtgtcgatgcactcggtttttaaggaagagatcaggggcattatgggaacgaaacatgtgaagataccggcggtattcgttaaagggaggatgttaggaagtgttgaggaagttatgaagttagaggaagagggcaaattggggattttacttgaaggtattcccgcggcgaggctaggaggcagttgctgccgtggatgtggaggaatgagatttgtgatgtgtgtggtttgcgatggaagctgcaaggttaggggagaagacaagaagagtatggttaagtgtttggagtgtaatgagaatggtttggttctatgtccaatttgttcttgaaaaggaaaattatctttatctttgttagagtttctaaagatgtgtttagggctcttggtgtgttacagtttaatggagtttgtttctgatgtttgt

SEQ ID NO: 1424 - DNA, 1341 bp, Eutrema halophilum
gagagagacagagagatgggttgtgtttcttcgaaactaggcaagaagaaactgataagagagattcgggtcaacaatggcggcgatcacattgtctccctcacttccactacttacggtcatctcgatctcgaaaaacgagcagagacttctcctacgttacaggaactcactaaaggcgatgtctttgaatcggaaatcaaaccccggagatctattacacagagagatgatccggagataatcaatacatgggagcttatggaggatctcgaagattcaatgcatccacagaggattagccccaaaagtcgtggcattttcgggaaatcatggaagactccggtgaaatcgatagtggaatctccgaagaggaatagtagtaagaggtttgtgggaaaagaaaacagaggagggaataactcgagaggtgtgagtccgaatcagattctcaagccgaggaacattctcgaaactcctaaaagaggagtaatgcgtttgagtttccctctcaaatccgaagaaccttcggtgcagaggaggaagagtttcagtccaatgttcgatccaaatctcgtggcttcttacgagagagagttgtctcaggagcaagagcagatcaagatggtgatttctccggtggtccgggagaccagaaaaaccgagaaaactatagaatcggagagaatcctcaagagtttcccggagaaatgtccaccgggaggagagaactcagtggttatatacataacatcgctgagagggataaggaagacgtttgaggattgcaatgcggtgagatcgatattagactcgcacgaagtccgattctcggagcgagatgtgtcgatgcactcggtttacaaggaagagatcaggggtattatgggaacaaaacaggtgaagataccggcggtgttcgtgaaaggtaggatgataggaagcgttgaggaagtggtgaggctagaggaggagggcaaattgggaattttactcgaatgtatgcccaaggcgaggctcggaggccgttgctgccgtggatgcggagggatgagattcgtgatgtgtgcggtctgcaatggaagctgcaaggtcatggaggaggagaagaagagtatggttaagtgtttggagtgtaatgagaacggtttggttatttgtccattttgctcttaaattaaaagtgacttttccattttcatttgactttgattgaatttgattgaaatggttaatacattttggttttgtaatggtttggtgagagagtttctaaagttgggattagggctcttaagtgtgtactacttagaacgaatggattcttgttttaatgtttgt

SEQ ID NO: 1425 - DNA, 1360 bp, Eutrema parvulum
agagaaagatgggttgtgtctcttcgaaattagtcaagaagaaactgataagagagattcgagtcaacaatggcggcaatcacattgtgtctcttacttctactacttacggtcatctcgatctcgacgaacgagcagagacttgtccaaagttacaggaacccactaaaggcgatgatgtccctgattccgacatcatcaaacccaggagatctactacacagagagatgatccagagataatcaatacatgggagcttatggaagatctcgaagattcaatgcatccacagaggattagccccaaatctcgaggtatcttcggtaaatcgtggaagacgccggtgaaatcgattgttgaatctccgaagaggaatagtagtagtaagagatttggaggaaaagaaaacagaggagggaatcactcgagaggtgtgagtccgaaccagattctgaagccgaagaacattctagagactccaaagagaggagtaatgcgtttgagtttccctctcaaatccgaggaaccttcggtggtgattacgcagaggaggaagagtttcagccccatgttcgatccagatctcgtggcttcttacgagagagagttatctcaagagaaagagcagatcaagatggtgatctctccggcccccgagactcggaaacatgagaaacaccgagaatcggagagaatcctcgagaatttcccggagaaatgtccaccgggaggaggaaactcagtggtcatctacataacatcgctgagagggataaggaagacgtttgaggattgcaatgcggtaagatcgatattagattcgcatgaagttggattctcggagcgagatgtgtcgatgcactcggtttttaaggaggagatcaggagcatcatgggaacgaaacaggtgaaaataccggcggttttcgtcaaagggaggatgataggaagcgttgaggaagtgatgaggttagaggaagagggcaaattgggaattttacttaaatgtatgcctaaggcgaggctcggaggcggtgcctgtcggggatgcggcggcctgagatttgtgatgtgtgctgtttgcaatggaagctgcaaggttatggatgcggagaagaagaacactgttaagtgtttggactgtaatgagaatggtttggttctctgtccaatttgctctttaaattttttttttttgagtttttgccctaattgattaattttttagtgtaactttgcatttgagggggctggttttggttttggttttgtaatgatttgggtgagaggttttataaaacttgggtttaggtttattgttggtgtgtactagcaattcaatctgtttttaatgtttgt

SEQ ID NO: 1426 - DNA, 1344 bp, Eutrema parvulum
aaaacataaagatcagggtcttccgacaaaagtcccatcgatccacttcaaacacttccacgatgtccgttcgaaaatatgaccgttgaaagtaattaaattcaaaaataataaaagaataaaaactaaataactcccttcctcttctacttcaatctctctgttttccctcagtaaaactcgcgagagagaaagatgggttgtgtctcttcgaaattagtcaagaagaaactgataagagagattcgagtcaacaatggcggcaatcacattgtgtctcttacttctactacttacggtcatctcgatctcgacgaacgagcagagacttgtccaaagttacaggaacccactaaaggcgatgatgtccctgattccgacatcatcaaacccaggagatctactacacagagagatgatccagagataatcaatacatgggagcttatggaagatctcgaagattcaatgcatccacagaggattagccccaaatctcgaggtatcttcggtaaatcgtggaagacgccggtgaaatcgattgttgaatctccgaagaggaatagtagtagtaagagatttggaggaaaagaaaacagaggagggaatcactcgagaggtgtgagtccgaaccagatttccaaagagaggagtaatgcgtttgagtttccctctcaaatccgaggaaccttcggtggtgattacgcagaggaggaagagtttcagccccatgttcgatccagatctcgtggcttcttacgagagagagttatctcaagagaaagagcagatcaagatggtgatatgagaaacaccgagaatcggagagaatcctcgagaatttcccggagaaatgtccaccgggaggaggaaactcagtggtcatctacataacatcgctgagagggataaggaagacgtttgaggattgcaatgcggtaagatcgatattagattcgcatgaagttggattctcggagcgagatgtgtcgatgcactcggtttttaaggaggagatcaggagcatcatgggaacgaaacaggtgaaaataccggcggttttcgtcaaagggaggatgataggaagcgttgaggaagtgatgaggttagaggaagagggcaaattgggaattttacttaaatgtatgcctaaggcgaggctcggaggcggtgcctgtcggggatgcggcggcctgagatttgtgatgtgtgctgtttgcaatggaagctgcaaggttatggatgcggagaagaagaacactgttaagtgtttggactgtaatgagaatggtttggttctctgtccaatttgctctttaaattttttttttttgagtttttgcc

SEQ ID NO: 1427 - DNA, 5082 bp, Brassica napus
aagagattcctccttacaatggcgatgaaatctctttcccctgtccctaagcttcttctctccacaacaccaagctctgttctctcttccgacaagaacttcttcttcgtcgacttcgtcggactttactgcaagtccaagagaaccagacgcagacttcgtggagactcttcctcctctacctcacgcgcctctcctctctctcgtctctcctctgttcgtgccgtcatcgacttagaacgcgtccatgacaaagatctcgcttctccttcctacttaaaacctcaggttgctaacttggaagatatattgtccgagagaggagcttgtggtgtcgggtttatagcaaacttagataacattccttcacatggagtcgtcaaggatgctcttattgctctcgggtgtatggaacatcgtggagggtgtggagctgacaatgattctggtgatggctctggtcttatgtcttccatcccttgggacttctttaacgtgtgggccaaggaacagggccttgctccctttgataagttgcatactggtgttggaatgatctttcttccacaagaagataccttcatgcaagaagccaaacaagttattgaaaatatatttgagaaagaaggcttagaggttcttgggtggagagatgttcctgtgaatgctcccatagttggtaagaacgctagagagacaatgcctaacatacagcaagtgtttgtgaagatagcaaaggatgatagtactgatgacattgaaagggagctttacatctgtcggaagttgattgaaagagcagtggctgctgagacttggggaactgaactctatttttgttcactgtccaatcaaactatagtgtacaagggcatgcttagatctgaagctcttggactgttttatctagaccttcagaatgagttgtacacgtctccctttgctatttatcatagaaggtacagcacaaacactagtcccaggtggcctcttgctcagcctatgaggtttcttggacataacggggagatcaacaccatacaggggaacttaaactggatgcagtctagagaagcttctttgaagtcttctgtttggaatggccgtgaaaatgagattcgtccatttggtaatcccagaggttcagactctgccaaccttgatagtgctgcggaaatattaataagaagtggcagaacaccagaggaggctctaatgattcttgtccctgaggcatacaaaaaccatccaactttatctatcaaatatcctgaggttctagacttttatgactactacaaaggacaaatggaggcttgggatggtcctgcattactattgttcagtgatggaaaaacagttggggcttgtcttgaccgcaatggccttcgtcctgctcgttattggaggactagtgacaatttcgtctatgttgcatctgaggtcggagtagtaccagttgatgaggcgaaagtcaccatgaaagggcgtctaggacctggaatgatgattgctgctgacctagtgaatggccaggtatatgagaacacagaggtcaagaagcgagtatcttcactgaatccatacggaaagtggatcaaagaaaacctccggttcttgaagcctgtcaatttcaaatcctcaactgtcatggaaaatgaagaaatcttaagaacccaacaggcatttggttactcaagtgaggatgtgcaaatggtcattgagtctatggcctcccaaggaaaggaaccaaccttctgcatgggtgatgatattccactggcaggactgtctcaaaggccacacatgctttacgattacttcaagcaaagatttgctcaggttacaaaccctgccattgatccccttagggaaggcttggttatgtctcttgaagtaaacatcggcaaacgtgggaacatactggagcttgggcctgagaacgcctcccaggtcattctttcaaaccctgtgttgaacgaaggagggattgaagagttgatgaaggatacatacttgaaacccaaggttctgtccacgtttttcgatataagaaaaggtgttgaaggctccttgcaaaaggctctttattatctttgtgaagcagctgatgatgctgtccggagtggctctcagctgcttatactttcagaccgaaccgatagcctggaaccgacccggcctgcaattcctataatgttagccgttggagctgttcatcaacatcttattcagaatggcttgaggatgtcagcttccattgttgctgatacggctcagtgcttcagcacacatcagtttgcttgtttgattggatatggtgcaagtgctgtatgcccatacttggcactggagacatgtagacaatggcgtttaagtaacaaaactgtggccttaatgcgtaacggtaaaattcccactgtaaccattgaacaagctcagaagaattataccaaggcggttaatgcagggcttcttaaaatcttgtccaagatgggcatctcattgctttcaagttattgtggtgctcagatttttgagatatatggtttggggcaggatgttgttgatcttgcattcactggtagtgtgtctaaaatcagtggactcacctttgatgagttggcaagggagacactgtctttctgggtgaaggccttttctgaggatacaactaagagactagaaaacttcgggttcattcaatttagacctggaggtgagtatcattcaaacaacccggagatgtcaaagttgctccacaaggccgtccgtgaaaagagtgaaactgcatatgctgtctatcaacagcatctcgctaaccgacctgttaatgtcctacgtgatctacttgagttcaagagtgaccgtgcacccatcccagtggggaaagtagagcctgctgtctctatagttcagagattctgtactggtggaatgtcacttggtgctatctcaagagaaactcatgaagctattgctattgccatgaataggattggtggcaaatcaaactctggagaaggtggagaggatcctatccgttggaagccgcttacggatgtggttgatggatactcaccaacactaccacatctcaaaggtcttcaaaatggggacattgcaacaagtgctatcaagcaggttgcttcagggcgttttggagtcacaccaacgttcttggtgaatgcagatcagctggagatcaaagttgcacaaggtgctaagcctggggaaggtggtcagcttcctggaaagaaagtcagtgcttatatagcaaggctaagaagctctaagcctggtgttcctcttatatctccacctcctcaccatgacatttactccatagaggatctcgctcagctgatctttgatctgcatcagatcaatccaaatgcaaaagtatcagtcaagctggtagcagaagctggaattggaacagttgcttctggtgttgcaaagggtaacgctgatattatccagatatcagggcatgatggtggaactggtgctagtccaataagctccattaaacacgctggtggtccatgggagcttggactaactgaaactaaccaaactcttattgagaatgggcttagggagagagtcattttaagagtagatggaggcttaaagagtggtgttgatgtactaatggctgcagcaatgggtgctgatgaatacggatttggttctttggcaatgattgctactggctgtgtcatggctcgtatttgccacactaataactgcccagtgggtgtggcaagtcagagagaagaactgcgtgcaagattccccggtgtgcctggtgatctagtcaactacttcttatacgtagcagaagaggtgaggggtatcttggctcagttaggatacagcaagttagatgacatcattggacgaaccgagttactgaaaccacgagacatttcgctagtgaaaactcagcatctcgacctgagctaccttctctcgtctgttggagtaccttcaatgagcagtactgagatcagaaagcaggaggttcacacaaacggacctgttctcgatgatgatattcttgacgatccattggtgaaagatgctatagagaacgaaaaagtggttgataaaaccgtaaagatatgcaacatagaccgtgctgcttgtggtcgcgttgctggtgtcatcgcaaagaaatatggagacactggttttgctggacaagtgaacctaaccttccttgggagtgcgggacagtcctttggatgcttcttgattcccggtatgaacatcagactcgtaggagaggccaatgactacgtaggaaagggaatggctggtggggagatagtagtaactcctgtggataaaattgggtttgtgcctgaggaagcaaccatagttgggaacacttgcttgtacggtgcaacggggggtcagatattcgctagaggcaaagctggggagaggtttgcggttagaaactcactcgctgaggcagtggttgaaggcactggggaccattgctgtgagtacatgactggtggctgtgtcgtcgtgcttggaaaagtgggaagaaatgtagctgcaggtatgacaggagggttagcttatcttcttgatgaagacgacactcttcttcccaagattaaccgagagatagtgaagatccagagagtaactgcacctgcaggggagttgcagctcaagagcttaatcgaagcccatgtggaaaaaaccggaagcagcaaaggagagacgatcctgaaggaatgggaaaagtatctacctctcttctggcagcttgttccaccgagcgaggaagacactcctgaagcttctgctgcttatgtaagaacagccaccggtgaagtcacattccaatcggcatagaggagaggtcatcatcaatcaccattcaaacatgttgcagttggaaacagaaggattgatacatcaatggtgtcattcatagatcatcaatgtgtggagacaatattcttaattgtcctgtgatctttaacagtaccatcatgattgctatagatgtacagtttattcagttaaataactgaattcaactgccatgaaaaa

SEQ ID NO: 1428 - DNA, 5313 bp, Eutrema parvulum
gaaaaagaaaaagaaaggaagaaagagagagaagaagaagaagaggctcaagtaagctctcatcactcatctgttatcttcctcttcttcttcttcgtcttcttatttatcttttatattttatttatggttttaatgtcaaacccatttatcttattttccacacacgcctctcattttttctttcaatggcgatgaaatctctttcccctgttcctaagcttctctccacaacaccaagctctgttctttcttccgataagaacttcttcttcgtcgatttcgttggattgtactgtaagtccaagaggaccagacgcagacttcgtggagattcttcctcctcctctaactctcgcgcttctcctctgtctcgtctatcctctgttcgtgccgttatcgacctcgaacgcgttaatggcgtttccgacaaagatctcgcttctccctcctacttaaaacctcaggttgctaatttggaggatatattatctgagagaggagcttgtggcgttgggtttatagccaacttagataacattccttcacatggagtcgtcaaggatgctcttattgctcttgggtgtatggaacatcgtggaggctgtggagcagacaatgattctggtgatggctctggtcttatgtcttccattccgtgggattattttaacgtctgggccaaggaacagggccttgctccctttgataagttgcatacgggtgttggaatgatctttctcccacaagatgatacctttatgcaagaagccaaacaagttattgaaaacatatttgagaaagaaggattacaggttcttgggtggagagaagttcctgtaaatgctcccatagttggtaaaaacgctagagagacaatgcctaacatacaacaagtgtttgtgaaaatcgcaaaggacgatagtacggatgatattgaaagggaactgtacatctgccggaaattaatcgaaagggcagtggttactgagagttggggaaatgagctctatttctgttcattgtccaatcaaactatagtgtacaagggcatgcttcgatccgaggttcttggactgttttatctggaccttcaaaatgagctctatacgtctccttttgctatttatcatcgacggtacagcacaaacactagtcccaggtggcctcttgctcaaccaatgaggtttcttggacataacggggagatcaataccatacaggggaacttaaactggatgcagtctcgagaagcttctttgaagtcttctgtttggaatggccgtgaaaatgaaatccgcccattcggtaaccccaggggttcagactccgcaaatcttgatagtgctgcagaaatattaataagaagtggccgaactccagaggaagctctaatgattcttgtccctgaggcatacaaaaatcatccaactttatctatcaaatatcctgagattattgatttttatgactactacaaaggacaaatggaggcttgggatggtcctgcattacttttgttcagtgatggaaaaacagttggggcttgtcttgaccgcaatgggcttcgtcctgctcgatattggcggaccagtgacaatgttgtctatgttgcatctgaggtcggagtagtaccagttgatgaggccaaagtcaccatgaaaggccgtctaggacctgggatgatgattgctgttgacctagtgaacggccaggtatatgagaatacagaggtcaagaagcgaatatcttcattcaatccatatggaaagtggataaaagaaaaccttcggttcttgaagcctgtgaatttcaaatcctcaactgtcatggaaaatgaagaaatcctaagaacccaacaggcatttggttattcaagtgaggatgtgcaaatggttattgagtctatggcttcccaaggaaaggaaccaaccttctgcatgggcgatgatattccactggcaggactgtctcaaaggccacacatgctttacgattatttcaagcaaagatttgcgcaggttacaaaccctgccattgatccccttagggaaggtttggttatgtctcttgaagtaaatataggaaaacgtggaaatatattggagcttgggcctgagaatgcctcacaggttattcttccaaaccctatgttaaatgaaggagggattgaggagttaatgaaggatacatacttgaaacccaaggttctgtctacatttttcgatataagaaaaggagttgaaggttccttgcaaaaggctctgtattatctttgtgaagcagctgatgatgctgtccgaagtggctctcagctgctcattctttcagacagatctgataaactggaaccgacccggcctgcaattccgataatgttagctgttggcgctgtccatcaacatcttattcagaatggcttgcggatgtcagcttccattgttgctgatacggcacagtgcttcagcacgcatcaatttgcttgtttgattggatatggtgcaagtgctgtatgcccatacttggcactggagacatgtagacaatggcgcttaagtaccaaaactgtggccttaatgcggaacgggaaaattcccactgtaaccattgagcaagctcagaagaattataccaaggcggttaatgcagggcttcttaaaattttgtctaagatgggcatctcattgctttcaagttattgcggtgctcagatttttgaaatatatggtttggggaaggagattgttgatcttgcattcaccggaagtgtatcgaaaatcagtggactcacctttgatgagttggcacgagagacattgtctttctgggtgaaggccttttctgaggatacaactaagagattagaaaatttcgggtttattcaatttaggcctggaggggagtatcattcaaacaacccagagatgacaaagttgctccacaaggctgtccgtgaaaagagtgaaactgcatatgctgtctatcaacagcatctcgctaaccgacctgttaatgtcctccgtgatctccttgagttcaagagtgatcgtgcaccgatcccagtcgggaaagtcgaaccggctgtatctattgttcagagattttgtactggtggaatgtcacttggtgctatttcaagagaaactcatgaagcaattgctattgcaatgaataggattggtggcaaatcaaactccggagaaggtggagaggatcctatccgctggaagccgcttacagatgtggttgatggatattcaccaacattaccacatctcaaaggtcttcaaaatggggatattgcaacgagtgctatcaagcaggttgcttcagggcgttttggtgtcacaccaacattcttggtgaatgcagatcaattggaaatcaaagttgcacaaggtgccaaacctggggaaggtggtcagcttcctggaaagaaagtcagtgcatatatcgcaaggctaagaagctctaaacctggtgttcctcttatatccccacctcctcaccacgacatttactctatagaggaccttgctcagttgatctttgatctacatcagattaatccaaacgcaaaagtatcagtcaagctggtcgcagaagctggaataggaacagttgcttctggagttgcaaagggtaacgctgatattatccagatatcagggcatgatggtggaaccggtgctagtccaataagctccataaaacatgctggaggaccatgggaacttggactaacagaaacccaccaaactcttatcgaaaatggactcagagaaagagtcattttaagagtcgatggaggcttaaagagtggtgttgatgttctcatggctgcagctatgggtgctgatgaatacggatttggttctttggcaatgattgctactggctgtgttatggctcgtatttgccacaccaataattgcccagtgggtgttgccagtcagagagaagaattgcgtgcgagattccctggtgtgcctggtgatcttgtcaattacttcttatacgtagcagaagaggtgagaggtatcttagcgcagttaggatacaacaagttggatgacattattggacgaacagagttacttagaccacgggacatttcgctagttaaaactcagcatctcgatctgagttatcttctttcgtctgctggaataccttcaatgagcagtactgaaatcaggaagcaggctgttcatacaaatggccctgttctcgatgacgatattcttgaagatccattggtgatggatgctatagagaatgaaaaagtggttgagaaaaccgtcaaaatatgcaacatagaccgtgccgcttgtggtcgcattgctggggtcatcgcaaagaagtatggagacactggttttgccggacaagtgaatctaactttccttgggagcgcaggacagtcctttgcctgctttttgattcccggtatgaatatccggctcataggagaggcaaatgactacgtaggaaagggaatggctggtggtgaagtagtagtaactcctgtggagaaaatcgggtttgtgcccgaggaagcaaccatagtcgggaacacttgcttgtatggtgcaacgggcggtcagatattcgctagagggagagctggagagagatttgcagtgagaaactcactcgctgaagcagtagttgaaggcactggagaccattgctgtgagtacatgactggtggctgtgtcgtcgtgcttggaaaagtgggaagaaacgtagcagcaggtatgacaggagggttagcatatcttcttgacgaagacgacactcttcttcctaagattaaccgagagatagtgaagatccagagagtaactgctcctgcaggggaatttcagctgaagagcttaatcgaagcccatgtcgaaaaaaccggaagcagcaaaggcgagacgattctgaaggattgggacaagtatctacctctcttctggcaactggttccaccgagcgaggaagacactcccgaagcttctgctgcttatgtcagaacagccaccggtgaagtcacgtttcaatcggcatagaggaagtcatcatcctcaccattcaagcatgttgcagttgaaacagaaggattgatacatatggtggactatgaagcgcaaatcgagaatcattatcattcatagatcaatgtgtgggacaatattcttaatttgtcctgtgatcttcacagtatcatgattgctataactgtacagttattcagttaaataactgcattcaatagccataaaatccaccccataactttgcatattctcttcattgaataaa

SEQ ID NO: 1429 - DNA, 5311 bp, Eutrema halophilum
gaaaaaggaaaaagaaagacagagagagagaagaagaggctcaagtaagctctcatcactcatctgttatcttcctcttcttcctcttcgtcttcttattttctttccttttattccccatttatcttatttttaattttatttttatggttttaatgttaaacccatttatcttattttccacacacgcctctcatttttcctttcaatggcgatgaaatctctttcccctgttcctaagattctctccacaacaccaagctctgttctttcttcagacaagaacttcttcttcgtagatttcgttggactctactgtaagtccaagagaaccagacgcagacttcgtggagattcttcctctaactcacgcgcttcttctctgtctcgactatcctctgttcgtgccgttctcgacctcgaacgcgttaatggcgtatctgacaaagatctaccttctccctcctttttaaaacctcaggttgcgaatttggaggagatattgtcagagagaggagcttgtggagttgggtttatagccaacttagataacattccttcacatggagtggtcaaggatgctcttatcgctctcgggtgcatggagcatcgaggaggctgcggagcagacaatgattctggtgatggctctggtcttatgtcttccattccctgggatttctttaacgtctgggccaaggaacagggcctttctccctttgataagttgcacactggtgttggaatgatctttcttccacaagaggagacctttatgcaagaagctaaacaagttattgaaaacatatttgagaaggaaggattacaagttcttgggtggagggaagttcctgtgaatgctcctgtagttggtagaaacgctaaagagacaatgcctaacatacagcaagtgtttgtgaaaatcgcaaaggaagacagtacggatgacattgagagggaactctacatctgccggaaattgatcgagagggcagtggctactgagagttggggaagtgagctctatttctgctcactctccaaccaaaccatagtgtacaagggcatgcttcgatccgcagttcttggattgttttatctagaccttcagaatgagctttatacctctccctttgctatttatcatcggaggtacagcacaaacactagtcccaggtggcctcttgctcaaccaatgaggtttcttggacataacggggagatcaataccatacaggggaatttaaattggatgcagtctcgagaagcttctttgaagtcttctgtttggaatggccgtgaaaatgaaattcgcccattcggtaatcccaggggttcagactctgccaaccttgatagtgctgcagaaatattaataagaagtggccgaactccagaggaagctctaatgattcttgtccctgaggcatacaaaaatcatccaaccttatctatcaaatatcctgaggttgtagatttttatgactactacaaaggacaaatggaggcttgggatggtcctgcattacttttgttcagtgatggaaaaacagttggggcttgtcttgatcgcaacgggcttcgtcctgctcggtattggcggacaagtgacaatgtcgtctatgttgcatccgaggtcggagtagtaccagttgatgaggcgaaagtcaccatgaaaggccgtctaggacctggaatgatgattgctgttgacttagtgaatggccaggtatatgagaatacagaggtcaagaagagaatatcttcatttaatccatatggaaagtggattaaagaaaacctccgattcttgaagcctgtgaatttcaaatcttcaactatcatggaaaatgaagaaattctaagaactcagcaggcgttcggttattcaagtgaggatgtgcaaatggttattgagtctatggcttcccaaggaaaggaaccaaccttctgcatgggcgatgatattccgctggcaggattgtctcaaaggccacacatgctttacgattattttaagcaaagatttgcgcaggttacaaaccctgccattgatccccttagggaaggcttggttatgtctcttgaagtaaatattggaaaacgtggaaatatattggagcttgggcctgagaatgcctcgcaggttattctgtcaaaccctgtgttaaatgaaggagggattgaggagttaatgaaggatccttacttgaaacccaaggttctttccacatttttcgatataagaaaaggagttgaaggttccttgcaaaaggctctgtattatctttgtgaagcagctgatgatgctgtccgaagtggctctcagctgctcattctttcagaccgatctgataatctggaaccgacccgtcctgcgattccgataatgttagctgttggagccgtccatcaacatcttatacagaacggcttgcggatgtctgcttccattgttgctgataccgcccagtgcttcagcacgcatcactttgcttgtttgattggatacggtgcaagtgctgtatgcccatacttggcactggagacatgtagacaatggcgcttaagtaacaaaactgtggccttaatgcgtaacgggaagattcccactgtaaccattgagcaggctcagaagaattacactaaggcggttaatgcggggcttcttaaaattttgtctaagatgggcatctcattgctctcaagttattgcggtgctcagatatttgagatatatggtttggggaaggaggttgttgattttgcattcactggaagtgtgtcgaaaatcagtggactcacctttgatgagttggctagggagacattgtctttctgggttaaggccttttctgaggatacaactaagcgattagaaaattttgggtttattcaatttagacctggaggggagtatcattcaaacaacccagagatgtcaaagttgctccacaaggctgtccgtgaaaagagtgaaactgcctatgcggtctatcaacaacatctcgctaaccgaccggttaatgtcctccgagatctccttgagttcaagagtgatcgtgcaccgattccagtgggaaaagtcgaaccagccgtttctattgttcagagattttgtactggtggaatgtcacttggtgctatttcaagagaaactcacgaagcaattgctattgccatgaatagaatcggtgggaaatcaaactctggagaaggtggagaggatcctatccgctggaagcatctcacagatgtggttgatggatattcaccaacattaccacatctcaaaggtcttcaaaacggtgacattgcaacgagtgctatcaagcaggttgcttcaggacgttttggagtcacaccaacattcttggtcaatgcagatcaattagaaatcaaagttgcacaaggtgccaagcctggagaaggtggtcagcttcctggaaagaaagtgagtgcgtatatcgcaaggctaagaagttctaaacctggtgttcctcttatatccccacctcctcaccacgacatttactcgatagaggatcttgctcagctgatctatgatctacatcagattaatccaaatgcaaaagtatcagtcaagctggtcgcagaagctggaatcggaacagttgcttctggagttgcaaagggtaacgctgatattatccagatatcagggcatgatggtggaaccggtgctagtccaattagctccattaaacatgctggtgggccgtgggaacttggactaacagaaactcaccaaactcttatcgaaaatgggctcagagaaagagtcattttaagagttgatggaggcttaaagagtggcgttgatgtcctaatggccgcagctatgggtgctgatgaatacggatttggttctttggcaatgattgctactggctgtgttatggctcgtatttgccacactaataattgcccagtgggtgtggcaagtcagagagaagaattgcgtgctagattccctggtgtgcctggtgatcttgtcaatttcttcttatatgtagcagaagaggtgagaggtatcttagcagagttaggatacagcaagttagatgacatcattggacgaacagagttactgagaccacgagacatttcgctagtgaaaactcagcatctcgatcttagttatcttctttcgtctgctggactaccttcaatgagcagtactgaaatcaggaagcaggatgttcattcaaatggacctgttctcgatgacgagattcttgaagatccattggtgatggatgcgatagagaacgaaaaagtggttgataaaaccgttaaaatatgcaacatagaccgtgcggcttgtggtcgtgttgctggggtcatcgcaaagaagtatggagacactggttttgccggacaagtgaatctaaccttccttgggagcgcaggacagtcctttgcgtgcttcttgattcccggtatgaatatccggctcataggagaggcaaatgactacgtaggaaagggaatggctggtggtgaagtagtagtaactcctgtggacaaaatcgggtttgtgcccgaggaagcaaccatagttgggaacacttgcttgtatggtgcaacaggcggtcagatattcgcgagaggcaaagctggagagagatttgcagtgagaaactcactcgctgaagcagtagtggaaggcactggggaccattgctgtgagtacatgactggtggctgtgtcgtcgtgcttggaaaagtgggaagaaacgttgctgcaggtatgacgggagggttagcttatcttcttgatgaagacgacactcttcttcccaagattaaccgagagatagtgaagatccagagagtaactgcacctgcaggggaattgcagcttaagagcttaatcgaagcccatgtcgaaaaaactggaagcagcaaaggtgaagcgattctgaaggagtgggacaagtatctacctatgttctggcaactagttccaccgagcgaggaagacactcctgaagcttctgcttcttatgtaagaacagccaccggtgaagtcacatttcagtcggcatagagatcatcatcatcatccaagcatttttcagttggaaacagaaggattggtacatcaatggtggactatggaggggcaaatcgagaatcacttgatcaatgtgtgggacatatattctgattgtccagtgatctttacagtaccatgattgctataactgtacagttattcagttaaataactgcattcaactgccatgatatttacataaattccatatactctttattgaataaa

SEQ ID NO: 1430 - DNA, 5212 bp, Arabidopsis lyrata
aaaggaaagaaagagagaagaagaagctctcatcactcatctgttatcttcctcctcttcttcttcttcctcttcttttttttttttctttctttcttacatttatctttatttattttattttttagtgtgcatttatcttattttccacacacgcctctcattttttttcatttcaatggcgatgaaatctctttcccctattcctaagcttctctccacaacaccaagctctgttctttcttctgacaagaacttcttcttcgtcgatttcgttggattatactgtaagtccaagagaaccagacgcagacttcgtggcgattcctcctcaggctcttcttcttcttctctctctcgtctttcctctgttcgtgctgttatcgaccttgaacgtcttaatggcgtctctcacaaagatctctcttctacttcactcttaaaacctcaggttgctaatttggaggacatattgtctgaaagaggagcttgtggagttgggtttatagcaaacttagataacataccttcacatggagttgtcaaagatgctcttattgctcttggttgtatggaacatcgtggaggttgtggagctgacaatgattctggtgatggctctggtcttatgtcttccattccttgggatttctttaacgtctgggccaaggaacaaggtctttctccttttgataagttgcatactggtgttggcatgatctttcttccacaagaggatacctttatgcaagaagccaaacaagttattgaaaacatatttgagaaagaaggattacaagttcttggttggagggaagttcctgtgaatgttcctatagttggtaaaaatgctagggaaacaatgcctaacattcaacaagtgtttgtcaaaatcgcaaaggaagatagtacggatgacattgaaagggaactttacatatgccgtaaactaatcgaaagggcggtggctactgagagttggggaacagagctatacttctgttcactgtccaatcaaaccatagtgtacaagggcatgcttcggtccgaggctcttggattgttttatctagatcttcagaatgagctttatgagtctccctttgctatttatcatcgaaggtacagtacaaacactagtcctaggtggcctcttgctcaaccaatgaggtttcttggacataacggagagatcaataccatacaggggaacttaaattggatgcagtctcgagaagcttctttgaagtcctctgtttggaatggccgtgaaaatgaaattcgtccatttggtaatcccagaggttcagactctgctaatcttgatagtgctgcagaaatcttgattagaagtggccgaactccagaggaggctctaatgattcttgtccctgaggcatacaaaaatcatccaaccttatctgtcaaatatcctgaggttatagatttctatgactactacaaaggacaaatggaggcttgggatggtcctgccttacttttgttcagtgatggaaaaacagttggggcttgtcttgaccgtaatggccttcgtcctgctcgatattggcggactagtgacaatgtcgtctatgtagcatctgaggtcggagttgtaccagttgatgaggcaaaagtcacgatgaaaggccgtctaggacctggaatgatgattgctgttgacctagtgaatggccaggtatatgagaatacagaggtcaagaagagaatatcttcatttaatccatatggaaaatggattaaagaaaactcccggttcttgaagcctgtgaatttcaaatcctcaactgtcatggaaaatgaagaaatcttaagaagccaacaggcatttggttattcaagtgaggatgtgcaaatggttattgagtctatggcttctcaaggaaaggaaccaaccttctgcatgggcgacgatattccgctggcaggattgtctcaaagaccacatatgctttacgattatttcaaacaaagatttgcgcaggttacaaaccctgccattgatccccttagggaaggtttggttatgtctcttgaagtaaatattggaaaacgtggaaatatattggagcttgggcctgagaatgcctcacaggttattctgtctaaccctgtgttaaacgaaggaacgttggaggagttaatgaaggatacatacttaaaacctaaggttctgtccacatatttcgatatacgaaaaggcgttgaaggttccttgcaaaaggctctatattctctttgtgaagcagctgatgatgctgtccgaagtggctctcagcttctcgttctttcagaccgatccgatagcctggaaccaacccgccctgcaattccgataatgttagctgttggcgctgtccatcaacatcttattcagaacgtatcttttgtttgctctgaattttctaaatttgtccctgccaatgctgtatgcccatacttggcactggagacatgtaggcaatggcgcttaagtaacaaaactgtcgcattcatgcgtaacgggaaaattcccactgtaaccattgagcaagctcagaaaaactacaccaaggcggttaatgcagggcttcttaaaattctttctaagatgggcatctcattgctttcaagttattgtggtgctcagatatttgagatctatggtttggggaaagaggttgttgatcttgcattcactggaagtgtgtcaaaaatcagtggactcacctttgatgagttggcaagagagacattgtctttttgggtgaaggccttttctgaggatacaactaaacgattagaaaatttcgggtttattcaatttaggcctggaggtgagtatcattcaaacaacccagagatgtcaaagttgctccacaaggctgtccgtgaaaagagtgaaactgcatatgcagtctatcaacaacatctctctaacagacctgttaatgtcctccgtgatctccttgagttcaagagtgaccgtgcaccgatcccagtagggaaagttgaaccagccgtttccattgtccagagattttgtactggtggaatgtcacttggtgctatttcaagagagactcatgaagctattgctattgctatgaataggattggtggtaaatcaaactctggagaaggtggagaggatcctatccgttggaagccacttacagatgtggttgatgggtattcatcaacattaccacatctcaaaggtcttcaaaacggtgatatcgcaacaagtgctatcaagcaggttgcttcaggacgttttggagtcacaccaacattcttggtcaatgcagaccaattggaaatcaaagttgcacaaggtgccaagcctggggaaggtggtcagcttcctggaaagaaagttagtgcatatatcgcaaggctaagaagctctaaacctggtgttccgcttatatccccgcctcctcaccacgacatttactctattgaggatcttgctcagttgatctttgatctacatcagattaatcctaacgcaaaagtatcagtcaagctggtcgcagaagctggaatcggaacagttgcttctggagttgcaaagggtaacgctgatatcattcagatatcagggcatgatggtggaactggtgctagtccaataagctccataaaacatgctggtggaccatgggaacttggactaacagaaactcaccaaactcttatcgaaaatggactcagagaaagagtcattttaagagtcgatggaggcttaaagagtggtgttgatgttctaatggctgcagctatgggtgctgatgaatacggatttggttccttggcaatgattgctactggttgtgttatggctcgtatttgccacactaataactgcccagtgggtgtagcaagtcagagagaagaattacgtgcaagattccccggtgtgcctggtgatcttgtcaattacttcttatacgtagcagaagaggtgagaggtatcttagcacagttgggatacagcaagttagatgacatcattggacgaacagagttactgaaaccacgagacatttcgttagtgaaaactcagcatctcgatctgagttatcttctttcgtctgttggaacaccttcattgagcagtactgaaatcagaaagcaggaagttcatacaaatggacctgttctcgacgacgatattcttgcagatccattggtgattgatgcaatagagaacgaaaaggtggttgataaaaccgtcaaaatatgcaacgtagaccgtgccgtttgtggtcgcgttgctggtgttattgcaaagaagtatggagacactggttttgcaggacaagtgaatctgactttccttgggagcgcgggacagtcctttgggtgctttttgattcccggtatgaacatccggctaataggagagtcaaatgactacgttggaaagggaatggctggtggtgaaatagtagtaactcctgtggacacaatcgggtttgtgcccgaggaagcaacgatagtcgggaacacttgcttgtatggtgccacaggcggtcagatatttgctagaggcaaagctggagagagatttgcagtgagaaactcactagctgaagcagtagttgaaggcaccggagaccattgctgtgagtacatgactggtggctgtgtcgtcgtgcttggaaaggtgggaagaaacgttgctgcgggtatgactggaggcttagcttaccttcttgatgaagatgacactcttctccctaagattaaccgagagatagtgaagatgcaaagagtaactgcgcctgcaggggaattgcagctgaagagcttaattgaagcacatgtcgaaaaaaccggaagcagcaaaggcgcaacgattctgaatgaatgggacaagtatctacctctcttctggcaactggttccaccgagtgaagaagacactcctgaagcttctgctgcatatgtaagaacagccaccggagaagtcacatttcaatcggcataaagatcattcaagagaaggttgttgcagttgaaacacaaggattgatatacatacatcaatggtggactatggagggcaaatggaaaatcattatcatttcatagatcaaatgtgtgggacaatattcttattgtcttgtgatctttacaacaataccatggttgctataactgtacagtaaattcagtaaaataactgctttcaactgtcata

SEQ ID NO: 1431 - DNA, 5548 bp, Citrus sinensis
cactttctcttcaaccaaacatggccttgcaatcatcaatctcacccgtcattgctcatctcagcgctgctacaaagccgagttcggttctttcatcaaacaaaaacttgctctttgttgattttgtcggtctctattgtcaatccaacagaatcagacggagaatcggcgtttcttgtaatcaaacagtattttctcgtttgttgaataagaaaacatcgtcgtctgttaaagctgtacatgatcttgagcgcaccacttctgctcctcaatctgattccaaaccaaaggttgccaacttggaggacataatttcagaaagaggagcatgcggagttggttttattgcccatttggaaaacaaagcatcttatgaaattgttaaggatgctcttacagctcttggctgcatggaacatcgtgggggctgtggagcagataatgattctggtgatggttcaggattgatgacttcaattccatgggatctttttaacaattgggctgaaaatgaagggattgcttcctttgataagttgcacactggtgtgggaatggttttctttcccaaagatgatgatcttatgaagaaagccaaagaagttattgtaaatacttttagacaagagggccttgaggtgcttggatggaggcctgttcctgtgaatacatctgtagttggttattacgcaaaagaaacaatgcccaatatacagcaggtgtttgttaaagttgttaaagaagagagcgttgatgacattgaacgcgaactgtacatctgccggaaattgatagaaagagcagcagcgttggaaagttgcgggaatgagctttatttctgctctttgtcaaaccaaacagttgtttacaagggcatgcttcgttctgaagttcttgggttgttttatggtgacttgcagaatgagctctataaaacctcttttgctatttatcaccggaggtatagcacaaatactagccccagatggcctcttgcccaacccatgaggttgcttggtcataatggagagatcaataccatacagggaaacttgaactggatgcaatctcgcgaagcctcattgaagtctcctgtttggcgtggtcgtgaaaatgaaattcgtcctttcggcaacccaaaggcctcagactctgcaaatcttgatagtacagcagaattgttactaagaagcggtcgtactcctgatgaagctttaatgattcttgtcccagaggcatacaaaaatcatccgactttgtcgaaaaaatatcctgaggtgattgatttttacgactactacaaaggtcagatggaagcttgggatgggcctgcattactcttattcagtgatggaaaaactgttggagcttgtcttgataggaatggtcttcgccctgctaggtattggcggacaattgacaatgtggtctatgttgcttctgaggttggtgttttaccgattgatgatgcaaaagtcaccatgaaaggccgtctgggtcctggaatgatgatagcggttgatttgcggagtggtcaggtttttgagaatacagaggttaaaaagcgagtagctgcttcaaatccctatggaaagtgggtcagtgaaaacctgcgaaccttgaagcctgtaaacttcttctcggctacagctatggacaatgaagcaatcttaagacatcaacaggcatttggatattctagtgaggatgtgcaaatggttattgagactatggctgcacaagggaaagagcctacattttgcatgggagatgatattcctttggcagttttgtcacagaagccacatatgctttacgattattttaagcaacggtttgctcaggttactaatccggctattgaccctctaagagaaggattagttatgtctctcgaagtaaacattgggagaagaggcaacatcttagaggcggaacctgaaaatgcttcccaggttattctctctagtcctgtactgaatgaaggagaattggagtcgttgctcaaggatccactcttgaaacctcaagtcttacctacattttttgatatacgtaaaggaattgaaggttccttggagaagacactttataaactatgtgaagctgctgatgatgctgttcgaaatggttcccaactgcttgttctgtctgaccgtgctgatgagctggaaccaactcgtcctgcaatccctatacttcttgctgtaggagctgtacaccagcatcttattcagaatggtttgcgaatgtcagcttccattgtagcagacactgctcagtgcttcagcacacatcagtttgcctgtttgataggatatggagcaagtgctgtatgtccatacttggcactagagacttgtcgacagtggcgtctgagcagtaaaactgtgaacttgatgcgaaatgggaaaatgccttctgtgacaatcgaacaggctcaaatgaacttttgtaaggcagttaaatctgggcttctcaaaattctttctaaaatgggcatttcattgctttcaagttactgtggtgcacagatatttgagatatatggattagggaaggaggttgttgatcttgcattttctgggagtgtatcaaatattggcggattaacttttgatgagctggcaagggagtcattgtctttctgggtgaaggctttctccggagatacagcaaaaagattagaaaattatggatttatacaatttagacctggaggagagtatcatggaaacaacccagaaatgtcgaaattgcttcataaagcagttcgtcaaaagagtgaaaatgccttttcaatttatcagcagcatttggctaaccggcctgtgaatgttctccgtgatcttcttgagttcaaaagtgatcgtgctcctattcctgtcggaagggttgaacctgctgctactattgttcaaaggttttgtaccggtggaatgtcacttggtgcaatttcaagagaaactcatgaagccattgccattgccatgaatagactaggagggaaatctaattcaggagaaggtggagaggatcctattcgctggagcccacttactgatgttgttgatgggtactctccaactctaccacaccttaaaggtcttcaaaatggagatactgctactagtgctattaaacaggttgcttcaggccggtttggtgtaactccaacattcttggccaatgctgatcagctggaaatcaaaattgcacaaggtgcaaagccaggggaaggaggccagttgcctgggaaaaaagttagtgcatacattgcaaggttgagaaattctaaacctggtgttccacttatatctccacctccgcatcacgacatttattcgattgaggatcttgcccagttgatctatgaccttcatcaggttaaccctaaagctaaggtgtctgtaaagcttgtgggagaagctggaataggaacagttgcttctggggttgcaaagggtaatgctgatattatacagatatctgggcatgattggtggaactggagccagccctattagttcaataaagcatgctggtggtccttgggaacttggacttacagaaacgcatcagactctcattgcaaatggactgagagaaagagtaattctcagagttgatggcggcttcaaaagcggagttgatgtcttaatggctgcagtaatgggtgctgatgaatatggatttggttctgtggcaatgattgctactggatgtgttatggcccgcatttgccatacaaacaattgcccagttggggttgccagtcaaagagaagaactgcgtgcacgatttcctggtgtgcctggtgatcttgttaattttttcctttatgtagctgaggaggttagaggcatgttggcacaactgggttatgcgaagttggatgatgtaattggaagaacagatttgttcaggccgcgggacatctcactagtgaaaactcagcatcttgatctcagttatattctctcaaatgttggattgccaaaatggagcagtacggaaataaggaatcaggatgttcatacgaatgggcctgtactggatgaggttttgcttgcagatgctgagatatctgatgcaattgagtatgagaaagtggttcacaaaacctgtaagatatacaatgtggaccgagctgtttgtgggcgtatagcgggtgtgatcgcgaagaaatatggagacactggttttgctgggcagctaaacataacatttattgggagtgctggccagtcatttgcgtgctttttgacacctgggatgaacattcacctgattggagaggccaatgattatgtgggaaagggaatggctggaggtgaggttgtagtgactcctgttgagaccactggattttgccctgaggaagcaacaatagtggggaatacatgcttgtatggagcaactggtggtcaaatctttgttagaggaaaagccggagagaggtttgccgtgagaaactcacttgctcaagcagttgttgaaggcactggagatcactgttgtgaatacatgactggtggttgtgtcgttgtacttggaaaagtgggtagaaatgttgctgctggaatgactggaggtttggcatacattctcgatgaggatgatactctcatccccaaggtcaataaggagatagtgaaggtccagagggtgattgctcctgttggccagatgcagttgaagagccttattgaagcccatgttgaaaaaactggcagcagcaaaggcactgctattctcaaggaatgggatacgtatctaccgctcttctggcagctggttccacctagcgaagaagacaccccagaggcttgtgcagagtatgtaagaacagctactggggaggtgacattgcagtcagcttaggacaacaatttgacattatacgatggcctcgaggcctgcatgcaaagccagaaaattccaatcacaccttgtacaattcaaacagagagattgattttgaaattggaattctgcatcgatgagagggagactcgaatttcagcatgaaagcagctttgaatatttattggcaaagaaacatcatatttggattgatctgttggtaagagaattcttacctcaatattacagcagttgtatagtgaattgtggtagactgtaaatgtaagtttaggtttttccgatcttgtcgggctacatatatggttttgtaataattgtaaaccttggtagcctttttaagtgctggtccttgctatgtatttatccaattgattttcttatccccatttctttgtattcgcagctttcaatcttggtttggccaacgcttgaaccatatttcttgtttcaatgataattcgatctttatatccgccaaggacagttgtaattatctttctataaggctcaattagtttaacattcatgaatcctttgttcttttttttttttttcttgtttaagttacaatctacggatattattggtatacttaaaagaaataaacattggcttgtaaagagaattttggctagatatcagtaatagatcctcgagctag

SEQ ID NO: 1432 - DNA, 5467 bp, Quercus alba
cacacacacacacacacacagtcactctctctctctctttcttctctatggctttacagtcagtctctcccattcctcaccttctccactcttcttcttcaccaaagccttcgattctcgcttcctccaacaatggccgctacttcattgatttcgtcggtttacattgcaaatccaagcgaaccaggcggaaattcactgcgacttctcggaccttctcgcactttgtttcttcgtcgaaggtcaaagcggttcttgattttgcacgtaacaataacgcctcggaggaatcggattctcgctctgatttgagaccgaaggttgcaagcttggatgatatattatcagagagaggagcttgtggggttggattcattgccaatttggaaaataaagaatcgcatgggataattaaggatgctcttacagctcttggctgtatggaacatcgtgggggatgtggagcagataatgactctggtgatggttcaggtgtgatgacttcaattccttgggaactatttaacagctggggaaataagcaagggattgctccctttgataaattgcatactgctgttggaatgattttccttcccaaagatgatgacctattgaaagaagccaaaagagttattgtaaatacttttcaacaagagggtcttgaggtgcttggatggaggcctgttcctgtgaatgcttctatagttggttactatgccagagaaaccatgcccaacatacagcaggtatttgttaaagctgtcaaagaagagactgtcgaagacattgaaagagaactgtacatctgccgaaaattgattgaaagagcagcaagctcagaaacttggggaagcgagctttatttctgttctttgtccaatcagacaatagtttacaagggaatgcttcgctctgaagctcttgggttattttattctgaccttcaaagtgatctttataaatccccttttgccatttatcatcgaaggtacagcacaaatactagtcccagatggcctcttgcacaaccaatgagatttcttggacataatggagaaatcaataccattcagggtaacttaaactggatgcaatctcgagaaagctcattgaagtcatctgtatggcgtgggcgtgaaaatgaaattcgtccatttggtaacccaaaggcatcggactctgcaaatcttgatagtgcagcagaattattaataaggagtggccgtactgctgaggaagctctgatgattcttgtcccagaggcatacaagaatcatccaactcttatgatcaaatatcctgaggtggctgacttttatgactactacaagggtcagatggaggcttgggatgggcctgctttacttttattcagtgatggaaaaacagtgggggcatgtctagatcggaatggacttcgccctgctaggtattggcggacgtcagacaatgttgtctatgttgcatctgaggttggtgtcctacctatggatgagtcgaaagttacaatgaaaggccgtctaggtccagggatgatgatagctgttgatttaaccagcggacaggtttatgagaatacggaggtaaaaaagcgagtagcgttgtcaaatccatttggaaagtggataaaggaaaacttgcgatccctgaagcctgtgaacttcctatcaggaacaattatggacaatgatgcaatattgagacaccaacaggcatttggctactcaagcgaagatgtgcaattggttattgaaactatggcttcacaagggaaggagcctacattttgcatgggagatgatattccactggcaattttgtctcagaagccacacatgctttatgattattttaagcagcggtttgcacaggttacaaatccagctattgaccctcttagagaaggacttgtcatgtctctcgaaatcaatattgggaagcgaagaaatattttagaggttggacctgaaaatgcttcacaggttattttgtccagtcccgtactgaatgaaggggagcttgagtccttgctaaatgatccctctttgaaaccccaagttttgccaacattttttgatattcgtaaaggagttgatggttccttggaaaagacactaaataagctttgtgaagctgctgatgaagctgttcgaaatggttcccaactgcttgttctgtcggaccgttctgatgtgctggaaccaactcgtccggcagttccaatacttctggctgttggtgcggttcatcagcatcttattcagaatggattgcgaatgtcagcttctattgttgcagacactgcacaatgcttcagcactcatcagtttgcctgtttggttggatttggtgcaagtgccatatgtccatacttggcactagaaacatgccgacagtggcgtctgagtaagaaaaccgtaaatttgatgaggaatggaaagatgcctactgtaacaattgagcaggctcaaaagaacttttgcaaggctgttaaatccggtcttctcaaaattctttccaaaatgggaatctcattgctttctagttattgtggtgcacagatatttgagatttatggattagggaaggagattgttgatctttcattttgtggaagtgtctcaaaaattggtggattaacttttgatgagctggctagggagactttatctttttgggtgaaggcattctctgaggatacagctaaaagactagaaaattttgggtttatacaattcagaccaggaggggagtatcatggaaacaaccctgagatgtcaaaattactccataaagctgttcgccaaaagagtgaaagtgcgttttcagtttatcagcaacatttggctaaccgacctgttaatgttcttcgtgatcttcttgagttcaaaagtgatcgcgctcccattcctgtgggaaaggttgagcctgctgtatctattgtgctaaggttttgcactggtgggatgtcacttggagctatttcaagagaaactcatgaagccattgctattgctatgaataggttaggtggaaaatctaattccggagaaggtggtgaggatcccattcgctggagaccacttactgatgtttttgatgggtactcgccaacgcttcctcatctcaaaggtcttcaaaatggggatacagctacaagtgctatcaaacaggttgcttcaggacgttttggtgtcactccaatgttcttagccaatgctgatcaattagaaatcaaaatcgcacaaggtgcaaagcctggtgaaggtggtcaattgcctgggaaaaaagttagtgcatatattgcaaggttaagaaattctaaacctggggttccacttatttctccacctcctcaccacgacatctattccatagaagatcttgcccaattgatctttgaccttcatcaggtcaatcctaaggctaaggtgtcggtaaagctagtggcagaagcaggaattggcactgttgcttctggggttgcaaagggtaatgctgatgttatacagatatcagggcatgatggtggaactggagccagccctataagttccatcaagcatgctggtggtccctgggaacttggacttacagagacacaccagacacttattgaaaatggtctaagggaaagggtcattctcagagttgatggtggctttaaaagtggagttgatgtcctaacagctgcagctatgggtgctgatgaatatgggtttggttctgtggcaatgattgctactggttgtgtgatggcccgaatttgccacacaaataattgtcctgttggcgttgccagtcagagagaagaactgcgtgctcggttccctggtgtgcctggtgatcttgtcaacttctttttatatgttgctgaggaggtaagaggcatgttggcacaactgggatatgagaagttggatgatattattggtaggacagatttattaagaccacgagatatctctctaatgaaaacccaacatcttgatctcagttacattctatcaaatgttgggttaccaaaatggagtagtactgaaatcaggaatcaagatgttcatactaatggtcctgttctggatgatattttactagcagatccagagatatcagatgcaattgataatgaaaaggtgatccataagaatgtaaagatttacaatgttgatcgtgctgcttgtggacgcatagcgggggtaattgcaaagaagtatggtgacactggttttgctgggcagttgaacataacattcgtggggagtgctgggcagtcatttgcatgctttttgacacctggaatgaatattcggctaataggagagtccaatgactatgtgggaaagggtattgccggaggtgagttggttgtagttccggttgataacactgggttctgccctgaggatgcaactattgttgggaatacttgcctgtatggggcaacaggtggtcaagtctttgtcagaggaaaagctggggaacgatttgctgttagaaactcacttgctgaagcagtggttgagggcactggagaccattgttgtgagtacatgacgggtggttgcgtggttgtacttggaaaagtgggtagaaatgtagctgctggaatgactggtggtttggcatacattcttgatgaggacaacgctctcctccccaaggtaaataaagaaattgtcaagatccaaagagtgactgcgactgtggggcagatgcagctgaagaaccttattgaagcccatgttgaaaaaactgggagcagtaaaggttctgctattctgaaggagtgggacacatatctaccactgttttggcagctggttccacctagtgaagaagacaccccagaagcttgtgcagattatgagaaaacaggtgctgggcaggtcactttgcaatctgcttaggataatgattcaaaagtaccctgagaccagcactgaaatcacataaactgcttcccaatctgtacagtcatatacacgggagatgggttattaagttaaatactactgctacttaaaaaggatttgaatgctttagtgccgagggtggaaaaaaaagttttaatcaaagattggcagtgcattgcctgaagttggagaccgttatctgtacattgaaaagcatacacatttggtcacataaaatttgtatagtgattgtgtcagacattgtaaattcaagctcagacttttccaatctttcaaagcagtgtcatggcctgctattgctagtcattcctctttagtttaattaaaatctggttgagctttcttcagatatttattttttgttaccatgtaaaaagtttcattcaaaagagcatcatagtatagaaatgtctaatcttgcttcttactataccgaccatgcacatgttgtagttacataatctaatttattgtttaggactcaaatagtttgatatatgaaattaataaaaacgattcttggttgt

SEQ ID NO: 1433 - DNA, 5549 bp, Citrus clementina
cactttctcttcaaccaaacatggccttgcaatcatcaatctcacccgtcattgctcatctcagcgctgctacaaagccgagttcggttctttcatcaaacaaaaacttgctctttgttgattttgtcggtctctattgtcaatccaacagaatcagacggagaatcggcgtttcttgtaatcaaacagtattttctcgtttgttgaataagaaaacatcgtcgtctgttaaagctgtacatgatcttgagcgcaccacttctgctcctcaatctgattccaaaccaaaggttgccaacttggaggacgtaatttcagaaagaggagcatgcggagttggttttattgcccatttggaaaacaaagcatcttatgaaattgttaaggatgctcttacagctcttggctgcatggaacatcgtgggggctgtggagcagataatgattctggtgatggttcaggattgatgacttcaattccatgggatctttttaacaattgggctgaaaatgaagggattgcttcctttgataagttgcacactggtgtgggaatggttttctttcccaaagatgatgatcttatgaagaaagccaaagaagttattgtaaatacttttagacaagagggccttgaggtgcttggatggaggcctgttcctgtgaatacatctgtagttggttattacgcaaaagaaacaatgcccaatatacagcaggtgtttgttaaagttgttaaagaagagagcgttgatgacattgaacgcgaactgtacatctgccggaaattgatagaaagagcagcagcgttggaaagttgcgggaatgagctttatttctgctctttgtcaaaccaaacagttgtttacaagggcatgcttcgttctgaagttcttgggttgttttatggtgacttgcagaatgagctctataaaacctcttttgctatttatcaccggaggtatagcacaaatactagccccaaatggcctcttgcccaacccatgaggttgcttggtcataatggagagatcaataccatacagggaaacttgaactggatgcaatctcgcgaagcctcattgaagtctcctgtttggcgtggtcgtgaaaatgaaattcgtcctttcggcaacccaaaggcctcagactctgcaaatcttgatagtacagcagaattgttactaagaagcggtcgtactcctgatgaagctttaatgattcttgtcccagaggcatacaaaaatcatccgactttgtcgataaaatatcctgaggtgattgatttttacgactactacaaaggtcagatggaagcttgggatgggcctgcattactcttattcagtgatggaaaaactgttggagcttgtcttgataggaatggtcttcgccctgctaggtattggcggacaattgacaatgtggtctatgttgcttctgaggttggtgttttaccgattgatgatgcaaaagtcaccatgaaaggccgtctgggtcctggaatgatgatagcggttgatttgcggagtggtcaggtttttgagaatacagaggttaaaaagcgagtagctgcttcaaatccctatggaaagtgggtcagtgaaaacctgcgaaccttgaagcctgtaaacttcttctcggctacagctatggacaatgaagcaatcttaagacatcaacaggcatttggatattctagtgaggatgtgcaaatggttattgagactatggctgcacaagggaaagagcctacattttgcatgggagatgatattcctttggcagttttgtcacagaagccacatatgctttacgattattttaagcaacggtttgctcaggttactaatccggctattgaccctctaagagaaggattagttatgtctctcgaagtaaacattgggagaagaggcaacatcttggaggcgggacctgaaaatgcttcccaggttattctctctagtcctgtactgaatgaaggagaattggagtcgttgctcaaggatccactcttgaaacctcaagtcttacctacattttttgatatacgtaaaggaattgaaggttccttggagaagacactttataaactatgtgaagccgctgatgatgctgttcgaaatggttcccaactgcttgttctgtctgaccgtgctgatgagcttgaaccaactcgtcctgcaatccctatacttcttgctgtaggagctgtacaccagcatcttattcagaatggtttgcgaatgtcagcttccattgtagcagacactgctcagtgcttcagcacacatcagtttgcctgtttgataggatatggagcaagtgctgtatgtccatacttggcactagagacttgtcgacagtggcgtctgagcagtaaaactgtgaacttgatgcgaaatgggaaaatgccttctgtgacaatcgaacaggctcaaatgaacttttgtaaggcagttaaatctgggcttctcaaaattctttctaaaatgggcatttcattgctttcaagttactgtggtgcacagatatttgagatatatggattagggaaggaggttgttgatcttgcattttctgggagtgtatcaaatattggcggattaacttttgatgagctggcaagggagtcattgtctttctgggtgaaggctttctccggagatacagcaaaaagattagaaaattatggatttatacaatttagacctggaggagagtatcatggaaacaacccagaaatgtcgaaattgcttcataaagcagttcgtcaaaagagtgaaaatgccttttcaatttatcagcagcatttggctaaccggcctgtgaatgttcttcgtgatcttcttgagttcaaaagtgatcgtgctcctattcctgtcggaagggttgaacctgctgctactattgttcaaaggttttgtaccggtggaatgtcacttggtgcaatttcaagagaaacccatgaagccattgccattgccatgaatagactaggagggaaatctaattcaggagaaggtggagaggatcctattcgctggagcccacttactgatgttgttgatgggtactctccaactctaccacaccttaaaggtcttcaaaatggagatactgctactagtgctattaaacaggttgcttcaggccggtttggtgtaactccaacattcttggccaatgctgatcagctggaaatcaaaattgcacaaggtgcaaagccaggggaaggaggccagttgcctgggaaaaaagttagtgcatacattgcaaggttgagaaattctaaacctggtgttccacttatatctccacctccgcatcacgacatttattcgattgaggatcttgcccagttgatctatgaccttcatcaggttaaccctaaagctaaggtgtctgtaaagcttgtgggagaagctggaataggaacagttgcttctggggttgcaaagggtaatgctgatattatacagatatctgggcatgatggtggaactggagccagccctattagttcaataaagcatgctggtggtccttgggaacttggacttacagaaacgcatcagactctcattgcaaatggactgagagaaagagtaattctcagagttgatggcggcttcaaaagtggagttgatgtcttaatggctgcagtaatgggtgctgatgaatatggatttggttctgtggcaatgattgctactggatgtgttatggcccgcatttgccatacaaacaattgcccagttggggttgccagtcaaagagaagaactgcgtgcacgatttcctggtgtgcctggtgatcttgttaattttttcctttatgtagctgaggaggttagaggcatgttggcacaactgggttatgagaagttggatgatgtaattggaagaacagatttgttcaggccgcgggacatctctctagtgaaaactcagcatcttgatctcagttatattctctcaaatgttggattgccaaaatggagcagtacggaaataaggaatcaggatgttcatacgaatgggcctgtactggatgaggttttgcttgcagatcctgagatatctgatgcaattgagtatgagaaagtggttcacaaaacctgtaagatatacaatgtggaccgagctgtttgtgggcgtatagcaggtgtgatcgcgaagaaatatggagacactggttttgctgggcagctaaacataacatttattgggagtgctggccagtcatttgcgtgctttttgacacctgggatgaacattcacctgattggagaggccaatgattatgtgggaaagggaatggctggaggtgaggttgtagtgactcctattgagaccactggattttgccctgaggaagcaacaatagtggggaatacatgcttgtatggagcaactggtggtcaaatctttgttagaggaaaagccggagagaggtttgccgtgagaaactcacttgttcaagcagttgttgaaggcactggagatcactgttgtgaatacatgactggtggttgtgtcgttgtacttggaaaagtgggtagaaatgttgctgctggaatgactggaggtttggcatacattcttgatgaggatgatactctcatccccaaggtcaataaggagatagtgaaggtccagagggtgattgctcctgttggccagatgcagttgaagagccttattgaagcccatgttgaaaaaactggcagcagcaaaggcactgctattctcaaggaatgggatacgtatctaccgctcttctggcagctggttccacctagcgaagaagacaccccagaggcttgtgcagagtatgtaagaacagctactggggaggtgacattgcagtcagcttaggacaacaatttgacattatatgatggcctcgaggcctgcatgcaaagccagaaagttccaatcacaccttgtacaattcaaacagagagattgattttgaaattggaattctgcatcgatgagagggagactcgaatttcagcatgaaagcagctttgaatatttattggcaaagaaacatcatatttggattgatctgttggtaagagaattcttacctcaatattacagcagttgtatagtgaattgtggtagactgtaaatgtaagtttaggtttttccgatcttgtcgggctacatatatggttttgtaataattgtaaaccttggtagcctttttaagtgctggtccttgctatgtatttatccaattgattttcttatccccatttctttgtattcgcagctttcaatcttggtttggccaacgcttgaaccatatttcttgtttcaatgataattcgatctttatatccgccaaggacagttgtaattatctttctataaggctcaattagtttaacattcatgaatcctttgttcttttttttttttttttcttgtttaagttacaatctacggatattattggtatacttaaaagaaataaacattggcttgtaaagagaattttggctagatatcagtaatagatcctcgagctag

SEQ ID NO: 1434 - DNA, 5667 bp, Tabernaemontana elegans
taaagtagtaagtagtagtccccccgtcagtttcatcagtcgcttactacgctcccagagccagagagcagacgtacctcattatcatcatcatcatcagcaaagctgaaattgaacgtctctcaacacatttgaggctcccagtctctcgtcttttatctccacatcctcccctctctccgcacatttcctcgctgtcactccaccaccaactctcttctctctccatctccttccattctgactagtcacagtagtaaaaactaagaagagtgctgggaaggacgagagatgtctgtaaacacggtggcgggacaggtcccgcaactgctctactcaaatgggcagttggcttcgagagacttggtgtttcttgattttgttgggttgtgtagcaagcgaactcgccggagagttgggattgcttcgtctaaccggctgacacgtggtgctatgttgggaaagaattggtcttcgttgtctattagagctgttcttgatcttgaacgcattggcaccgtttctaagtcgtcttccgatgatttaaagcctcaggttgcaagcttggaagatataatatccgaaagaggagcttgtggagttggatttattgcgaatttggaaaataaagcatcgcatgcaattgttaaagatgctcttactgcccttggttgtatggagcatcgtgggggttgtggggcagataatgattccggtgatggttctggagtgatgacatctattccttgggacctttttaatgattgggccgccaagtctgggattgctgcctttgataaattacacactggtgttggaatgatatttttcccccaagatgaagaactaatgaaagaagcaaaaacagcaattgtaaatatctttaaagaagaaggtcttgaagtgcttggttggaggcctgttcctgtagatgcttccgttgttggtttttatgccagaaaaactgtgcccaacatacaacaggtctttgttaggattgtcaaagaagaaaatgttgatgacattgaaagagaactatatatatgtcggaaattgattgaaagagcggccaactctgaaacatgggggagtgagctgtacttctgctcattgtccaaccaaaccatagtttacaagggaatgctacgatcagaagttcttggcagattttatttggacctacaaaatgatctctatgaatccccatttgctatctaccataggagatacagtacaaataccagccctagatggcctctagctcaacccatgaggtttcttggccataatggagagatcaacactatacagggaaatttgaattggatgcaatctagggaagcctccctgaagtctcctgtttggcgtggtcgggaaaatgaaattcgcccttttgggaatccaaaggcatcggattctgctaatcttgacagtgcagcagaattattgataagaagtggtcgtactcctgaggaagctttgatgattctggtcccggaggcttataagaaccatccaacgctatcgataaaataccctgaggttgttgatttttatgattattacaaggggcaaatggaagcctgggacggacctgccttactattgttcagtgatggaaaaactgtcggagctgcccttgatcgtaacggactacgccctgcaagatattggcggacaaaagacaacattgtctatgttgcatctgaggttggtgttttgccaatggatgagtcaaaagtcacaatgaaagggcggttaggtcctggaatgatgatagccgttgatctaacaagtggtcaggtttttgagaacactgaagttaaaaaacgcgtagcgttttcaaatccttatggaaagtgggtaaatgaaaatttacggtcattgaagcctgtaaacttcctttctacaacagtcatggataatgaagcaatattaagacgccagcaggcatttgggtattcgagtgaggacgtccaaatggttattgaatctatggctgcacaaggaaaggagcccactttttgtatgggagatgatatacctctggcagcattgtctcagaagccacacatgctatttgattacttcaagcaacgatttgctcaggttactaatccagctattgatcctcttagagaaggactagttatgtctcttgaagtcaatcttggcaagcgtggcaatatacttgaagttggacctgaaaatacctcgcaggtgattttgtcaagtccagtattcaatgaaggagagcttgagtctttgctcaaagatccaatcttgaagcctcaagtcttacgaaccttttttgacataaggaaaggggttgaaggttccttagagaagactttaaacaagctctgtgaagcagctgatgaagcagttagaaatggatcccagttgctcattctctctgacagatctgatgagccggaaccgacacagccggcgatcccaatacttcttgctgtaggggctgttcaccagcatctgattcagaatggtctacggatgtcagcttctattgttgctgatactgctcagtgcttcagtactcaccattttgcttgcttaattggttatggtgcaagtgctgtgtgcccatatttggcactggagacaagcaggcaatggcgcttgagcactaaaactgtgaacctgatgagaaatgggaaaatgcctacagttacaattgaacaggctcaaaagaactattgcaaggcagttaaatctggtcttctaaaaattctctccaaaatgggcatctcattgctctcaagttattgtggtgctcagatatttgaaatttatggactgggaaaagaagttgttgacattgcattttgtgggagtaattcaagtattggcggattaaccctggatgagttggcaagggagagtttatcattctgggtaaaggctttctctgaggatacagctaaaagactagaaaattttggatttatacaattcagaccaggaggggagtatcatggcaacaacccggagatgtcaaaattgctccacaaagctgtccgacaaaaaagtgaaattgcatattctgtttatcagcagcatttagctacccgacctgtgaatgttctccgagatcttcttgagttcaaaagtgatcgatcgcccatcccagtaggaagggttgagcctgcttcttctattgtgcagcgcttttgtacaggtgggatgtcactcggagctatttctagggaaactcatgaggcaattgcaattgcgatgaatagaataggtggaaaatcaaattcaggagaaggtggtgaggatccaattcgctggaagccactgactgatgttgttgatggttattctccaacactcccacatctcaaaggtcttcaaaatggggatactgctacaagtgccatcaagcaggttgcttctggtcgctttggtgtcacaccaacttttttagcaaatgctgatcaattggaaattaaaattgcacaaggtgcaaaacctggtgaaggtggccaattgccagggaaaaaagttagtgcttacatagcacgattaaggaattcaaaaccaggagttcctcttatttctcctcctccacaccatgatatctattctattgaagatctagctcagttgatttttgaccttcatcaggtcaaccccaaggcaaaagtatctgtaaagcttgtagcagaagctggcattggcacagtggcttctggggttgcaaagggtaatgccgacattatacagatatcaggacatgacggaggaactggagccagccctataagttccattaagcatgcaggtggtccttgggaacttggactaactgaatcacaccagacgcttattgaaaatgggctcagagaaagggtcatactcagagttgatggtggcttcaaaagtggaatggatgttctaatggctgcagcaatgggtgctgatgagtatggatttggttctgttgcaatgattgccactggttgtgtcatggctcgtatctgccacacaaataattgtccagttggtgttgccagccagagagaagaattaagagctcgttttcctggtgtgcctggtgatcttgttaactacttcttatatgttgccgaggaggtaagaggcatgttggcgcaactgggttatgagaagctggatgatgttattgggcgcacagatctgttgagaccccgagatatatcactgatgaagactcagcatcttgatcttagttatattctttcaagtgttggtttaccaaagtggagcagcactgccgtcaggaaccaggaggttcacagcaatggtcctgttctggatgacacattgctgtcagatccagagatatcagatgcaattaagaatgaaaaggtggtaaataaaactgtaccaatctacaatgtggaccgtgctgtttgtggacgtattgcaggtgtagttgcaaagaagtatggggacactgggtttgctgggcagctcaatatgacattcatggggagtgctgggcagtcatttgcttgttttctcacccctggaatgaacatccggcttgtaggggaagcgaatgactacgtagggaagggtatggctggtggtgaattggttgtgactccagttgacaatactggattttgccccgaggatgccacaatagtgggaaatacctgcttgtatggggctacaggtggtcaagtctttgttcgaggaaaagctggggagcgttttgctgtgagaaactcgcttgctgaagcagttgtagaaggcactggggatcattgttgtgaatacatgactgggggctgtgttgtggtgcttggaaaggtgggtagaaatgtagcagctggaatgactgggggtttagcctacattctagatgaggacgatactcttattcccaagctgaacaaggaaatcgtgaagatccagagagttgttgctccagttggccagatgcagcttaagagtctcattgaggcccatgctgagaaaaccggaagcagcaaaggcactgccattctgaaggagtgggacaaatatttgccactcttctggcagctggttccacctagcgaggaggacaccccagaggcttgtgctgagtatgagcaaacagctgctggtcaagtgagtttacagtctgcatagaagacatcccggtatagctcgtgatcaactattgcttcagcagctgcagccaaagtccttttaaaggtaggattgtatacaagattctttgtatgtttctgcaaaggagattcccaaagatgaaagattatgcaaaggaagatcatcctcgcgtaaaggattaaagatagaggccatgatctttatcaaacaaccgatctttcaaaaatgcatggatcagtgggtgtacagtgatggcgggtatgcttgagattctagatgctgatttctcagaatcttcagtggagtttatgttctttgaacagatgttgttgatcacttgaaatcttgcaatcttagagcatgaaatgtaaatataacatggaaagcttcgttgctctcatctttccatatttcatctgaagtaatctgaaagtctcttccacatcaagtacagtaagttgtaaatgtcatcgacatgaaatatacatcccaatttcccattaccctgattatgcagattctgtaaacaaagatttg

SEQ ID NO: 1435 - DNA, 5369 bp, Populus trichocarpa
gaggagcgggtggttccggtcctttatcttctttatccacctcttacaaaaaccttcctcttttcttcttctcctccacacgattctccaacccacaaaaatctcaaaaatatataaaaaagaaacattctctcgctcgctcgctcactgactgactgactcatggcttctcttcaatcaccagtagtctccccgattccgcaactcgtcaatgctacaagaccgaactcactcaataagaatttgttatttgttgatttcgttggactctactgtaaatcgaagagaactagaaggagaataggactttcttcgagtttctctcgattttcaattaaaaagaactccagtccggtccacgccattctcagtgttgaccgtcaaaacatctctccgcagtatcctcctcctcctgatttgaaaccgcaggtagcaaacttggaggatataatatcagaaagaggagcatgtggagttggatttattgcgaatttggaaaacaagccgtcccatgcgattgtcaaggatgcacttacggctcttggttgtatggaacatcgtggaggctgtggagcagataatgactctggtgatggttcaggactgatgacttcgattccgtgggagttatttgataaatgggctgagagtgaagggattggttcttttgataagtcgcatactggtgttgggatggtttttttccctaaagatgataacctcgtgaaagaagccaaaaaagcaattgtaaatatttttgaacaagagggccttgaggtgcttggatggaggtccgttcctgtaaatacgtccgtagttggtttttatgcaaaagaaaccatgcccaacatccaacaagtatttgttaaagttattaaagaagagaatgttgacgacattgaacgtgaactgtatatctgccggaagctgattgaaagggcggcgaactcagcaaattgggggaatgagctttatttctgctctttgtctaatcaaacaattgtttataagggaatgcttcgttctgaagttcttgggatgttttattctgaccttcagaatgatatctacaaatcacctttcgctatttatcatcgaaggtatagcacaaatactagtcccagatggcctcttgctcaaccaatgcggtttcttggtcataatggagagattaacaccatacagggtaacctgaattggatgcaatctcgagaaacctcattgaaatcttcggtttggcatggtcgtgaaaatgaaattcgtccttatgggaacccaaaggcatcagattcagcaaatcttgacagtgcagccgaactgttaataaggagtggacgcgctcctgaggaggctttgatgattcttgtccctgaggcatataaaaatcatccaactctgacaatcaaatatcctgaggttgtagatttttatgattattacaagggtcagatggaagcttgggatggacctgctttactcttattcagtgatggaaagacagttggggcttgtctcgataggaatggactccgtcctgctagatattggcggacagtggacaattttgtatatgttgcatctgaggttggggttgtaccaatggatgaatcaaaagtaacgatgaaaggccgtctaggtcccggaatgatgatagctgtagatttgcctggtggccaggtttatgagaacaccgaagtaaaaaagcgagtagcactgttaaatccatacggaaaatgggtcaaggaaaacctgcgatccttgaagcctgcaaacttcctctccgcaacagttatggacaatgaagtaactttaaaccgccaacaggcattcggctactccagcgaggatgtccaaatggttattgagaatatggcttcgcaagggaaggagcctacattttgcatgggagatgatattccactggcgatattgtctcaaaagccgcatatgctttatgactattttaaacaacggtttgcacaggttacaaatccagctatagaccctctcagagaaggattagttatgtctcttgaagtcaatattggaaagcgaagaaacatcttggaagttggaccagaaaatgcttcacaggttatcttgtctagtcctgtactaaatgaaggagagcttgaattgttactgaaggatccctacttaaaacctcaagttttaccaaccttttttgatatacgcaaaggggttgagggttctttggagaaaacattaattaagctttgtgaggcagctgatgaagctgttagaaatggttcccaattacttgttctctccgaccgatctgatgagctggaacccactcggcctgcaattccaattcttcttgctgttggtgctgttcatcagcatcttattcagaatggtttgcgaatgtcaacttcaattgtagctgacactgctcagtgctttagcactcatcagtttgcctgtttgattggatatggtgctagtgcaatatgtccgtacttggcactggaaacatgtcggcagtggcgcctgaataaaagaactgtgaatctgatgatgaatggcaagatgcctactgtaacaattgaacaagctcaaaagaatttttgcaaggcagttaaatctggtcttctcaaaattctttctaagatgggcatctcattgctttcaagttattgtggtgcgcagatatttgagatttatggattggggaaggagattgttgatctagcattctgtggcagtgtttcaaatattggtggagcaacttttgatgagttggcaagggagacgttgtctttctgggtgaaagctttctcccaggctacagctaaaagactggaaaattatggatttatacaattcagacctggaggggaatatcatggaaacaatccagagatgtcaaagctgcttcacaaagctgttcgccaaaagagtgaaaatgcattttctatttatcagcagcatttgtctaaccggcctgtgaatgttcttcgtgatcttcttgagttcaaaagtgatcgtgctccaatacccgtgggaaaggttgaacctgccacatctattgttcaacggttttgcactggtgggatgtcgcttggagctatttctagagaaactcatgaagcaattgccattgctatgaacagattaggtggaaaatctaattcaggggaaggtggtgaggatcctattcgctggagcccacttactgatgttgttgatgggtactctcctacgttaccacatcttaaaggtcttcaaaatggtgatactgctaccagcgctattaaacaggttgcttcaggacgttttggtgtcactccaacattcttggtcaatgctgatcagttagaaatcaaaattgcacaaggtgccaagcctggtgaaggtggccagttgcccgggaagaaagtcagtgcatacattgcaaggctgagaaattcaaaacctggggttccgcttatatctccacccccacaccatgacatttattccattgaagatcttgcgcaattgatctatgaccttcatcaggtcaatcctaaggctaaggtttctgtaaagcttgtggcagaagctggtattggcacagttgcatctggggtagcaaagggtaatgctgatattatacagatatcagggcatgatggtggaactggagctagccccataagttccattaagcatgctggtggaccttgggaacttggactcacagaatcccatcagactctcattgagaatgggctcagagaaagagtgatccttagggttgatgggggcttcaaaagcggagttgatgtcatgatggctgcagtaatgggtgccgatgagtatggatttggttccgttgcaatgattgctacgggatgtgtaatggcccgcatttgtcacactaataactgccctgttggtgttgccagccagagagaagaactacgtgctcggtttcctggcatccctggtgatcttgttaatttctttttatatgttgctgaggagataagaggcatgctggcacaattgggttatcagaagttagatgatatcattgggcatacagatttgttaagaccacgagatatatctcttgtcaaaactcagcatcttgatctcagttgtatcatgtcgagtgtaggcttaccaaaactgagaagtactgatatcaggaatcaagatgttcacaccaatggtcctgttttagatgatgttgttctagcagatccagagattctagatgctattaataatgaaaaagttgtcaataaaaccataaaaatatacaatgtggaccgggctgtttgtgggcgtatagctggtgtggttgcaaagaaatatggcgacactggttttgctgggcagctgaacataacgtttaccgggagtgcagggcagtcgtttgcatgctttttgacacctggaatgaacattcgcctaataggagaggctaatgattacgtggggaagggtatggctggaggagaattggtcgtaactcctgtggagaacactggatttgttcctgaggatgcagctattgtcgggaatacttgcttgtatggggctacaggtggccaagtatttgtcagagggaaagctggggagcggtttgctgtcagaaactcacttgctcaagctgtagttgaaggcactggagaccattgttgtgaatacatgactggtggttgtgtggtggtacttggaaaagtgggtaggaatgtagctgctgggatgactggaggtttggcttacattcttgatgaggatgacactttgatgcccaaggtaaataaagagatagtgaaggtccaaagagtaactgcatctgttggccagatgcagctaaagagccttattgaagctcacgttgaaaaaaccgggagcagcaaaggcgcagctatcctgaaggagtgggacacaaatctaccactcttttggcagctagtaccacccagtgaagaagacaccccagaggcttgtgcagcatacgaggcaaacagtgctgggcaagtgacatcattgcaatctgcataagatagctctgcgagaaaactctggaggccggccaataaaacccgaatttgcaaccccaacctgtacagatcaaatataaacaagatgaactcttgacttggaattctccacatatttataggggatccccggaatgcttggtatccttggcgatgaaggttttgtaatcgaagaaagattaacatcacccaagagcatcccagacatccattttcgagcatccaggttccacattgttgcagaaattgtatagtgatttgtggcagaaaatgtaaattcaagttaaaagttttttcaccattgtcaagattctgatacttggcaatagaacgtttgatttcatt

(The sequence listing continues in the following parts.)

What is claimed is:

1. A method of increasing vegetative growth and reducing time to flowering of a plant, comprising:
   (a) transforming a cell of the plant with a nucleic acid construct comprising a polynucleotide encoding a polypeptide comprising an amino acid sequence having at least 80% sequence identity and conservative amino acid substitutions with respect to SEQ ID NO: 600, to thereby over-express said polypeptide within the plant as compared to a native plant of the same species under the same growth conditions, and;
   (b) measuring the vegetative growth and the time to flowering of said plant over-expressing said polypeptide, wherein said measuring vegetative growth comprises measuring leaf blade area, plot coverage, rosette area, rosette diameter, and/or dry weight, (c) selecting plants over-expressing said polypeptide for an increased vegetative growth and for a decreased time to flowering under non-stress conditions as compared to said vegetative growth and said time to flowering of a native plant of the same species under the same growth conditions, and;

(d) isolating a regenerable portion of said plants selected according to step (c) having said increased vegetative growth and said decreased time to flowering under non-stress conditions as compared to said native plant under the same growth conditions so as to obtain an isolated regenerable portion of said selected plants; and (e) regenerating plants from said isolated regenerable portion of said selected plants, wherein plants without the said increased vegetative growth and said decreased time to flowering are not isolated and not regenerated, thereby increasing the vegetative growth and reducing the time to flowering of the plant.

2. The method of claim 1, wherein said polypeptide is set forth by SEQ ID NO: 600.

3. The method of claim 1, wherein said polynucleotide is operably linked to a heterologous promoter, and wherein said polynucleotide comprises a nucleic acid sequence at least 98% identical to SEQ ID NO: 399.

4. The method of claim 1, wherein said polynucleotide is operably linked to a heterologous promoter, and wherein said polynucleotide comprises the nucleic acid sequence set forth by SEQ ID NO: 399.

5. The method of claim 1, wherein said vegetative growth is measured by plot coverage
thereby increasing the plot coverage and reducing the time to flowering of said plant.

6. The method of claim 5, wherein said polynucleotide is operably linked to a heterologous promoter, and wherein said polynucleotide comprises a nucleic acid sequence at least 98% identical to SEQ ID NO: 399.

7. The method of claim 5, wherein said polynucleotide is operably linked to a heterologous promoter, and wherein said polynucleotide comprises the nucleic acid sequence set forth by SEQ ID NO: 399.

8. The method of claim 5, wherein said polypeptide is set forth by SEQ ID NO: 600.

9. The method of claim 1, wherein said vegetative growth is measured by leaf blade area,
thereby generating said plant with the increased leaf blade area and the reduced time to flowering as compared to the native plant of the same species under the same growth conditions.

10. The method of claim 9, wherein said polynucleotide is operably linked to a heterologous promoter, and wherein said polynucleotide comprises the nucleic acid sequence set forth by SEQ ID NO: 399.

11. The method of claim 9, wherein said polypeptide is set forth by SEQ ID NO: 600.

12. The method of claim 1, wherein said amino acid sequence has at least 95% sequence identity to the amino acid sequence set forth in SEQ ID NO: 600.

13. The method of claim 1, wherein said amino acid sequence has at least 98% sequence identity to the amino acid sequence set forth in SEQ ID NO: 600.

14. The method of claim 1, wherein said vegetative growth is measured by rosette area,
thereby generating said plant with the increased rosette area and the reduced time to flowering as compared to the native plant of the same species under the same growth conditions.

15. A method of selecting a plant, comprising:
(a) providing plants transformed with a nucleic acid construct comprising a polynucleotide encoding a polypeptide comprising an amino acid sequence having at least 80% sequence identity and conservative amino acid substitutions with respect to SEQ ID NO: 600; and
(b) selecting said plants of step (a) for a reduced time to flowering and for an increased vegetative growth under non-stress conditions as compared to the time to flowering and the vegetative growth of a native plant of the same species under the same growth conditions, wherein said increased vegetative growth comprises increased leaf blade area, plot coverage, rosette area, rosette diameter, and/or dry weight,
thereby selecting the plant.

16. The method of claim 15, wherein said amino acid sequence has at least 95% sequence identity to the amino acid sequence set forth in SEQ ID NO: 600.

17. The method of claim 15, wherein said amino acid sequence has at least 98% sequence identity to the amino acid sequence set forth in SEQ ID NO: 600.

18. The method of claim 15, wherein said polypeptide is set forth by SEQ ID NO: 600.

19. The method of claim 15, wherein said polynucleotide is operably linked to a heterologous promoter, and wherein said polynucleotide comprises a nucleic acid sequence at least 98% identical to SEQ ID NO: 399.

20. The method of claim 15, wherein said polynucleotide is operably linked to a heterologous promoter, and wherein said polynucleotide comprises the nucleic acid sequence set forth by SEQ ID NO: 399.

21. A method of selecting a plant, comprising: (a) providing plants transformed with a nucleic acid construct comprising a polynucleotide encoding a polypeptide comprising an amino acid sequence having at least 95% sequence identity and conservative amino acid substitutions with respect to SEQ ID NO: 600; and (b) selecting said plants of step (a) for a reduced time to flowering or for an increased vegetative growth under non-stress conditions as compared to the time to flowering or the vegetative growth of a native plant of the same species under the same growth conditions, wherein said increased vegetative growth comprises increased leaf blade area, plot coverage, rosette area, rosette diameter, and/or dry weight, thereby selecting the plant.

22. The method of claim 21, wherein said amino acid sequence has at least 98% sequence identity to the amino acid sequence set forth in SEQ ID NO: 600.

23. The method of claim 21, wherein said polypeptide is set forth by SEQ ID NO: 600.

24. The method of claim 21, wherein said polynucleotide is operably linked to a heterologous promoter, and wherein said polynucleotide comprises a nucleic acid sequence at least 98% identical to SEQ ID NO: 399.

25. The method of claim 21, wherein said polynucleotide is operably linked to a heterologous promoter, and wherein said polynucleotide comprises the nucleic acid sequence set forth by SEQ ID NO: 399.

* * * * *